United States Patent 7,868,149 (PLANT GENOME SEQUENCE AND USES THEREOF) - sequence listing, part 94

SEQ ID NO: 49176 - DNA, 5222 bp, Oryza sativa
cattattaaaaaatttaagtaattattaatatttctctatcatttaatttattgttaaatatacttttatgtatacatatagttttacatatttcacaaaagtttttgaataagataaacggtcaaacatatactaaaaattcaatggtgtcaaatatttagaaagggagggagtatatatatttgcatccacatgcatgcatatacactgaaccatatggtgaatattatatagtgtcactacgatggccggcacaccacgtggaacaattgcctaattgtcactagttaatatgcaattacgtaccactccatcaataaagacaagaagctagcgctagctacagctaggattaattagcaggcaaactaagcatctgaatcgatcacccagcaaataaaagaccagctgatatatgagtatgaccgatcgatcgatcgcgacaaacaagaaatacagtcgtcctagctcgcgccttacgtagtacgtactgcatcgatcagctggatctatgcataattattttattatatgagtatagtatgtatgcattgtcgactccaaacctcactttaatctgtaatcatgtcgagttaacattactacatgtgatgggaagaaagttaaaacaaattaaggaactcttgttgcagcgattaatttcttttttctgaacgcacaaaagaattgcacgtcaatatattagaaaaaaaagtttttgttacacaacacaatcagacaaaccggcttatgccaagaggaggaagaaaacaaagacaaaaaccaaggaagaaaaagaaaaactcatacgacgggtaacgctactccaatcagcgggagggggcaaagccacgctacactcccaacaaatccccaaaggaagcaacacccgctaacgaccacagctggccttccgaaagaatggactctaaaaccactgagaacgaagagagcagagtcaaaaaccctagagttccgttccttccacagttgccaagagactagaaggatcagggagtcgaagccggcacggaggcgttcaagtaaacagaccctagaagatggccaccagttctggagccagttgccatggggggagagggcagcctagccaggaggggacaacacctgtaaccagacctgccgagcgaacacgcagtcgagaaggatgtggttcgtcgtctcaagctcctgagcacaaaaaggataagtcaagtggccatcgatgccacgcttctggactagatcatccacttgaaattgctcatcgtagaatgatgccaagattggtgatccaacgtacgattgctatgccaggatgacctgctagagtcttgcacgtacgtatgcatttatgtgaatttctagtaagatactctactctactctactctaccagagtgagtatcatagaaagtacttaattactagctaagtgtgaaaatagaagaaagcttagctagcgaatcatgggtatgcattgcatggtgggccgatggatggacggatcgaacaaggaaggaggaaggttccgacgacgaggggatcattgatgggcccactctcggcctgtacccacaaacaaaccgacaccaatgggctgggcccactctcctccccgaccactttgggccccacacctcctcattaattcctcctcttctatctactgtattatctctgcctgcctgccacttgttttttttcccctcaattctttttgtcgaacattttccccataaataaagagtaaaaataaaaaaactaatacaaactcttagtgtcgtactggattgctcatatgcaccgtaagtatgaaatggaccagcccgtcacccgtaaatttctatctcctgttgttgatgtctactcttcccatcttaaaaacgaaaatcaaacttgaatctatacattttttttgggcgaaacttgaatctagataaatggtcgtccacattcatcatagtcaggatatgagggtgtgtttggataataggaaatgaggggtaggattaggatcggaaaataaatgaatgattaggattaaatgtaagagagagagaatggatggttaagatttaaacatatcttttggtgggtgagaaatcatttccttattccattagccaaacatggctgattgttttgggatatatagtgtatgtatttttctctatttctagcccataacataatataaagagcattctgcaaagcaaaatggaccggctaatgcaagcagcccatcaacacaagagataccaaattaggcgaggagcccatcaagctgcttcaagacttcagctgagtcttcttcacccttttttcgccgggagtcttcttcacccttcacaagactactgaagttctccacctatcagaacgcatctcctaaagtttaattttttataactatacatttctttgtgcctcgtgattgacagtaaaagataactccgcctctatcatatactgcttttcaataactgtcaaaaattaaaggatgggagtgagtgtgatgtgcgttgagacttgagagtatatatgctcagtaaaatgaagtctcagtctctcagatctttcttaccatttttgcatggcaaaggttggttgcattgcaggcttccttactctctaagtagagggcagagcaacgctgaaactatccaatcatcaatgaaggcagcttgttaaaaggaaagctctctctctccttaatgtgtgagtgtgactgattctaatgttaatataatctttctaatcatctcgtttagaaagtctcttttgttcttaaggagctccgatcgataatatgagcttgcattgcatcctcattttgtcggacagacagcaaaaacaaaagccattgatgtggtgacaatgcatatatgcaaaaaagacacttttgctgcaaaattaaagccatgcccccataccccataccgagaaagccaatgtctgctacctttatttattttcctttttttctttctccctttcctttccctccatgtgcttttgtttgccgtctctctctctctctctcttctcatcactggaattgtcacactaatgtctcattttacctgtaactttatgatcagataatgtttatggaagagctaaagaaaatggctacaaattaaagtgggtgagaagattgaaaaatcttcagagcatgcatttgggcagttataataatgcctgaatcagttcatgcagtagatcaaagcaagtggttaccggttgtaactgccgatgtctgatatttcaacgaacatttttgttttaccaacatatcatagcaattggaatctactagcggtagtcggagaagaagatttggtcacttgttgatctgaaaaaacaatggctcaaaggatataccaccgcgctttcgcattcctcttttcaattggaagctgctcgtctctcggttcattctttatggtacgagtatgaagcgatatcagatcagactggaggatttttcacaatttctttttactctttttgataagaaagatagtaacattgttcaagcatgatgtgtgttgggtttgtgcccatgctcatcttcactagcaggatgatactgatgacgatgcactaccaatgcaacgtgaagaggagttagtacatacaacaactacaagtgagatgatcactgatcagatgtggtggatcaaattatcagacagacagctttcacactaggtgagcactccactgcctgcctccggccctatccgagctgcttttcattctttggatttgattggtgccgccttttttcgctattgaatcgcactgcgagatgcaccatgatacgaatcaagtcaaatttctggcccaaacaaagacattgccacgctaaccgaactgttcaaacgatggtatcttttttattgatgcctctctaaactccacttatgagagctgagtacttgcaatccctaatttaagagcgctgagagcttgatatttcagatctttaaaaaaaaggtgcctgatatttctccattaccttccatgatctccaccatcagcttcgtgacaaaagaaacattcgcagaagtggtcaaaatatactggaaatattgtatatgattatcttgtttgcaaacaaaaaaaaatactgtcacattttgcattgccgacttgcttctgaatgtcccattgaataaatggccttttagataatgactgttgaataaatgtgtgatcatgcatgatatagtgcagtacccttttttttgtgtatgttttggaggtgggggctaaaacagtcagtgtgtatatcctgtatctgtcacacctctttttttttaagaaaaagaaaaaaaagtgccatcaagtaaaatgtctataaatagtccattacaagaacaatgctgcggcgatataggtggaagaggtactgatcatctgaaacaccataatgtggaagatgtcacaagtcgatgagtggaagccggtgatcgcaatgctgttctttgacctcatatctgctgtgacaacagccttgctcaagaaggcgctcgcggaggggcttgaccgtcttgtactcatcacgctgcgacaactagtcgccacgatcttccttgctccgattgcctatttcaaagaacggtacattgcctaaatgcaacttccagcaaatggtgatcagagttcacaacttgagctatgatgtgatactactgttggttttgccaccctctttttcaggggtaaaagacctaagctcacactggagatccttgtgtacctcttcttcagtgcagcacttgggtacaatctaaaaaccacttgttgatatcacattgaggtcaaaattttataaaactatatctatctaatccattgattgcattttttccccctctctgcttttagtgccgcgctatctcagtacacattcttctatgggttgcagtacacgaccgcaacattcgccataactttcaccaacatgtcccctgtgatcaccttcctcattgctgcactcctaaggtgttacatttttcaagcctagtacttgtctgcgctttgtttctttttttttttgtctgaatcattgggtactgttcatgtactcagggtggagtcactgaacatgaagaacaaggcaggagctgcaaagatcatcggaacactcatgtcattcgccggtgtcatgctcctcaccctctacaagggtgtggccttgacacaccaa

SEQ ID NO: 49177 - DNA, 4524 bp, Oryza sativa
gtgtacttgtgtagaacctcttttaggccttcatcctcgcttcgctcaaaaggttttaacatgtaagcgcaacacattggaatgactagtattaattactatatgctagtgaaactaaatgtcaaatggaaacgcgttgtttaaggacatgctcaagatttaacccaaaacctgaggttgttagataacggcggcacaagttgcttgcatttgagcatgtcaaatcattattatgtgtcacattgaacatgaaaggaaaagaaatgttctttgaatgcacgattttcgtaccgagagctcctgtgagggcggcgaatcaatgctttgtgatttgatttagacttaaagtgaccaattgctcatcaaagcagagacaatgggcattggatctttaggactttctcatggaaagatgttttctacttgttcttagtagttgctaaacaggctcaagctaatgttttagtgctgaaacagcatcctatgctctacagtagaagcaatgtatgcatgatcacaattatatactacttggttgccaaaactgaaagctttaaattgttccattgcactatgagaatactgttattccaattggttggttgcgccgttttctcaatgcaaatcttccatactgaagatattccgatgtcatcagctaatacttgcccacccccctcaactccaactcttgtgtttactcttcgtcacgtgttgcgaaaacgaaacgaaatcgaaatcatccttgcagatgccatgagcaccatcaccatgcatggcatatggctccctataaaaccatgacattaccaaaaacaaattgctcaaactaggccaccggatcaaactttagttgagagcaaaggaaaggcctctggttttcctgaaatgtggagggcaggatgcatggagcaatggatgccgacggtgtcaatggtcgccaccaatgttgtgatagccatcatgacagccttgatcaagcaagcactcaaccaggggatgaaccgcctggtcctcattactttccggcaaatggtggctactgtattccttggccccatagcctacttcaaggaaaggtaccaaagcaaaagtataactataataataaagtactgccaactactagtcgcttgtattttactgttgctgatcactgatttttcaggaagacaagaccaaagttcacaactgaaatctttgtctacatgttcttaagcggaatgcttgggtaatcatttgacaaatactatattatatgtagagagagttggatttcaccattcattgatacccctggatcaattgtttctttgacttgcattcatcaggccggtgcttcttcagtatacactgtttgtagggctggagtttacaacagcaacatttgctgcaactttcggcaatttgcttccggtggttactttcttgatttcactcgttttcaggtaactacaatttctttgagaaatctggaactcttttcactgaagagcactttgtcctctatatatgtctctctttaagtagctcaatatcaggcaagcagttacatttgctactatctactactccctctggtttttaagatacggcgcaattgactttttttttcacaaactttgaccagtaatatttattcaagtaaagtaaaaggactaccactaaatctctcataaaaaatactttaagcgtgcgtaatatgcttgtgcaaatacttctagataaaaatgaattcaaaaggtcaactgtgtcattttttttaaaaaaaaacagaggtagcatatgttaatagcttttcatttgaagttgtactacaacaccttaaaatcaactaaggccccaaagcacctaaaaggaaactccagctttgttgcccagcagaaagaaaattgcattgggtcctaaggcaccttcaactcctcacatgcttttggatttttttttcagtgaaacacaaaagcagtgaagtacttctcacaaactagttccaattctttataggtttgaagcacttaatgtaaagagcagatcagggagtgccaagatctcaggaacattggtttctctcagtggagcaatgatgctcaccttctacaagggctcagcactgacccatacaccatcatctagcagtagtccagcatccagcagtagccacagccaagctgaagaacatgacacggcccattgggtgctcggttccgtctcgttgctcgcgaacgtagttgggttcgcattgtggctgatgctgcagaggaaattcaccaggaagtacccagcaatctactctgctactgcattcatgtcattgttcagctgcttgcaagcaggagcacttgccttgtccatacaaaggagcagcatctcaatctgggctctcaaggggaaaatagagatagccacagttgtatattgtgtaagatctcttccagagctccccaaccatattttgcagcatttcttttatatactttttgtccattttgtttggcatagtcgaaaagtaccaactgaaaatagaactagccccgcctacttttcttcttctttttttgtttgaagctgcatacttaatttgcatgtgcactcttctaaaagaactctagacaaaacatagagcatgctaaaatatttgcacacatgaaacatatgtactataatataaagagaaataaatcaacaactttcatatctttctgtatgttacacaaataatcattcgtgcacgtattataaaaattctctacattattcttttaaacaaaatctagttaggtgtacataatactacatccacactcaaagaacccataatcttctccggtggatagtttcttatctacaaaagataccttttgtaaaaaaagaaatgaaaaggaaagaaagagaggggagaagatagtgttcattggaccagtatattatatgggatggatggatccatcctccacaccatgcatcatggaccagacctttaggataacattagccccgatttgaaacaaattattcaacagattatctacttaattgtaggaataaattaaatatttttagaaataaacttaataaatagcttcgaacaagtggcctaagcaatgtagtagaagaaagttttttttttaaaaaaatagagatgtggagcaaataatccgccataataatccatgaagtaactgaaaagaacaaggccagatcattataaacagttttcaactcttctttttcaatgtacagagatccttctacaaagccttatttgaaaagaaaaaggtctaactttcaagtttcaatagaaagggattggttaccactcaaacctgtctttatgacttgaaccgtttgcacagggggtcaaattgttccctttttactaggattcttccccttctatagatttttaatccctacataaaggtataaatctaacatatttggagagattattccaggatagccaggtgaaaaaagaaaatttagcccggcgaaaaagagattattccaggataaagaacttacaatatattaaattgataagcctattggtttctagcgtgcagcttaaaagatctttactgaaacatgtcctatggtcctttagaagtatcagattttttaagtgtaaattttgatacctcccaaccatgagcatgatggaattgtacaatgggacataggggtggaattgtatccccaaagtttttggcaaacaatatgcaatcaagtaggcataatatgtatatagaccattagataaaaaagaattattaagcccaaaatcaccatttccaatatattatagtttattttgagtatataattttatctttttgttctatgcaaataatttttatttgcactagtaacaaaaactagcacctcattttctgaagttctgttgctcctatttcagtcaaaaagtggtatggtgctcttctagcactgatgtaacaagaatttgcgacatatcgaataacaaaatgtgggcattgcatttgttctgtgaaatttgcagggtgtagtggcgtctggctttgggtacctgatgctcacatattgtgtggagaagagaggccctgttttcaccgctgccttcagccctctctcccagatcttcgtggccggcatcgatctcttcatcctccacgagccgctctatcttggcaggtactaattcttaattaatttctagcacaaacgaattgattgattcattcatgattccataagttactgattgttggtatggcactaaaagaatagttaattttttgcagtgtgttagggtcagtcctggtgattgtggggctctaccttgttctgtggggcaaaagggaggagaccgccgccgtcagcaaagatgccattgcttcgccggagaagccagtgcaagacgtagaacagcagcaagagaaagtgtgattgatattgattcctcttagctaggctgcatgctatctgcaaatgtgttgcaattaacttaacttgagtgtttatgcatttgtgatgatggagtatata

SEQ ID NO: 49178 - DNA, 8289 bp, Oryza sativa
gcacccaccggcttcccccatttacgaagtcaccaagtccatgctccgcacccagtacgcctcccagactcccaagcgagacaccggcagcaaccagcagctggaaatcgagatcgccgccgagaagccccgccgattaatcacctccgatggcggcgccggcggcgaggccaagccggagtccgctccacctagcgaaggaggcgatagagggggcaaggggcccacgttttcggatcttggggggatggagtcggtgatagagcagctaatgatggaggtggtggtgcccctatgccatccggaggtgccgcgctggcttggggttaagcctgtggctgggctgctgctgcacgggccaccaggctgcggcaagaccacgctcgctcatgccatcgccaatgagaccggcgtgccattctacaagatatcggcgccggaggttgtgtccggggtctctggtatgctatccgattcttttcatgaaaactctgaacttagctaaacctttgaacatgtgttacaagcaagaacaaattagtttaacttactaaccaccaatcatgtttgctgctgggatgcttgaggaatgctaaattttgcaaatgctaatgtggtgttttctgaatcgcaacttctcaacatactagcaaatttggtaacctgttgtgtcgatgtctgcaagttcaggttgttcgttttaataacttataatgcaatcctcacttgataaatggaatttcatttgttaactaatggactctgaagctattagtgttcaatatgtacaaatagaccaggatcactgtttttattgctgcttcttacattagtcgtttgatctacttcacttagttttctttctcattagggaaggagtgcccgcaagtctagccgaacatagaactggtagtttctgcttgatgtcagtgtggcatgagattgatcctctatcaaattaggttcctgagttctattgttatactggtaatagtaatactctgccttgcaatgaaacataacacataggctttaaaggttctgattgctaatatgttctgcgatgacatagctccactgagatatgatccttagttgaaaccatatcggtcaagctttgtccttaccctgcataccaaatcagatatagcctatctcctattttcttttaccttttttaatatatatttcgtccctactcttagatagatctcttctatcagtagccatataagggtacaccttgtaaaccctcgttttcttgcaggggcttctgaggaaaacatcagaagcctgtttaagaaggcgtacaggactgctccatcaattgtatttatagatgagatagatgcgattgcatccaagagggagaatctgcaacgggaaatggaacgacggatagttacacagttaatgacatgcatggatgaataccaccaacaaattggctctggtagcggtgatgtgggttcagagtcagctgaaaagaaacctggctatgttattgtcattggagctacaaatagacctgacgctgttgaccaagcacttcgtaggccaggaaggtttgatcgagagatctctcttggtgttccagatgagtatgcacggaaaaagatacttatgatgcttacccggaatcttcgactggaaggtcagttggacttgttgaagatagcaagggccacatcaagctttgttggtgcggacttgaaggcattggtggataaagcggggaatctagcaatgaagagaataattgatagaagaagagctcagttttgtcaggagcatgatgaaaacagcaagcacgactggtggagacaaccttgggatgcaaatgagatagagggcctgagtattacaatggatgattttgaggtgaggtttccacctgttacatgtgcagctcaagtccaataactcctctgctaatgtcatcaagtgtaacttctaaaatagttttcctggccacgtatccaatgctttaatcatgattagttctgatctcatttcaactgtgtgccttatgtggactaaatagccatgctaatgaacctttctgctttttgtttgctgaaggaagcaaccaagatggttcaaccatctttgagaagagaaggattttcttctatccctgatgtcacatgggatgacgttggaggccttgattcgctaaggaaagagtttgaccgctacattatccgatgtatcaagcaacctgaagaatataaggtgaacatacttagtatgtcaataaaccgttttctacaattatttcttatgtctgttctattgttcctcttttagcgatgatgcagcctagtagtttaaagtaccacatgacatacccatgatgtttatttgcaatatgttttgaagtttaggactccttttgcagtacttttacttatttgatttttttattccatgtccgctttgttgtctatattttccagacatttggattgaatatgcaagctggctttttgctgtttggaccacccggttgtgggaaaacactgatagcaaaagcagttgcgcatgaggcaggggcaaattttattcatattaaggtagttgatgcttatatttctgtattttgaccacgttcgttcagatttatacaaagtaacgttaagatattcctttgtgtgtttaggggccagagctgttgaacaagtatgttggtgagagtgaatcagaagttaggaaaattttcatccgtgcacaaactaatacaccatgcatcctgttttttgacgaggtaaaggattttggtttatctagccatatagtctgttccattgatgaaaacttggacacaagttactgaatgactccgaatgtttgataaattttgactgttaaacacacatcaagcagtgtatatgtgtggagtatgaagtcgtttttccaattctaagacgctcaagtgtaaacccatgtgatgttacaggtagatgctttgacaacaaaaagagggaaagaggggggatgggttgttgaacgtctcctgaaccaggtttgaatactttacaagttaatatatatttgcggtagttgatctgctaacaaggttctttttgttctgtgttactctaattgttttgttcacagttgcttattgaacttgatggtgctggtgaacggaaaggtgtttttgttattggagctacaaacaggtgctgtcagctgctgataggttctccttacatatttatcactgaacataaggctgaaactgcagctccttttctggtgcagaattgatgtgatagatgatgcagcacttcgacctggtagatttggcaagaaacattatgtacctttacctggtgctgatgagcgggtttcgatattgagagccctcgctcggaacaaaccgatctcctccagtgttgatttgggtgcactggcacgtagagaggaatgcaaaaatctcactggtgctgacctagcatcaatggtaagttatgactttttgttgagtggtttctccatttgaattttgtacagggtgatcatgtctgctttaatttggggcaatgtagttctttatatgttttagttgattattttcttcccctaggaacctatgggacattttgtgagttaaaccggatattggagtgattatagttgctttttgtttgaatattaatcatgtgattaaagaaacgtgcaaaatggaactaatgtggtccattcttcaggtgaatgaagcagccatggcagcattggaagagaggctggagttcctggagaatggggaatcgtcaatgagctcatcatctgcgattgagctccctcattttgaacgtgctctagcaaaaatgcagccatcagtatctgaacaggttagaagctcttaatagttcataaatgtcttgttgctatagcgaggagatgtacatcagattgtcatggtcaacccttttgatgacacgtttcaccttggttttgttctttggtcacaacagcaaaggagacactacgaggcgttgtgcaagaaatactccgcaagctgatatatattgcgccatgcttacagagatccatgtcctctgagttgcttgcagggaaaatacaggtttcgcttgcaaccaattttggttttgccctttttttttgttcccctttgagtaggccttgtggcaattttgtgcgaccgaaacatagatggttgagtgagtagtagtatgaatatgcgagaaaaatagttgttttttttttcttttcacttattgtaccattcatcatcttgtattgtaatacaaacttcatattggttatgagattgcataatcatccaattaagcccctactatgctccaagttgtccattggattgagctgctgctgctgcttggagcttgtctaatgccgcccagagcttgtggtctttgtagtccctgatgacgagggacgctccggcggcgacgaccttggcctcccgggcctcctccgcaacggcgatcaccggcatcccggcggcgacgccggcctgcaccccgaccaccgagtcctcgaagacgagcgtgtgacggggagacgcgccgagcaggctgagcgcccggaggtagggctccggcgagggcttggggaggtcgcagtcgtcggcagcggcgacgatgacctggaagaagtcggagaggccgaggatggagatcatgaggtcggcgttggcccgcggcgcgttggtgacggcggcgcgcttgaggccgcgggcggcggcccaccggcagaggtcggtgaggccggcgacctcgcggaggccctcggcggcgtagcgcgcgaagagggcctccttgtcggcgaataaggcgtcgaggcggtgctggggccagtccgggaagaggaagctgccgatctggtggttgctccggccggccatgtgggccatgccgaactccggcgtgatggggacgccggagttgtagccgagggcctggaggagctcggagaaggccctgtggtggaacgggtcggagacgcacatggtgctgtcgatgtcgaacagcacggcctccaccagagacacctccgccaccgacatcctcttggtcgtcgtcgtcgccatcgtctccatggccatggcctcttcctccatcaagctcaccatcatcagtactgttattatattgacgaaggcttggttggttggtgtggttaaagttggcgcggttggtgaggtgaggtgacccgtctcgccttctttttctacgattcccgccatgtctccaccgaccttatttttcccactgtttttgacttgccctccaccgctgagtctgactgaacagtcaatatattgactctctgaagcaagggggaaaaatccattttaactcgtaggacttgttcggaatataggaatattaaaaatggagaaataggaaaagccgagaaatttgataggaaatgtgtaagcaaaatagaggatttgaagtacatgacttttataggatgggtatccggatgattgcgagaaacataggaattgttctggaggaatgcaacgtaaataatcaacaaacaaatataaagccagctgacaattgagtctagtgcatataattgtgtatgacaccattattaaagtagagtaaccaaaaataatagagttggtataggcctttgggcttccacgaaaccatggcctacctttcagttcacaaagaagtcagaaggaaagaagataaactttgggccgtttgcaaagaacagatgaactatgggctcaattcttgagcccataatggacgaagcttgaccactgtatggcggagaatccggtgcaggaaacattgaggagcttctctcttctgttgatttatgcagggaagattaggattcgggattgaggctctttgtgttgtaaaccaacacgcctattaacggatcaccggatccgttcactgtccctcccacagcagtagaggcatgagatgatgtagaacacccgcgtccatccctttgccctcaagaacattacagaagtagacaatgaacacatatatagggtggagctctctcttcattatagatctcatctggagtacaagccagccattagccattagatgtcacatcctgcccctgtatagataggggtcttaggaggagatagaccttatctctactccggttcggattagcccacaagaaacttatctccaagagatttgtttcacaacactcccccttaggctaatccacgaccaactcatgcctcgtcaaaactcctaccaaaacccagtgggaaaaaggctaggagaaagagtacatagttatcgctcatgcattgcacgttgttgcctcgttaaaaaccttatgtgaggaacaacagctccactcactcaagggaaaaagagtacaacactaaggactacacggtccatattgtgggtcatgttctagggtgttctccccctgaacctagcaaacatcaaagtcttctcatcccaattctccggaaaagcttccgagaactaaaagctgggagagactaggtgatcaatcctctagattatcattcaacttgaattgctgctcatctcacctcccctcaggagtctgtgaggtagcccacttgtatttggtgtcagtcaataaagacagatcttattatgataggaccttaggaacaggtctaagtgatcgtcatcgagtcaatgccctgggcatactctaagacatttcaatgtctcgcaaatgacaatcaacacatagcacatactccccctgatgacaacctttgtcacagaccatgttcccatagcattaaacatctctcagatgtatgcgtaggcaagaatccttcagatcctcaaaccattagtcttaaaagacttgtctcatttcaccgctaaaacgagaatagggaacacagagagtaatgcattccatcactatcatataccataataccatactgctgtgcaacgcaatctgtttcatccttcagaaggattattggataaataagtagcaacggcacgcacctcctggtcgtgaccccatcaagcacttggcctgatcattgcaactttctctgactgtgtcaccaacaattagggattcacaagatcaaccgaagccttccaaagacatgttgtaacaatcagagtaactagctagtctgaaaatttaagcactgtgggggataacacacagccaacaacaccaagtatacctcaatagctattagaggacaccaccattccaaccattaggtggaacggatttcacgagtgtacacactccagtgataatcacgagatgcacatgtgcctacagacctcgtctgtgatctcatcaggttcctcatttcaatcttaccgggtcataaatgggtcatcatccctccaagggattatacaatatggtgtattcagacttactaattattttgtatctcagaggaaaattcatcaatgaggtctccccctcagagaaaattccgtccatgagattttctcccaacgggagatggtactcttaccggaatacctattggtacgagatttgcatgccgaaatttcactatggagtctattcaagacctcctcatggatttcccaaatcctttaactgcatatttaatttcatgccattttgccaatacctttgtttagtggaacattcaactcacgtggaagaggtctcatgaaggacctacttgaaccatcgcgcatcaccacctcattatattaataatgacccataaaaatccgaacaacgttcgcgattttcaattggcgattcggttcaacctcaattgcatttccatttgacccgatttgagcaccgtatgctcatgccatggacttgttccggatccgggttctctctaagagaatcattagcaagaggcgacgtagtgtcgacacatttattcctacttacacatttaaccagatcttcgtcatttcccaaaatgatcgatccatggttgttccatattcctagcaccataatatgcgcgcattgctaggaatgtagtctccacgacgaacatcattatgaggtatatcaccttccagaggtgaattctccaccaggagaatcagaggagtatgctcacatccagtgagaactcttatgctctgactaaggactacggatcgtgttagcaggcgtccccgcacaacatgatcaaatgccataagtcttatgtggatacgatattattcccgggtctatccacatttaccacaattgggagcattactctttttaacaactatctagttgttcctcatatgattttgttggcaaaaactc

SEQ ID NO: 49179 - DNA, 3663 bp, Oryza sativa
ggagacatttgtccatatatgcagtgagcctagacatatacgaatacagtggcatgaatactgtattcttccttcttccgaagggttatcctcaacctcctagttaggatatacaggtttgcaaaaaccaccattgctatcaaatgtatatgcaaccaacatgcaatactttagccaaatgcactctccatggattaatgctcacctagtgccattcaaactcacaatcgattccggatcgacgtgcattacacatggcatgtcatatgcttaagaaggcaacctatggtggcaaaatgcattccgatgtgctcaacaaggagtatgatagcaaaatgcgcggccactagcctgcgctgccaaccatattttgtggtgcagagttgttttaaagtccatcttgtttaatgcccaagtttgaccccaattactcataacaaactctagaattgggtcatagttaagcagcatgtattaggtaccatccactagcgaattattaaaccacatttgctaatgtcccctggacatagccatcgagagataatcaatacctccaacaatggtaatattcacaataaaaccattatattcagacatatccacaaaaatagtggaatgtgtcggtgcaaccgtcgttggtataacgaagctcaacgcatgcaacacgacgaacctttgcatggcttgcacatgtccacacgcaaaaaacgccagtgtgcgacaagcatggtcatcaacccatgggatgatcaaccaacacaaccagggagtagtcatcgactacgagagcgcgataaaacgcaatagtgcatagccaacctttgtctgaaatacagttacgtcgaattgtgtgagtggttgtaactcctcggattatacactaattgttcttctaaactaaagcattttatcaattccagcatgaagataagctttagaatagaacaggaaagaccaagaacgttatttatctgagaaatatcgatctaatgcaaagttccaaactaagcaaaagataaactgcttggcaacagtatagtcgaccattgtcctcctaggacatgctctaaactggccatacaactcctgttgtcaaaacaactttattagacaaacactacaaacaattggtcaacaaccagaggtggcaatttagcgctagatgcacacgaggaccgagactgggtcaacacccaagtcaagctgttggcgctatagtgaagtgggaatcatgcctattcacagcatctacccttgggcttatccctctagatttgcctcctcttttccggtgtcctcgcaagacatcaggttccaaataatattgagaaaatttgtgcacaccaacggcaaccatacgaacagtgtcattccaccatatgaaaaacactttacatctttcaccgggccaggtgaaaaatatctcaaattattgaacctcgcaactccacgttgccagaaaattgaggtataatcatttatctccaaatcagaaaagcgtgctctcaaccattgggaaagcaaaaaaaaatgtcgaccgtagtccggccatactctgattgagatgttaagccactaggggaaagacacaatgaatcccaaacacattgtctaatcccacacatttcaatgactcagaatcccattcttgagtgtgatcacagggatagagtgatctacattaatgcccaaagccatacaatagtcattgaaggcttttacgtgaaatcacccacactatcatccgaatcgtttcatgcggttctcagagaacgcaacacgcaaactgacgatatgcagagtgaattcggcaagagcatggatcttgtacaacaagtatacgtgactccatcttgtagacacatcgatatcaccatttatgtatggaggagtgtatcagtaaagagtggtcttatctatagccatggatatttaatttcccagaatttccatgcattaggtgattttctattatttacttggtcttattggcattatattcccaatatttatgccacacagaaaaccatcacacataaatgcaggaaaataaacccatcataatgcttccaaggggggattctacactgtatgaacacaatttatggaagcatcataacctagaaaaccatctctagattatttagttggaattgcatcaattttaaaagcaaagcaatgcttaaaaaacaccattacatggttatttacgagtccggagacccacatgcaaaaccaaactatacaaggcctaagcaacaagacataaccacacaaacaaaattaatataatctcttgttaattacaaggttcaaactgtaaaattgcattaaacagtgaactatagcataaaaacccaacactccgggggcttaaacgcaagttgtcaataaaccgaaattaatcgggccgaattaccgttcatgccacgatcttatttgggctagcaagcacagtgtagcccaacatgcctaatgggccgaatttccgaaagtctaggcccatgaggatttccaggtttattatttttattaatttgtttgggctatctcgttactgttgggctttattcggtcgggcggaggcagaccggcccaaccggttcgcctaagtgaccgagagagggaagggggggaattagggtttcccctttcccattcattgtccgcaacggcgtccaccgcccggcgcaccggcccctcgggcatggcggcagcgttggaggccgtcgactgtcgactttgaagggatttagggcggtgcacgcgaggaggtcatcgacgacccatccactaccccgattggcaggacggcggcgatgacatcactcccgtgtggcaatttggtgcggtggcggctcggtggcacacgacggagctccacgttgacccgcgcatccttatgatggtggcgaggcgaactcaacgacgacaactgagacaccaacaacggcaaccaaattgcatccggccatatcgtctcggcggaggttaatccggtagcaggcagccgatgacccatcatcctcctaccacggctcgacggcagcgtcgatgggaggtcaacggcggcaacggcgacatgggtttagggatttctccgagacggcggtttcctgcgacggcatcgacgtaaggccgacggcgtacccaacagcgacggcgaacgacagttgacacgtctccaagtccagcaaaacggactgagattatgtcaccgtgttcccggcgtggcatcatcaaagaaagagagaaacagagagatgcgaggtaggagggcgagtcggctgattcggcctagccgaattaggcacgtctccagtccagagtttcctatcgattttaatgatttctctcacacagttttctccagttttcatcaaataaaatagatgcatatagatcaaaagcagaaaattaatctaccgctagatcaagagcagaatcaaatctactgcaagcaaagcatccatatgataaaaacgagaaaatataatcaatctataaaacatatagatttcatgccttaataggcacatgcccggatgtatatatatgaattatagtaaattagtttataaactaatcttactaattaccgtgatttgcgcgtctgtcttagatcgcgcggttgatgtgcgtgtgtgcgtcgaccaaccg

SEQ ID NO: 49180 - DNA, 853 bp, Oryza sativa
tattcatgttgaaacctaacatatattttccctatttagcaaagctggggcagcatttcctttcattaattgcaaagttgcttctcagataattatgagattcaaccaaaattttgaattctgaccatcaattatttctgatatgcttagtttaaaaataaaagaattaacatatgtagatttgcctcgaaagttactacaatatcagaaacttattataatataaaattgattgttggaatttgataagtttgaccgaatcttgtcctaaacgtcaaatattttttgaacaaagggagtaatttggtagagaatcgacccaaacttgttatacatggagtaaaccaaccatttttttggcaaaagtaggaagaatccttcagccactaaacctgtttaacttcattaaaaacttcaagggagcttataaacacttcttttaaacaactggctgaatgacatcaatgtttatactgccacagggaattatggggtctggagtgggctacgtactgatgacatggtgtgtcgaaaagagaggtccagtgttcacttcagcctttattcccatcatccagatcatggttgccataattgatttcttctatcacatgagaacctctaccttggaaggtaatcttgtcttcagttcttaaatcaaggcatggagtctcatgtttctttcttaatttattcctcttcctgatgaagaactgcagaatctttagtaacagacattggatatatagcacaattttattctagctagtcttattattttctaaactaaattctagtcttattaaaagagtgaaatggtacatagatacatcacattcaagctatgagtttt

SEQ ID NO: 49181 - DNA, 704 bp, Oryza sativa
gggcgacgagaggcgaaggcgaaggtggcggcgggtagaggagacaccgggggtccttttaaaggggctaggaggcggcggcgaaggcccacggcgaccggcgacgagaaggaaagtttgggaaaaacgaatccgaaacaaactcgaatccacgaatttccaaacgattttagccgatgtttccaaaggagaaaaggtagaggagatcgagaagatcatttcccctctattgattcggccggaaacggaaaggaacggctggatttggaaggaaacggcggcggcggcgcgaggtagacgatgggtccgacaggtgggacccacctgtcagcgacagcgagggcgcgcgcgcggcggctgcggactgggccggctgggccgaggagagaggaaggagttttgggccgactttcggcccaaagccaaaagaagacttttaaaacctttttcaatttaaattatttcttaaatgaaattccatttattaaaaatacttccttagctcaaataaatcctagaaaaatctaggaattatagaattaagcaaagtatttattgaaattttatctggcccctttttatattggaatttattaattaaaattagatcttctcttcaagacttttaaaataaattctaaaaattccatttaaacaacaatttatatattttgaattttcagggtgtgacactgatcatgaga

SEQ ID NO: 49182 - DNA, 15468 bp, Oryza sativa
  unsure (1)..(15468): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggtgcaccacatggacgtcaagtcagcgttcctcaacagtgagctccaggagatggtatttgtttagcaaccacccggcttcatcaacgccaacgatcaaggcaaagtgtacaagctccataaggtgttgtacggtctccggcaagctccttgagcgtggaacgccaagctagatagctccttgttgtcgctgggtttctgttgcagcagctcagaacatggagtctacacacgtgccaccgccggcaagcgactgatcgtcggtgtgtacgtggacgacctcatcatcactggtgatcacactgaagacatcgctggtttcaaagaggagatgaagaatctcttcaagatgagtgatctcggaacactcaaatactacctcggcatctaagtgactcaacgcagtggctgcatcacgcttggccaatctgcgtacgccaccaagatattggagaaagctgggctccaagactgcaatccaagtcagactccgatggaggtatgtctcaaattgagtaagaactccgattctcctttgatggattcgactttctactgcatcctcgtcgggagtcttcgttacctcgtcaacacccgccccgacctggcatatgcaatcgggtatgtcagcagattcatggagactcctagagaagagcatctctctgctgtacggcgtatacagcgctatgtggccgggacgaggaactggggactcacttacctcggtgggaaggaagaaaagcctagtctgctgggttatagtgacagtgacctagcaggcgacactgacgatcgccggagcacctctggacaaatcttcttcaccggtggaagcccagtcacctggcaatcctccaagcaacgagtggtggtggctctgtcttcttgcgaagcagagtacattgctgctgcggtagcagcatgccagggagtgttgttggcgcgactcctgactgatgtgctggaggctgatgcgcctgctccaaaactgatggtggacaatcagtccacaatttctcttgtcaagaatcctgtgcatcacgaccggacgaagcatgttgacatcaaatttcattatctccgggagtgcgcagaacaaaagctaatcgaggttgcgttcgttggcaccgctgatcagcttggggatatcttcaccaagtcactcggcagaaccaggttccacgagctgtgttccaagattggtgtttctgatcttcgtcaaaggagtagcaagaattagggggtgatttgttgaataaatctagctgctttgtttgttttagtttcccctgttttcggtttttcctagtcaagcacgatctggctttgttttcaggtcatgtgtagtaaggcttgacgcgcgctgagttcgcgcggagctggtgtcgtgtgcgtcgtgtcctggatcgtgggatggcacgatgtggcaacggatacgtgtgcacacatttaggagtccacttcctttcagttgtaactttccttatttatagttcaatgcaacaatcagaaaagctgcagcttcacagcaccaaaaacctcacagagttcgtttctttcttctttgcaaaagttcgagaatcttgagtgtttctgtcactcgacttatgaattatgactaggttggcctctgcctcaggatgctcgtttagattgccatggggcagtggatggaacgctcaatcctggccatggaacggggtaggaagggcctttttggttggtgtcttgagcatcatgcctgagaggaataggagaagttgatgaaaattgcctagctaggcagcctggcattttgcttgtttggttgtgcatcgttgcctgaggggaaaaaacatggttagagtttagatagtactgctaagagcatccacagtgtgtaatcgattttaggattataaggtcgttgacgtggaatttaatcgagagctgcagtgttgcatcagatcgttgtcctcaagggaacaataaaaaaaattataagctgcttcttggctggacagatgaagccatgcttggcctgacacccgtatctatctattcttgcgcctggatttttttaatcagcaatgcgtggtttggttcggctcgtctttggagttcgatttttcctctgacacgcaccagtcgaccgccccagtgtactctattcgatttttccgtctcacggttcgatttgtccatacactggagtttctcaaactcaaatgctaattgaaagacaaatctcgattcgcctagctttgttcacttttagttgttcgctcttccgaacaaatcaatttattgccttagcttttgatgaacgaaccatttgcatacatcaagaagaattaaagaatgaagaacataggaaaaaaaaaatcccaaatccacgcatctagcagaacgccaacctagaatgatttctgcgggctttctttccaaggaccaatcaatcatcacgtacatgaagaaggagaaaaagggaacagaatgcaatgacagaaattcccaaaccatcaacgatttcttcaagattcaactgcatgcaaagcgtttcaatcgtttcggcagatcggcgactgctgttgcttcgtgcggaagatgggtcgcagacgtcgatgtcgcgccttgaccagctcccacgggtgttggatccattcgccggaggggactgcgaggcgggggtggcagtcagtggcggatggtgtgtgcggaggagggggctgcgaggaggcggcgacgcggtggagaggcagggggcagcggttagtggcgcaaatcctggtgagtgagagatagaagatgggagatccgcgaggagggtggggcggcgtgaattccttgaagagcggagtgcgtgcgatgagagtggatgggagcgggaggaaacgtcggatgatttgaggcgttggattagaaaattctgtatcattggatttgacgaatgaagtacgaaggatgcaagatctagttggtgaactcataaggtgtaatataataatatgtaatataaggtgtaatagtaatataatactgtcactatttatcataccataaatctatctattatcttctattattattattattatatactaaaagtccattaaaaatcctaaaaacacactcaagtcgccatgtgtcactctataaacactcctataccaccatgtggcactatctaatctcaccatcgattttcatttaattggtggatccattattttagaacattagattagatctgatttttattaaattggtggacccattacttacactgatcattagtatataatatcttccctttataaaagtgaaaatacgtacgtcagcaaaaaaaaaaaatcaagtatctccggtacatatgattcgggaataaaagcgttcacattccgttcgtcggaagaaaaaaaaattgcccggccatgttataaaagagacagagaaaaaaaaaagagaatactataaacactcctataccgtcacgtggcactatctaatctcaccgtcgatttttatttaattggcggacccgttattttagactaatcattagtgtatatataatatctttcctgtataaaagtgaaagtacgtacggtcggcgaaacaaaaaatcaagtatctccagtaggtatgattcgggaaaaaaaaaacgctcatgttccgttcgcggaagaaaaaaaatgccaggccgtattaaaaaagagataaagcaaaaaaaaaagaatataattttctaccgtataagatacagcgaaaaaaccatatatccgtagtaccatctatatctatctactatctatctattatataataaataaaatccattaaactttctacaaacactcccaaaccatcacatggcaccctataaataatctcaagtcacaacataaataaaatagaaatctaaccatcgatattcatttaaatcgatggacccattattctatatcattagatctattgtagaaaaccaaaacctcccacgttcccatatccgtgcaccacacacgtacagatcaaattgcaggctacctgttcctttctccttttttatccctatcacaatttaaattaaaattatcattatgaaaaacaatatcataaataggtgttaaagtccattaaacattctataagtatttctaaatcattgtatgacattagagaaacttctatccattggtttccacttaaatctggacacattaatttacatcattattggatctatttttttaataaaaaaacaccccaaaccatcttccctttctctccatccctatgggcgttttgccaagctgctacttgtctcacttaaattagattctaataaatctgagaaaaaaatataatatccaaccatcgattttggcttaaacttcaacacattattttatgtcgtcagatcaatcattttttttctaaaaaaagaaacatcccaaacctccctccatccccgttaccatgcggtgtgtggtgttacttttctatgttttttccggctctatgataattaaaataaaattatttttatggacaaagaaaagaccacaaatgaatctccatctattaggtctagctggctattatttttttaagtgaaaacaataacttaataacgatattgcctatatttaagtgctgaaaaatttactttatgaacccacatccatattgaagcctctacttaataaatataaaatttgctacaggacataaaagaagtgtagttagttgagagacactggaagaacatatatatgctatgggacacagaaaaaaaatggtaattagctgttggatacccgtggcattatttttttatatccaaaggaaagggagagagaaacaatcgcgaaagtatgattttgccccttccttccatgtgtggctcgcatatagctctgacgccattgtagtcatgacatggcagcgtgtcgtggcgcagctgcgagaccgacaacaatagcctgcgctctgcggcgccctgctcgatataaatcaggaggtgctccatgttgtgctcacccccaagcgcggtgtgtggtggagcatcgacaccggcatggccctcgcgctgtagcgacacgagtgcgggaacgacatggagctacgggccctccttgaaaccccctccccctctagatagccacctcaccggcggcgggtgcggttgccgcgttggaggtgtatgcgagccggacttggtagccaaggggcaaaattgtacttttattattgtttctctctccatttccgttggacattataaaataatgttgcgggtgtccagcaactaaataccagttttttcggtgtcctacagctgatacacattcttacggtgtccctagctaattacctttttttaatgtcctgtagcaaattttaccctaaataaaataaaatactaaagttgctcactaaaaatcaaagtatcctagcttaatttttttataaaactggtagacccattatttatatcccgttagacatctaacaactttctatcaactttattaattttgttctcagcatgtatacatgagctatttacccatacattttgatattgatgcttttatgaataaatgattattttaggagataaataaataatcttaagatgatcatatcatctaaattatatatatgatctatgaagttacgtggccagttgaacaacatactgatcatactaagcacgttggttgcaccaaggaatcttaagagtgaaacaaccatgatgtgccctcaacaatatataagccaattccagataggaattaaaagaccgtatccatttacttttcgggtaaaacttgctacagtacattgtgaatttgtgacatagcatagaacaatctagaaacgtgtaattattacatgacactccggtttagtggtaatttgctaagaaaatactatggcctctattttaaattttcttacttgattggagcgagataatttagaatggatgcctttaccccatgccaagttgtaggatcaacccacttatattttaatcccaaattacatacatcaaagcatttcaagaagcttcatagagtggatttgtccaaaaaaaatgaagataaaaagaaatgaaaattaaacaaagtttatctaattttaaatttcttttcgttgggtttataacccattctaaatagaaatatccaaacattttaccaagactaatcaaatgaatatatttaaaatttcaaacagaatttaacaaaaaaaagggcattcatatgaaacacatcaattgtttcgatacaaaaattttctcatgaattaaaagaacacggttttgaagtatttttagttcacaatttatatgttgcaagtaacgaacgttcaaagaaccaggggcggatccacagtatatggagtggggtcccactcaaatttaatatttagtgtattactaatgtgtaattaagtaaaaaaatttaagcacactatcaattctaataagatgcccccactcgatttttgggctaggtccgcccctgcaaagaacgttaaataagttaaattttagtttatgataaagtaaaaaaatatttttgatataaaaccatccacacatggacattcgtaataaaattttacgcacatgcccgcgcatatgcgcgggctaccttcctagttttgaactaaaaatttaacctgtacaaaacaaaagagaaaatagaaaaaaaagtcaatagcagtaaattgaaccactcgtagaaaatcttataatcttacaaccaatttggttcttaaattgagataatcattgcatcatttttaagtgattaaatataaatagcgttccctctacccctatacaaagcattctccatatattattgcatatataagccacacaaagatagcaatatatagttagtttaaaaattatatttcttactattaaatatttttaatatgcatgtttactaggtatattttaacaaaacacactatagatcatgcatacaatgtctacaatacatatatatctactctgtctttattaattttatgttggtatgtataacaaattatggtaatgtgatccaactgaaaagagggttagtttgatagtactattagcaaatatttgtttttcgagatttgttaaaaaaagatcccaaaacagtccattaaaaaaacacctcacttccaatttacacttaatttattagacacattttctaaataaactaaatctatctaatttattaggcacgttttctaaataaactaaatatatctttttttcgaatgataaagaagactataaataattccgcataaggataagttaaatatcatctttaaaaaatctattatatactaaaagtccattaaactttatagaaacgctctcatgccaccatgtggcactctacaaatactcctatgccaccacgtggctctctaataaatttagagaaattaaaaaaatctaaccgtcagttttcatttaatctggtggacccattatttttaaccattggatctataataaaaataaccaattaaatttatccttaaaaggcccacatacatgccccacatacgtgcatgaacgtacgtacttcgtgcaccgggccccacgttcctcttttctttttttctctctttttcacgcacctgagataaaaaccgaattaattattctataatatattatgtgttttattcatatattattagatatttaatatcaaatatattattttgacaccgtgtcattgtcatttatctcccagtaaagacttcgtttgatcaagctcattgtgtgagcttatccagggtacgcagaatggtgcaagtcattagcacatgattaattgagtattaaatataaaaatagaaataaatttgttttatttttaaaaaaacttttatataaagcatatttgtaatacacgcaccgcgtaatataccatttagtagttcgggaaacatgcttgatataaataagggagtagccaatccgataagcactttagaacatagccttaaatgtattatttaggtagtaaaacattaatatataatatacaatatatttgtatacttggtcaatcatagcctaaaatatcaaacttatgtcctcactgatccttatgtatgtaagttctatatataagccactattcactgattgctaaataatattatttacgcagtatctatgcacaatgcacctaaaaattagctgatatccaataagcacgtgtgtcatctaacaccgaagataaatggtgacactaagtgcacaaccatcaacaaactatagagtaagtagacgatgcaaacaatagttaactacaagtagattacaactatgagtaataccattcctacacttctataaacgctcctaagatgtcatgtgatactctaataaatgatgaaccctgagttccactcgacactcaaggctgttgtttgcccgatctttcggtgagttgtagataactatgatttgagagaaacgttgacgacccgactacaatcgtacgagatgttgtgttgcgccttagcgatcgatacacctctccgagggttgttgatcttgccggtgcagatcaaccttattcctgcaagcaaatcaaagaaacaagcaaaaacaaaataaaatcaatctgaattgcaaataggaattgagtacacacgataagttggggtttcgaatacaagcagacggacggtctagccgacacgcgcgctgcaaggaagtagcaatggctaaactttcatctaaacaaaacccgagagttcttggcggcaactagaggtataagaagaggggaagaatgaccacagggtcgtgctccaaccctaggacgtgcccctaatgggcccaacttgatacatagcccattgggccaaaagaggtgacgcagcaccatggacataaaatagtcaggagtaaaatgacaattgcggccgcttcagaacatatatggacatgtggcttgatccatttgaaagtagacttgataagctttccatgaagtacttgcacgccaagctttccatgaagtacttgcacgcccaaatcagagttcgcatgaagtcgtggcggccgtcagaagttggcgctaccctgcaatccgaatccaccccgcgcgaatcctctcccctttggatcctctccatcattcctgagtaaaatgcgagtgcacgcgtctccggggtataaagaagaggaacatgaactcaagaaagaactcacctgatagtttagttgacgtgcacgagcgcgggtaataggaccatcatgctgtacttgggggacgtggatgtatcgatggtgttgatgtcctcatcaataaattagaaagaatatatgaaaagttatataaaaaagtaaacatacatccatcaatttacacttaaatagatgatccattattttcaaccattaaattaatttagatatatgaaagtaatccctctgtcctaaaaaccatataatatgtccctacatacatacacaactcctatataatttcgtacacgatatatatatatatatatatatatatatatatatatatatatatatatatatatatatatatatatatatatatatatataaatataaaagaagagtgggtatgtgattcatcttatctggtagttttctctttctttccagctctaagattttctcaaattgaggatatataaacatagcaaccactcctagcgaggtggtaaaacaagccatgtcgcagcgttgcctcacgccacccattgcttcactctcctccagtcaatttttttgaaagtatctttttactaacaatgtgaaagtcaatcatatgagctcatatatatatatgtgcacatgcacactatgaatacacatgcatgcaccatatccctatgttagaaaaatattcattcagaaaaaatgaaaaacaaacgtatgcatgagagactactattcggtagaaaaaaacatacatataacaacattatatctatttttacgtcaccctcatccaaatagttttaacaaattagctcaaattccaacgcatattaaccccagcgtacatgcataggtgaattagatgtataatacaagaaaaaaaaaatcaaaacttgtattaacttgtaagttagcaaaggataactgtgtgagcaaatattttttacatggtcgttatcactgtagctattagacagtcgaatgatcaaccctgctatttttttaacaaaaatatctatactactaaaaattttagtattgattaacaccttaaacaaattttgtctactctaaacaacaaatcaactcaagataaaaaaaaacttttttttatcaatatgccaagtatggatctcaactggctacattgtagtaattatacaggagtatgcattattcagttaagttggtccgagtaagatgttacggttgacaataaagcttaactggccttctacttaccgataaaattatgttaccgttgaggagcacgactatatcaatgcaacacccatgaattaaggcattagagaaaaatccttagcggctatagtctgcttcactcgatcgtcagaggagcatttatatataagtttaattgttttatcctattaattggtagaagcggtatttttaaatatttatatatagatttggacctatgagacatgggcacttgggtataatgtggagattaactttttatggtattaatgatgtattggggttttttttatacagctacaattccatcgattaaaaagacacacatacttcaaaacaatgataataagttatggtgaatggtgaatttacatataattgggataaagtgatttttgtttggataagccattttgatcatttactacatatcaaaatcaatggtctatttcttatagtgaatatggtaagatatggtattctttttataggcaataaataaattgcccgcgcatctgcgcgggctttcttcctagttattataaagaatgattaagccgctacttagtttcgataataattatttattggatcaaatccatgaaaaatatcttgacgagggattagaaggaacgttgacgaggcctcgacaaccagtcccatctttcaacatgtcatagtttttctcaacatgtcatagttttagtagaccatattgttgtagttcgttagaagcatatatatggtggactagcgcttctatcttattagcgaggtcatcggaggggatgttgatcttattactctactgtactagctagtcccacctttccacggttgctactgctaccacacaaccatctagaaccatggaaaaaaaaatagaagaagacgaagacgaagttgacgagaacggtaggagaacgactaagtccacaactcggcattgagagtggccgattggaataacaagttaggttttttgtttttgcaaggaattactgattgcttgcttaaactcgattaggaccgggacctattggcatcctattcagcgtctaattcaaccagtttggcactatactgtttgagctttggctcgcacgcacgcagtggcattcctaggttatattacacggggctatgggaccccgaagagaatttcaatctgtagtaatatattttagtctatttattagtttaaaattaaagtattatatatgctagtatgatatatgtacagaaccctcgataattttttgttaagggttcaccactgctcgcacgtatgttttgcagtgaatttataaagatccagatagattgcaatcatctggagacttaactaatgagtacttaatattggtcgacgaccagattgattttattgacaattaaacttagactgttatcaaattatgtgacagacatacataccctttgaaaaagaacatttttagctaggaacgtcttttcggaccgagggtgtgtatacatataaaaggggataaagaacattaaaactaaagctatttacatatacagtttaatcatgcaaatcaaatgtaacttgcacggaacaattaatcatgcgatgctcatctcatagaagcatatagtatcgtctgaagatcgaaacgaatcttccaattcgctggggctacgttgactgactgcatggtactctatgttgactgagcacaccatgtagtactggctagtggctacgttgactgacttcagtatcaaacaataatccgagagcgctttcgtccgaacgatcgattccacatttccacgagaaaacttgaacacccatgtcaccctctcccttcttcactatatctctcctttctaattgtacaggccactttgcatacagcgtattataccactataccatggattgtatcttagcttgccacgtaggaaccaagccccgtttcgggccaggaccatcgcactgccaggaatcacacacgcctcctgcagggtccacacacctccgctcgctcactagtagaaaaatgatttttttaccaacgttggttttttatttttccagacataaaaaaaccctcttataactatttgcgaaaatagctaaagagcctctagatttaaccccgcctgtgaaaatcaatttttccaggtggacgccttcctttattttcgcatatggacgtccaactagaaaaatttgatttcacaggtggaaccttacgtggttcgcctacaaaaatcatgcctgcagaaaaaatattaagtcgcatccttatcttctcctctaccatccttatcctttccaccactcatttccctccccctcccccctctctctctcttctaactgatgcgcgtcggcgactctgaggaggtccactaccagctgcgacggcaacgacgacgactgctacgatgatgatggtgccgacgcctgggtctcgctgtcggctgcgatgacgaagacgacgccgcgtggatccgccgccggccgatcttggggaggtgagggcaggcggcggcaacgacgaggtgaggcggcggcaccttggttcctccctctcccagcctggcaacgacagcgacgatgagggctagcagcggcttggcgacgaggaggggaggcagcggcggcgctccaatcctccctcccttcctcctagatctatccatcggtggcagaggcagggcggaggaggagctgatggtggtggccatcgcagacaacgtcggcccctcccctcctagatctggacggaagaggggagccgggcagcggcggcggcgaacagaggaggagagccgtcggccacaaggagaggggctgtagaggggaggccgacggcggcgctcacgggtatgggtgcggcagcatgtttttttttgttcgctgaaaatattttcgcaagcaggtggatctaccactacgaagatggagatgttgcctgcgaaaatgattttcacaggcctttgtgtacaagtggtcatttcccccgcctggaaaaactatttatggctgcctgggaaaacgattttcctagtagtggccctagcttaggaactgcgaaggtgaggtcatctccatgtggtagatccccatccatctcgtccttctccttcttctccttctttgctcttcgccagaaagagcacttgtgtcgctgggagtttgctgctcgattcatcatcctagtcgccagcctcgccgccagagccattttgatctacacaccgaccagcgccacctcagcccccgcactaggaagcatggtggtggccagcgaaggatgataagagaagggggtatggcagtggtcacctccatagcgggaagacactgcgagaagctccgctggccaatgacgcccctatctatgctgccgatgtctattccgccgccccgaccatcacttcaagctgatccgcccgaccaccgctgttggcagatccactttcgcggccctgatacatgccgtgcctccttggtcttcttggtggtgctgccaaggagagtgggggaagaggtggctccaccaagaagtggagaggtcatgccaggaaggggagaggtgctaccaggaaggggaaaggcaatactgcctggaggggaaggggagaggtggtgatgccgctcgatggagaggaggacaattagaagttagggagagtaggagaggtagaggggtgggttatcatatatgtttatgattcttagagtccatatcataaaatattggatttatttgtcattgaaaaaaaatgaggatttaaatacaaaagtatccgactgatcaaggctgaaatacaaaaataaatacatggctatggcgtgcattggatgaagaatatcacatgtgtggtttcatcctaagtggcacctcctttttttctttggctatggcttccattggtcatgccctaagtgtccgtgcatgtacatgcatgaaaacataaggaaaaagtacgaattacacctctgaactatcgaggtcgaccgaattacacccccgaactcaaaaaccagacattctacaccctcaactattgaaaccggacaaattacccccctgagcactgttttaggtggttttgggatagacttgctgatgtggcagtcctacgtggccgcacacgtggcactggccccacatgtcaacctccacctcatccaccctctcttaaaataattagtgggacccactgtcagatccccacccctccctatctctctctctcttctccctcccctccccttctctctctcaggcgtgcgtcaacgggtagtgggcggcggcagcggcatgcggacgggcggcgagcgcggcggcgggcgtggcggggagtggtgggaacggggcaggcggcgggcgtggcggggcgggcgtgatggcgccgtgcccccctgtcgcggcggagggcggcgaagtggcgagggcgacgaagtgcccccctctcacccctctctcttgggccgtcgggaggtcggcgcgcacgcccgagctcgccgttgtcatcttcaatgtcctcggcgcccgccgcccgtctcgccctccccaccgcgcccgccggtgcttgaggcggcgggaggaggggatagcggaggggaggctgtcgagacaggctgggatgccggcaagcgcccgcggaggggatgcggcgagcgcgccgagagggaggaggcgggcggcgcttctctccgccgccgcgccaaatctgagccgagcaggtgtcggggaaggggtagcggggcacggcggtcgtcgtcgggccaaaggtggtcatcgcagcaacgagtatggctgggctcatcgtactccggcgggagcggctcgaacgacgacgacggcggcgtctgggggat

SEQ ID NO: 49183 - DNA, 12629 bp, Oryza sativa
gccgcggcctcacgctgtcgtcctcaagatgctgccggccggcgccacgacggcccgcctttccgcgatggacgccggcgcccacctctcccccatcccctccacctcgctgcgcgccgccattcgcgccgaccgccggcctgcccccgcgcgccgctgcccatcgcatcccctcaccggcgctcgcctctctgccatggcgtgtcgccgtgcgcggcgctgcctgctgctggccgacgaagagagagaaagagtgtatgacatgtgggtcccaccattttaaaaaaaataaaatgctgactggactgccacatcagcaagtctatcccaaaaccacctaaaacagtgctcagtggggtaatttgcccggtttcaatagttgagggtgtagaatgtttggtttttgagttcgggggtgtaattcggtcgacctcgatagttcaggggtgtaattcgtactttttccaaaacataatagcaacactttaaacatgttttctcgtaaattatactccctccgttttttaatagatgacgccgttggctttctctcacatgtttgaccatttgtcttattcaaaaattttatgcaaatatataagatataaattacacttaaagtactatgaatgataaaacaactcataacaaaataaattataattacgtaattttttttgaataagacgaacatgtgagaaaaagtcaatggcgttatctattaaaaaacggagatagtatatcatatctatgatctgatcacataattgtatctgttacaatatatctttataacaaggtctattatatttcgatgaaagtattttgaaagttttttcagtgcattggattatttagtgttgcacatagtgttatttatatgtttcattaagtattgttttatgttttactaattcatttgttaatgttgtacacaatatttttttggatgtttcactcattattttatgatgtttcacaaaaccataacttgatgttttatgtgtgacataaaaatgtttcaattaagttaaatattttatttttgtttcactcattggaattaattaatgttttatgtagtggtttttagcgctgtagtcagtattttttcagtgttgtatctcactgaaacatttcatggagtgagtcaaaatattttttttatatgggatgaaacaaggctagatttttaatatacgtatttttttatcaaaatataactgtatttgatcttgttataaagattaattgtaatgaatacaacaatatagtcgaattattgatcggataattaatttagtgagtaaaatcatttaaagtttgataaaaaaagtattagtatgatgaggagagagtagtcgaggagaacatacacgtaggagcttgtggtcctgtacaagcagctaggaaaaatggtactcctacatgaagtccgatacatatttgcttccacaataatctaatgaagtcttcaggcctgctgctgcacagcacaagtgcagaactaaccagccagcaccgcctctataaatacatacatgttgccactcgcacaattgcactgcagactgcagtgcacatctgcacacgttctcgccaatcgccgggcggccatggcgatgaacttcgagatgtggggcgcggtgtggtctgcgctggcgagcctcgtcttcctctggcccatgctgcagaaccacgtccccgccggcctccgccactggctcaccgccatggccgacaagctcgcctcccacctcagcccctacctgcacatcaccatctccgagtacggtgaccaccgcttccgccgcagcgacttcttcctcgccgtcgaggcctacctcagccacgcctgcgcccgccgcgcccgcaggctcaaggccgacctcggcagggacgccaggagcgtccaggtctccgtcgacgaccaccaggaggtcaccgactccttccgcggcgccacgctctggtggtacccttcctccatgtccaacaagtccagcgtcatcagcttctaccccggcgaggatgagcgccgcctctaccgcctcgtcttccaccgccgccaccgcgacctcgtcctcgacggctacctcccccacgtcctcgccgagggccgcgccgtcaccgtccgcaaccgccagcgccgcctcttcaccaacaacgccagcaccagctggaacccctaccgccgcgggaagggcgtctggagccacgtgcccttcgagcacccggccagcttcgacacgctcgccatggaccccggcgacaaggacgccatcgtcgtcgacctcgtggcgttccgcgacggcaaggactactacgccaaggtgggcaagccatggaagcgcggatatctgctctacggcccgcccggcaccggcaagtccaccatgatcgccgccatggccaacttcctcgactacgacgtctatgacctcgagctcacggccgtcaagaacaacaccgagctgcgcaagctctacatcgagaccaccggcaagtccatcatcgtcatcgaggacatcgactgctccatcgacctcaccggcaagcgcaagaagtcctccggcgacaacaaggcgtccgacggcggcggcgagggcagcgacgacaaacccaagctgccgaccgaggcggacaaggacgacggcggcagcaaggtgacgctgtcggggctgctcaacttcatcgacgggctgtggtcggcgtgcggcggcgagcggatcatcatcttcacgacgaaccacaaggagaagctggacccggcgctgatccggcgggggaggatggacgtccacatcgagatgtcctactgcggcttcgaggcgttcaaagtgctggccagcaactacctcggcgtggagcagcacgagctgctaggcgacatacggcggctgctcgaggaggccgacatgtcgccggcggacgtcgccgagaacctgatgcccatgtccaagaggaagaagagggaccctgacgcgtgcctggcaggtctagtcgaggcgctgaacatggccaaggaggaagcacaagcaaacaagccggcgaaagaggacgaggaggcaaaggcagcgaaagggatagaagagatgaaaaccaaagagcaggcaacgaccaacggtgaagacgaagggaaggacaaaaggacatcggaagagaacaaggccaacggcgacatatagatattactagcaaggtgacaactaaggataagtatttttctacacctaggtgttatggcacccatcatttactagcgactcagatagttattgaaaaaaaattgtaacattaattgtgatgatataagtttaaacacaaacatgcaagactatctacaactagagaaacaaaattaacaaaattagatagttaattgtacccgtacatcgcagataaaatttgttatttttattttttcatgtgtagatcgaatttagacttacatatttgtatagtgtcttatattatcatagtctatcttattaaattttatgaaatttttatataactgttaaactatatgcatacattaggtgtggaaaatacttttcgaacaagctgaacgcaaaatactacagtacgttctcaactaaagctcgtccctcgtttactattcctacagtagtgcaggtcaattctgtgtgcttactggttgtttgattacgattctctgttctttttcagtgggatcatatcgggcagctgcagatccctggagttgcaagccatgtatcctagcagagtgctcatgaagattttcaacctttatttttacataacagtttgctaatagggcctgcgaaattgttagcatttccgtattatattaaggctgatagttgcttgtattttgtaagaatataataatgctatgcacgccttcaagcaaagagattggaggtaatctggccgggactagtgcctagatttcagacgccaaatcaaacggttttcatcgctggccttagagcaagtttaatagtatagcccattactagctctaaatcatctatagtcaatataatagctaattcatacaatagttgattactatactattaatacctggtcccacctgtcatacacacattacgtcttggagtccgtgctgcagctgactacagatctgtagcctgctgctccactacgccggaccaggccatctctgacgggcccaaacgtaactttgttgatctctgacgggcccaaacgtaattttgttgatctctgacgggctaaacataactttgttagtcatctctgtagcccgctgctccacattacgttttggttgcttgatctaaggtcgtttgaaaattttgaattttcattgtgagcaattcaaacgtaactttgttggatagatgatttcaaaagaaaaagttatcgactacaaaattttttaactttttgagatcaacaactatcatttttcccatttctccgtcggaggtcatttgaaaatatgaatttcaaacgcaattttccttgaatagatgagccaaatgaaaaggctgtcatctacaattgtacaacttttcgagatttacaactttcgtttttgtcgcttcttcatctgacatcatttgaaaattttgaatttctaatatgttcaattcaaacctgattttgttggattgatgctttcaaataaaaaagttgtcaattaactacaaaattttctaacctttcaagatcgacaccttttgtctttggtcatttctacatttgaggtcttttgaaaaatttgaatttcaaatgttgggaaatttcaaatgcaaacttccttggatagatgagccaaattaaaatgttgttaactacaaagttgtatgactttttaagatctacagcttttgttttgttcattttctttatccaaggtcatttgaaaattttgaacctcaaatatgagaaattcaaaggtaattcgttggatagattatttgaaagaaaaatttatcaacttgcgttttgggtttttttttccattcaaggtcatttgagaaatttgaatttcaaatatgagcaattcaatggtaattaaattggataaatgatttgaaataaaaattatcaactacaaggttttataacttatcaaaatctttaacttgcgatttggtcggtttcatcatccgaggttgtttgaggaatttgaatttcaaatgtgagaaagttcaaacatacttttccttggatagatgtttccaaatgaaaacattttcaactacaaagtttgacaactttgaatatctgcaacttttgttttgatcgtttcttcatctgcatttgaaaattttgaatttcaaatacgagtaattcaaacataacttctttggatagatgatttcaaatgaaaaagttttgaactataaagtagcataacttttcgacatctacaacttcgattttggttgtttctccatccaaggtccctaccactacacactcaattgtgaccatggagcatttggattcctttggtttaactttgtcgaaaagttgtcaactataaaggtgtagatctcatcgaggatataactatattggtcgagttgtgttttaactatgttgggcctaaataaatttgaactgggacgaaattggaagcctccgagcatctcccaaagtattctaaattctcttcctaaaaatatgggggttttaaaggccccaaaagatagagagaaattaaattgcctatcttccaaaggttcccatattccacttccataaagatccaacttttggattttttttggggcactatttcggagagcgctacgggtcggacgtccgatatttcactatatatcggacgcccagccaaccactaagcgcatgctactgcgcttctttgctcctcgatcacgggcttatggctgtgtgttggatggctcttttcatgtctagatggcagcatatcacttcttgccgctacatgcatgttatggctgcatgtctactctttaaacaaatcataacgtgtcttctccttttttttctctcatatatctactctttaaacaaactttaatcttaaaatgcaaatccaatttttattcaattacgccataaaatatatgtgtctcaaaaaatcaattgtttttatcatttatagaaaattgtttcaccatttgtgcctatgtttcaattcatctcatgtgatgtttcagagaattgcaacatatgaaaaatactagttgcaacaatcataaccactagatgaaacactaaataccatcatgtgaaacataaaaaaaacatacattatatttgcaatttaaatacttgattttattaaaaaaaattaaaccacacatgaagcatagttgttattgttgaaaaaaatcattcaaaagaacaccacttgtgcaacattttcaaataacatagtggaacattaggaaatactcattggaacatccaaataatattaggtgcaacactaagaaaatcagtagctgaaaaataagttttgataaagttgtggggtcttgttattaagatttaatcgtaacaaatatattggtgtaattagatcatggattggacaaatagtttaactagaaaaatcatttgaagctaatgatttctttttcttccctttcacacagtgtgccaggttaacacctgggctggcagagcactagagttgtatgggccacgagcgtccgatgccatccgacgtacgacaggaagcatttccgcactatttctttttcatgcgaggtccatctgcttgcgctggactcttcgcgccgccgctcggaaacgacgacggggcgttcgtttgcccgggcatctatttggactgccgtccaggtacagaacgctgaaattctgtgtgcttgatgccatacaatgtgtgcttctgtaggtctgttaggctgaaattctgttggccatacatcatgagatttacggctcaggttgtgtacgtttatatgtgtatttgtaaagtatttctgggattatttttctaaaggaaaatgaccatagataaagcaaaggcacatgcgcacagcactttcgttgtttggagatgtgacgtcatcaagctaacaaggagcacgaatcggccctcttggcgttgcgtgcgagcgtgtgcgatagccgaggccgctgctcaccggagtcgccgccgcctgtgccgaggtcgaggacgctgatgctgccgcacccgctacccgccgaggtcgctgctcgccggcgcgagggcgtcgcctctcccgctactcgacaaggccgaggtcgctactcgccgaggccactgcttgccgccggtgcggaggccagcgcctctcccactgctcgacgaggccgaggtctctgctcgccggcgggagccacctcagccatcgttagccgctccggcgtcgctcccgtcgggattgcgtgtgtgcgggcacagagctggcctgcggggctcgcggtcgcggccggcgtcgcgcagcagcgcgcctggtgtgcggagatgggacaaaagcggcgacgaccggtcggagtggaggatgcaggcgccagcagagcacgcagcagagcaatcagcgcctgtaggcgtatacgtacgtaataaccgcaaacagggtaagaactgaatttcttcaaggaaacggaaacggaaaacgtacagataccaaaccgagccgcaacgaaacggagacggagagcttattgatggctggagcgctggagcatgatgcagacacccaagtgaattgcctgtgttagcgaaaaccaacgattgaacacctttcgtgcgttctgcaccaatccggcaagacaacgacgaagcacagtgaagaacaaagacgatattcagagaagaagaaacagaggaaagcagaggagtttcagaactttgcagtttgcacgagaaggaaatgcgtgtggaattttctgtagatttcattcaactgaataaagaaacttacaaatggaaatttagctattctgctacttatactccataaacagaaaaaggaatcctaggctcaaatcgcgccatcccacgatccggaactcctggattcaacgccgtgcaaaactcacgcccacaacgcacgacctgacgcggtcgccaactcctgcagctcgccacatctctcgtgcacgcataacaaactcaaaactgacttattcatccagccgttgcaaaagccacagtctggaacaccttggggccacagctgaagtaacaacgtcaatagcctgatcatcagcttccttcagcagcaccgcttttggatggtgaggtgtccggtcatgtgccaaccctctttctcgccggcttcgccgcgcgcgtacgggcaccacggcgtgaagttgggcaggctctccagcatcttccacttggcgttggggtcctcctcgtcgtcggcaatgccggtccatgtcggcgtggagtactcgtagcggctgtgcgtgatgcggtggaactcctggatgtccctgttcttggccatgtccgtggtgtcacgcaggttgacggagaagatgtctccgtagggcctgaccgagtgcgtgaagtggggcatggagatggggtcggcggagaccgcggcgaggtcggcggcgaagacgatgctcttcatgtccgggctgaacacggggtggttgatgtgcccggcgatagtgggcgcgctgtggatcacccgcacgggcaccggcacctcgcccttcttgatgtctttggcgttcaccaggtacacggcgaagtagcctgggtccaagccgtggtccttctccggctcgtccttgcccttgactatgtctttctcgggcctgccggtggaggagaagacgatccagtcgcagccctcccgcggcgaccagctgcagtgggtgtcggtccaggggccgtcggtgagcgggaccacaccggcggcctcccccttctccgcgtctatgatgtagaggttcttgtgctgcctctcccctccggccaccctgttcctgcttgaccggaacacgagcttggtgccctcagcgttggtggacgggaacgcgcagttgtactcctcgtcggtgagcgggaacgtctccatgttctcgtagtcctcccgggacacgttggggatcctcatgatctgcaccggcttgtcgatcgagaaggccggcccctcgcagacgtagagcgtgtccaggtcgtcgttctggttccacgacgtggagaagacgctcttggtggccctcaccttgtacaccacgcggaggcccctgccgtcggcgagccacacggccttgaactgttgtccacgaacgccagcttcttgccgttcttggagacggacgggaacacgccggtcaccctgaagagccccacgtcggcgtgcgactccgggggctgcaccttgtcgaacctcctctggatgcttgtcgtcggagtactcttttggttttggaccttgagtagcttgtcggttcgacagcggtggtagcccacgcgtgttcctccgtcgagcacgaaggggttgtagtggtccccttcaggcctcgtcttctgggtgatgggcaccgacgtcttggaggccgtgtcgaagatctcgatgtgcctgtactgcgtcaccacgcgctccaccttcatgaggacctgcttggacttctcgcggacggtcgccacggccacctgggtctcgctgatggccgccggagtcatggcatcgatgctctcatccgtcacgcgttcctccttgccagcggcgatgtcgaaccggaagacgccccacctggcggtgttggagggcggcgtggtgtcgaagcctcggtggaagaagatcacgttgtcgctgccccacgtcggccagccgccgtccttgatgagcaccttgcggtcgctgcggccctgcgctcgtttgtccacgttcatgaccacaatgtccgtcttgaggttctcgatctcgccgttccacctgttctgctggaagttggccaccgccaccatcttcccggacggcgacaccgccgggctcagatcgtactggcccagcggcgtcaggcgctcggtcttgccgtcggcgaggtcggttctgtacaccacggtccacggggtgcgccgtgctttcaccggcgccttggtggacacgtacaccagggagtggccgacggtggtacgcccaactttgaagccgccagcgacgcagccgctgtcctccatgcgcactccgccgaaggtgtcggcaccgtagatgttgcccaggctcagcaccttgacctgcttgccgccggcgacgaagcgcaaagccacgtgcagcgtctccaggcccctgtccctctcggagacgaacaccaggccggtgacgcggcctttctccgcgtcctccggggtggcgccgcactccgacgccagcttcgggttcttcttgcccaagaacgtcaggagctctttgagcgccgctgctgggatgggctgcccgttctggttgtatgactccccgtcggtgaggagcagctcgtccttggcagactgcggcggcggattagcggggcaggagaagatatccaggggcaccggtggcctgtaggtgccgaagaaagcgatgctgccgcggctcttccccattccgatctgtccaaagaaagaacaaagagatgttcttcacttaatgatctgtcggtttgtgtttgtgtggttagatgatgagcttggatgcctcatttatagagtagctgttgattgatcacctggctttcaaagcatgtgtcttgactaatctctgtatatcgaaatccgcgcagattagtgtgcaattgtagtgaggcaaaaatgagcggttcgtgcatatgctcttcccgtgaagggctaaaatgtaaaatataaactttggttctctaaactttaggtgtataaactttaggtgtatagaagtactatatataaaaatatttaaattcaaattcaaatttgaatcggatatataaacttttgacttgtaaactttgggtctttaaactttaggtgtataaactttagatatgtaaacttgaggtgcacaaattttaggtgtatatatttactaaaataggaaagtaatgtggtgccaaaaaaggaaaccacgtggagggggtgattgatgtggggagggggaccgatcgtgcccggcgatcgatcgccccttacaactaatcggcctctcgtcctctcctgaagggtaagggttgaccacttgaccccatgtctcttccccttccaacgatcctttctcgatgcctcccgataatggcgctggcatctaaaaatcatgaaccgtcggatggagcagtcgactttattatagccgtacactactacaaatagtagtatcaaataggtgtgccactataggtgccagaagtgataaaaccggcaactatagtgctcttcccaccctcaaaagaataaaaaaaattaaaaccgacacctttaaacgaagataggtgtcggttttagagaaaaaccaacacctatattataggtgtcggtttttttacacctataaaatcgagcctagccagctgggggagatatttttcctcccggtggggcccacacccacactggcaggagataaggtcaagccttctctcggcttctcccctagctcctcaatttcctctctctctctccacttctccccttctctcggcttctcctctcctctctctctctctctctttgcggcagcggcggcctcccctccgctttatcggggggaagggaggtgcagcggcggcccggacctcccctccgccagatcggggagagagaggcactagtaaaggaatgatttttctagacgccggccccgatagattccagacgggctataagtggctccgtttagaaaaaccgaatgaccggcgttgggctgtcacccgcacgggaatatacattttcctgtgcgggcgtcttaacccgaccgcacagaataatcatcattatcccatgcggatgcggttgacttaagaggaccgcactgtcgacggtggatacccgtagaccggatatagagggtattggggtacgttggtacgaggatctacgtagtacgacatcaagcaaacaaaagacaaggattatactggttcaggccccttggtaggtaatagccctaatccagttggtatgggattatatgatggagaccatagtcgagttggttcgactagatcacccgatgacttggctcctgtaggctccggcttcgtaggctgtggtggatgtgttggcggtgagattcgatgccttaggtcttgctcagggggtcccttttataccacgggttagttgatctccaagtaggactcggagatattggacccctcacgatatggtaaagacctagtcttatccgagtaggactcctcccatctgtggattctgtttctatcacgtgatagatttccttacgtataaaggaactatccgtatacgcgcagggtataccgtatcggcatacaacgtacatccaaggatagagggtataccttatccgtaaccctgacacacatggaaaaatcgattttcgcgtgcgggctttttaagtggaccgcacgaaaaaatacctctccctcttttccctctcaccacttcaaaattttcacatcctctctcttcttttccccttttttattct

SEQ ID NO: 49184 - DNA, 12237 bp, Oryza sativa
tcccgcacacaacaacggccggccaacggggggcccggccaacggcaatggctcatcgacggccgggcggtcgtggcgcggtcgacggtgaaggcggcgactcaatcgccctcccccgcgaagctccggtggcggcctcgagcgacgaagatgaggcggcgccgccggctccgcgtgcatgcgcgccagccggccggatagggtttcgttttttgatttttgattttttttggtatttgatttttctgtgcgggtgacataaccggaccgcacgcaaaaatttgattattccgtgcggtccacctaatctaactgcatatgaagatggatttttctgtacagttggtttgcccgcatgcgaaaatattcatttttgcagacccttggttacagacggacaaaacctccgcatagaaagatgcattttgaccatacgggaaaatgtgatttgtagtagtgaggaggtgcagcggcggcaaacgacatggaggcggctgcggtccggccgcggacgatatggagaccggctcccggagaagaagaaatatccgaggtgtcccacaatcacatgctcgattgggacacaacactttgaccagtccctctgcgacttgggagcaagcgtaagcgtcatgcccaaggacgtctttgacaagctgaactacacggtgttgttaccaacaccgatgcggctccagctggctgactcgtcggtctgctacccagcgggaatcgctgaggatgtgccagcaaagatctaggatttcttcatcccagtggattttgtggtgcttgacatggaatcagacaaggaaatgctgaagccagcgttgatgtaggagccggaaacattcggttttgcatcaatgagaaggagaagaaattcaagttcaggccgaggatggagcaatgctcaatggtcaagatcaagtatgagccgaatccacaaaacatcagagtggtcgaagtgaaaccgccaaagacggacaacctcattgcgttcatgaagaacttcctagtgaaggaagcgtcaatgagtaggccctgtccaaataagacaccagttaaaactggtgtgcaggtcaagcagcctgtaaagccggcgcccagaaagccgccacccacacctaagaccaaaaaggtgtggcaagtcaaaaagacgacatccactacaccagctccggagtagggtggaaaatcaatgatctgaattttttggaggtacggtcttgctcgtcggactcaaaaagacgtcgcccttgccaataggtaaattggtatgtatcccatatttatttttcatcattttgattttttgcattaaagcatgttttaaatttcaagggagttttacattaggatttaaaattttgagataaatttgcaaaatgaaatttctaagaaaaaataataaagtattcggccatcatcagcgtggccccccacacatgtgaccgttggagtccaacggctgaatgtgggtccagcttggcccaccaggggttcggccgaaccagccaggcaacggtcggctgcccccttttgggaggtaatggctagtgggtcccacttcacagttgtagccattatgggtgcattatataagtggcttggccgggagagggagttcatcacaattcaattcactttcactctctctgaaactctcttttgctcccaaattcattttgagctaattcaagattgtcttaaattttagttctagcattttgatttccctcttgcatacacaagttatctaggtgagaagatttggcgggtagaagtcttgctagctttaacccgcgctcgagtctgtttttgtgctttgctcatttctgcagagatgaagatacgactttcccgtctgttcaagaatggatctggttctcatttgagccgtcaccaagacgagttgaatgctcactcgtccgccgacatcgcaatggaggatgtagacaccgcaccaagtttgttgagtgactccgacctagagctcgttggtgatcgggaaatacaagcctaccggatgctcaaggaccggacatttgctcatagccaagcctatgatccgtatggatgttgattttagaactgtgtggaaagttgttggttggtagaaatttgctgtggtagatgagccaggctctcgtttgcttactttgcaatttctttataccttgcgggaagtggaagatggaatttcttttcgtctttttttgtaaagaatttgagcttacaaggagaggcttaagtacacttctcggttttcatgatgtctgtagatctgattttcagaagataatttccagttttgagaaaaacagattttgggaagatatttttggtgcaccaatttgcaggaaactcagaactaatgacatttatagtcccacacttaggctcatgcataaatggattgccatgactttgttcccttgaggagatcttagacctattagggaggatgagttgattattctttgtgccatagttagaaagatcaaggttgttcctgtgcaatgtatgattaggcaatggttagaaaatgtgaagttcactgctccaatagaatgcacttccttgattactcgcatagcaaaggggtttggagttctttctcatgatcagtgtcacaccctgaaaattcaaaatatataaattgttgtttaaatggaatttttagaatttattttaaaagtcttgaagagaagatctaattttaattaataaattccaatataaaaaggggccagataaaatttcaataaatactttgcttaattctataattcctagatttttctaggatttatttgagctaaggaagtatttttaataaatggaattgcatttaagaaataatttaaattgaaaaaggttttaaaagtcttcttttggctttgggccgaaagtcggcccaaaactccttcctctctcctcggcccagccgacccagtccgcagccgccgtgcgcgcgccctcgctgtcgctgacaggtgggtcccacctgtcggacccatcgtctacctcgcgccaccgccgcccgaaaccctagcgcgccgccgccgccgtttccttccaaatccagccgttcctttccgtttccggccgaatcaatagaggggaaatgatcttctcgatctcctctaccttttctcctttggaaacatcggctaaaatcgtttggaaattcgtggattcgagtttgtttcggattcgtttttcccgaactttccttctcgtcgccggtcgccgtgggccttcgccgccgcctcctagcccctttaaaaggacccccggtgtctcctctacccgccgccaccttcgccttcgcctctcgtcgcccgtagcactctagcgccgtgtgccctagcgccgccgtcgccgccgtcactccagccgtgcgccgccgccgttccagacgtcgccgtcgctcgggaagaccgtcgtcgtggtcgccaagtcgtcgccgtcctcgtccgccgcttcgccaccatcggagaccgccggagcatcgtcgccgtcgtcgagccgaagaccgccgccgtttcaacctcgtcaccgtcgccgtccgttggtcgtccaccgtcgctttggtcgccggtgagttcgccgtgccgtccgctacccgttggtgtcctccgttcgtgccgaaacgccgccgttcgccggcgagcgtgcgccgtccgagccgctgagccgccgccgccggtggtgatgtcatcgctgacgtcatcgtcgccctctcccgtgagccggtcgtggaccgatcgatctcggccgtccgttttggatcaagtcgatctcggccgtccgttcgcgtgaaccgccgccgtgcgcccggtccaccgcgaaaccctagcccgctgacgcaataaatccctttttcctttttcaaaaataattcattattgcgtcataattcaattaaaatcaatttaagtgttttaatccgatttaatcttcaaaaattcataactagttcatcttagctccgatttagttggttcaagtctctaaatttttctaaaattgagatctacatattaaaaatatccacatgtactgttcatgattgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattgtttgttatagcccttttgttcttgattatcttattccttgataccttgggttattataatttgactagttgagctttatttatattagttcagctagatattagatataattgcttagccctgcttagaaacattagcacattattgggataacttatgactcactattatttaatgatggcttaatgatagttcacgatggtcaatcgtgatttgttaattaattatttgccaactaaaacctgataatggtgggttgtgagcacatggttttgatggtcgtgctcatgacaattaaggaccagttcacgagttttggttgtgaaacattaaccgtgccaaccacaagccagcatgggcaacggctttaccttttgtatagcatggttcattgcggggcaccagactgagaagtggcggagataagcccacgggggtcgctggggagtccatgccttgtttataagggggtgattatgatccaggaaaggtgcgctgcggtggattgtgttatgcaaggggtattgtcacaactcctttccgaggtaccgtggtggtattgaggcacatggtgacaagatgtggggttgtgtcttgtgggtacagtggtacacctctgatcagagtaaaactattcgaatagccgtgcccgcggttatgggcgggtctaacaatgtctttcgtgattagtctcacccttctcatcataataaaaggtgctttaactggtaataatttgattagctcctggtttggaatggtatattcctggtttggagatagaactgtgcagccggggtggttgttcagaatggttgggcctatgcaacagggtatgttgtatagtgttggattaatattgtttaattatcacttaactgttttataattctcaaatgtttgctaaatgctgcttttgcaaatgaaaccctactatgccatcctttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagtcgtctgcgccgtttaatttattttccgctgcttagattttattgattgagaggaactatctacctctgtaatgacattttattcgcttattaattagagtaataattgtactctattatcaatttgttattgtgtgcctcggctgatttctggacgagggttcacatacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtaaatctattactgtactaatggctcatttatcagcaaaagttttacaatgttgttttatttaatcttgctgcaataaaataaatttagcatgttgattttataactttcttttgaaacctgatgttcaaaagtacaaaattcgtttccaactgtttcaacttatcatgcaaagcttggtttactttatttacttacctttttactttgattttctaactctattcaaattaatctaaaaacttgtgctattaattggataaatgtcttaactccctcctttcacttgtctttagatgccgcgctacaagcctgagtacttgtttggtgtcgatggttttgtccaggagttgcgtacgatgtcctttgtcattggatttgagactgcccctttttatgctcagattcgtcatgatcgtcatgaagagaagtgccgagtcaaagtcaccttgaacagtaatagtgaagatattccctcagtgatgttcgaagctggaggaagaaactacatccatgcatgtcaggaggtggcaaggatcgccataggagagctccgtgatcgctacagtgatcagttggccgacactgagtatcgctaccatcctcgccaaccccagggaagtgaccgtggcagctaccttgagactgaaggaattgagaatgatgctaccacaaggcatttggttgagatgctgtgggctatggatgaaagtcgtgcggagactgtgttagcggctcaagatcgtgaagaccggaatcgtggtaagatttgcaagttagaagacaaggtggatcgtttggagaaggaattagctgagttgaagggagaagcaccgccgcagaaggccaggattcgtcttaccgcaaggaagagagctttatttgtccctcgctatcaattggcgccaaagattcgtgtggtggagaaagaagttgccccaactttagcagatcctccggttatcatcataagtgatgatgaagaagaagaatccaagcgcaacaattccaagattgagtgggtagcaacccaagatgatgaagacgagtcgaacgagccttcaatcgacctccgatgctcggaagaactagagtgacttgttaagtcgttgtcttagatcgttgtgttagtttgcttgctttaagtttgcttgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttttccccggtttctcttcttgtgccctgcccatgcctgatggtgaacactcgcagcaacgggaatggccccagtaacaataacaatggagagaatcccactcttgctcaagttcttgctcaacagactcagcttatgaatatgatgatgcagcaacttcagaatcaaggaaataaccatgcatctcctcagaataagttagcagaatttcttcgtgtgaggccgcctattttctctagcaccactaatcctgttgaagctggtgattggttgcatgccatagataagaagttggatttgcttcaatgcactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtggtgtctctcaagaagaaggaattcaggtcgctcacccagggatctcgctctgttacggagtatttgcacgagttcaatcgtctggctcgttatgctccagaagatgtgcgcaatgatgaagagcgccaggagaagttcttggaaggacttaatgatgagctttcttacccactcatgactggagattatgctgatttccagaagttggtggataaggctattcgtcaggaggacaaatacaatcgcatggagcagaagaaacgccggattgctcaattcaagacacaacaggggaataatcagaggccgcgtcttactttaggaccccagtctatgccacagggaggttcttcgtctgttgttcgtccgcagcgtcagttcttcaacaacaatgctggcaacaatatccgtaatcaagctccacgccctgttgcagctccaacacagcaacaacctgccaagagggagcaaggcagcaagtccgtggtgtgtttcaactgtggagacccaggacattatgctgataagtgtccgaagccccgacgcgtgaaggcccgtgtcaatcatgttgctgctgcagaagctcaagatgctccagatgtgattttgggtacgttccttgttaactcagttcatgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggaataccatttctggccaatcttatcttgttagaatccaaagaccttgatgtcatcttagggatggactggttagccagatataaaggtgtgatagactgtgctaacagaaaagtaactctcaccagcaatgatggtcgagttgtgactgttcatgcattgtcttctgagactttaaggtcaagactgaaccaaataactttggaagagattcctgtagtccgggagtattccgatgtgttcccagatgatttacctggtatgccgcctaaaagggatatagagttcagaatagatttggtaccaggaacaactccgatccataagagaccttatagaatggcagccaatgagttggcagaagtcaagaggcaagtagacgatttgcttcagaaaggatacatcagaccaagttcatctccatggggagctccggttatttttgtggaaaagaaagatcatacccagaggatgtgtgtggactatcgagccctaaacgatgtgactatcaagaataagtatccgctacctagaattgatgatttgtttgatcagcttaaaggtgctactgttttctccaagatagatcttcgatcagggtatcaccagttgagaatcaaagaggaagatatacctaagacagcatttaccactaggtatgggttgttcgatgtactgttatgtcttttggacttaccaatgcccctgctttcttcgtgaacttgatgaataaggtgtttatggaatacttagacaagttcgtggtggtctttattgatgatattcttatctattctcgaaccaaagaagagcatgaagaacatctttgccttgcactagagaagctacgagaacatcaactgtatgctaagtttagcaagtgtgaattttggttgtctgaagtgaagttccttggtcacgtcatctcagcaggaggagttgccatcgatcctagtaatgtggaatccgtaaccaactggaagcaaccaaagacagtttcagagattcgcagtttcttaggccttgcaggatattatcgaaggtttatagagaatttttccaagattgctaagcccatgacacgattacttcgaaaggatgtgaagtacaagtggtcagaagaatgtgagcggagttttcaagagttgaagaatcgcttaatatcagctcctattttgattttacctgatccaaagaagggtttccaagtgtattgcgatgcatccaaacttgggttaggttgtgttctgatgcaaaatgggaaggtggttgcctatgcatctcgtcagttacgtccgcatgagaagaactaccctactcatgatattgagttagccgtagtagttcatgcgttgaaaatttggcgtcattatcttttcggtactcgtacagaggtatataccgatcacaagagtttgaagtatatctttactcagccggatctgaacatgagacaaaggagatggttggaattaattaaggattatgacatgggaattcattatcacccggggaaggctaatgttgtagcagacgctcttagcagaaaaggctattgcaatgctacggaaggacgacagttgccgttggaattatgcaaggaatttgaaagattaaatttgggaattgtcagtagaggttgcgttgcagccctagaagcgaagcccactctaattgatcaagttagagaagcccaaattaatgatcctgatattcaagaaatcaagaagaatatgagaagaggaaaagctattggtttcttggaagatgagcaaggaactgtatggttgggtgagagaatctgtgtccccgacaacaaagatttaaaagatgcaattctgcaagaagctcatgatactttatactccattcaccctggtagtaccaagatgtaccaggatctcaaggaaagattttggtgggcaagtatgaagcgtgaaatcgcagaatacgtagtagtatgtgatgtttgtcagcgagtcaaggcagaacatcagaaacccgccggtttgttgcagcctttgaagattcctgaatggaaatgggaagaaatcggtatggattttatcactggtttgcccagaacgtcatcaggccatgactctatttgggtaatagtcgacagacttaccaaagtggcacatttcattccggtaaagacaacttattctagaagtcgattggcggaattgtatatggcaaggattgtgtgtttgcatggtgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtgctttagatttcggtggaagttgggataagaatctaccttatgcagaattttcgtacaacaacagttatcaagctagtctacagatggctccttacgaagcactgtatggtcggaagtgccgcactccgcttttgtgggatcaaacgggagaacgtcaggttttcgggacggatatcctaagggaagcagaagaaaaggtgaaaatcattcaagaaagattgcgagtggctcagtctcgacataagagttatgccgacaatcgctgcagagatttgagttttgaagaaggagattatgtgtatcttcgtgtcacgcctcttcgaggtgttcatcgttttcacaccaaaggaaaattggcaccgcgttttgtgggaccttataagattgtcagtagaagaggagaggttgcttatcaattggaattacctcaatccttggcaggagtccataatgtgttccatgtgtcgcaattgaagaagtgtttaagggtacctaccgaagaagctaatcttgaacagatagaagtccaagaggatctgacctatgttgagaaaccaatccgtatcttggaaacgaatgagagaagaaccaggaatcgagttatccgtttttgcaaagtccaatggagtaatcactcggaagaggagtcaacttgggaacgagaagatgaattgaagtcagctcatccacatctgttcgccagttcttccgaatctcgaggacgagattctgtttaaggggggtaggtttgtcacaccttgaaaattcaaaatatataaattgttgtttaaatggaatttttagaatttattttaaaagtcttgaagagaagatctaattttaattaataaattccaatataaaaaggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaactccttcctctctcctcggcccagccgacccagtccgcagccgccgtgcgcgcgccctcgctgtcgctgacaggtgggtcccacctgtcggacccatcgtctacctcgcgccaccgccgcccgaaaccctagcgcgccgccgccgccgtttccttccaaatccagccgttcctttccgtttccggccgaatcaatagaggggaaatgatcttctcgatctcctctaccttttctcctttggaaacatcggctaaaatcgtttggaaattcgtggattcgagtttgtttcggattcgtttttcccgaactttccttctcgtcgccggtcgccgtgggccttcgccgccgcctcctagcccctttaaaaggacccccggtgtctcctctacccgccgccacctt

SEQ ID NO: 49185 - DNA, 1320 bp, Oryza sativa
aatggttgggccctttgcaacagggtatgttgtatagtgttggattaatattgtttaattatcacttaactgttttataattctcaaatgtttgctaaatgctgcttttgcaaatgaaaccctactatgccatcctttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagtcgtctgcgccgtttaatttattttccgctgcttagattttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaatcagatagcttacattttagtttctcgcacctatgttgatgaatcttacttagtgcaagatcatatacataagcatggagtagatggatcactcatattctttttccaggttgtacaaatgaaatcccgttacctaacccagggtatcatttgtataattgtcttgagctaactattcccctgcagacgatagaggaatttcgtgctggtacaatacatagagagccctgttacatggcatggagatgaacatgaaggatcaacgtcctcaccatcagtgcagatgtacgaggctgactgggaaccaactgggggatgctcctggatggacccaagtatccgactacgctggaggttcagcctggcagagtgccagtgaacaccgatggcaagtgcctcaagacacatcctatgggaactcccattcctccagcactagtggcatgccacccatctccaagatgtggcgctctagttcctctcgaggggacttgtgggagctcactaggagaatggacacacgagagctgcaagcaggagagatccagcacaacctcgaaggacacatggcccaaatgtaagtatggccaacctctgatgctcagtacgccaacctcaacaatctgatgcagcaacagcaggctgacctacaggcgtactttcgctttcagcaattcaaccctatcaggggccctgagcgaaaagcaagcttgggggagatatctcttccccactgaggtaacttgtagtagattgcatattttgcttttccaaatgcatatttctttcatgcactgcattcatgaacttgaaaac

SEQ ID NO: 49186 - DNA, 10496 bp, Oryza sativa
gcagggcgccattgggtcgaagggtataagcagagcaagaagggcgaaagctaagcgaaagggctcgaaaacgagagcgtacgcgcgagcgggagcaagaatgtgtatgacggaagggaaaatgacggcggtgaaaagtgaaagcgaaccacggcggggttatataacccgactacacgacggttcacctcccacccaatcccagcccgccatgtggcacccaagggtagacgaaacggtaaattcccgttgtgtagtacaaggccgagcgaaacagtacacacggcccaatactgttaaaaaaaaactctcaagatttcgttgaacataggcacatgtcgagaagacaaaccacaagctccagaaagataacaagtgttgagttttgtaggtggaagataggtttcagcaggaacatcggccgaaagggggcgcctcatgccataccatatattttgcacggtctcagccgaagctccctactcacccttgcccgtgagaggcttgttggaggcatgtcacgaggaccttcgaccggacctgccgaaaccactgaagccatagggcaaagcgcctgggcaaagccgaacggtgaagatcgaagggcgaagtgttttgggcgaagccgaacgatgaaaaccgaagggcgaagcgttttgggcgaagctgaacgacgaaaactgaagggttcgtccccaagctcaccacttggccaagtcactgctaagggcgaaggctataaggtgaagcaagaggcctttgctcgaacagaaggggccttggaggcttggactataggcttgggaggccttgcagcccatggttcctatcgccattagtgggccggcccaaggagatctcctgagggcccatgaatacaagacacactgtgtacccacactaatgtccttatcataagggcgtccatgtaaattccgctgtactaaataaaccctagagtgtatgagcctgtactaaagactataaatagccccctagggctatgtaatggggagatcccaaaaatttttaccaattaatatattgcttttactattccatcaactcactgagtgaaccacgtctttcgatgtgacgcagttatctttcgacaagagtgatggtttctgaaccgccacaaccaactcgtcagtgatgatacaccgccagtgatgttatgtgaaaaccgccagtgatgtaattttccaaaatccataaaatggacaaaaaaaatccataacaatagtttcaggttaggagaccttcccctcgcgcgtagctcccctaaccaactgcaccacacactctactgtatatattatagattttcgttctactcatatcattctcaaccgaattcaaattggttgtttgatataaagttcgtcttcatcggacatcatatgaaaaagttatgatttttttcacgcagcctgtcattcgcccagcagagataatatcagtggcagttcgtggctcaaaccggcagtgatgcacggactgtgcggttttttaaaaatggcagtgatgcactatcagtggcggtttttgaaaaagtcttaggctgtgatctttcccatgggttcccaacccatctcccttgctttccgggtatacgcttttcaaactgctaaatggtacacgttttgcaaaaagtttatataggaaagttgctttaaaaattcgtattaatccatttttcaagttttttaatagctaatacttaactaatcacatgttaatctatcgctccgttttcgtgcggaggggaggagttcccaagtcccaaccccttcaaaagaacacagccttagtcgttgcgaggtgctcgcattttctcttcgacatagcattacattgtcaagaagcactgctcgcccaagcaattcaattcgttagatgttgcttccagttgaatcatgcatgaagtatccatgcgtaaccaacgttattctaggcggtagagaataaatattagatgaccttttgtttacttgttttttctgacaagagaacatgtcaaacatcggttaccatgttagtatgcatgataatttcaaaaaacagcaatctagctcaccctggtcaaaatatatgctttatagaagattaaacctgtcatgtgcggaggcaggtggatggatccatcagagttaattaaagagactaagcaataccataattgaaagtccaaataaaaggataactccaaaaaaaaaaaatgatagaggaaccattgagctcgctcacatcaaaatatatgctttctcacaaggtcaagccaatcttgtgacgaagcaaatgggtagatcgatcagagttagctaaaaaataaccagccaagatcataatagaaaagcatgacttaacagaggacaaccatttattatcatatacttagcttgtcagtttccttcaatcgagatgtcaattatgtttacacctatgtgacaggttggttcacatgcgtaatactctctcgtctatataaaatataaagcatggttatactaatttgaaatgcaaatttaatgcaacttcttttaaatttcaatattaatgtacatgattagttgaagtcaactcgctaggatcgacgccatgtagtattattttagacctatgattgtcttgcagtaagatagtgtagaagtcttggtcattgcgagctgctcgctttttgtcattgatgtagcattacattgtttagtcaagaagtactgctgctcgctcgagtcattcaattcgttagacgttgcttctgattgaatcatgcatgaagtacctatctgtaaccaatgttattctagatggtagacaataaatattggatcaccgtttgtttacttgttatacttgacaaatagacacagaacgtgacaaacatcggataccatgtccagtatgcatgataatttaaaaaaagaacaatctagctcatcaccccggtcaaaatatatgctttaatttcttacaagattaatcctatcttgtgaggaggcaggtggatcgatccatcggagttaattaaaaagactaaggaagaccataatagagaatccaaataaaaggatacacattgaccgtaactatcaagtgcaattaaaagtacaacttaacagaccacaatcatgtgtccttccagtcaagatgatattattgagatagtgatcgagtagtggtgcattaagatattattggatcggatgcaaatctgttctacgatgaatttaagaatacactctgcctccaactatatataagaatatatttattaaatgtgcaacatatattaattaaatgcccaagttaacaactacgacccttcctgttgaatcatccgtttgtttacttgttatatactccctccgtcctaaaaaagacaaaccctggtttccgtgtccaacgtttgaccgtccgtcttatttgaaaaaataaaaaaaattaaaaatataaatcgcgcataaagtattaatcatgttttatcatctaacaacaataaaaatactaattataaaaaaatttatataagacggacatttaaacgttggcacggaaacacagggtttgccttttttttgggacggagggagtacacaataaatattagatcaccatttgtttacttcttacacctgacaaatagacagagaacatgccagacatcggataccatgtcagtataaatgataatttcaaaaaagaacaatttgcatggctcaccccggtcaaaatatatgctttcttacatgtttaagcctatcatgtgggggaggcaggtggatggatccatgagagttaattaaagagactaagcaagaccataattgaaaatccaaataaaagaatatgttgagcccaactatcatgtgccctatattaattaaaagcccaagctaacatactacaatgatgtgtcattccagtcaagatgatcaaaagtcagggtcatgtaggagtggcgcgtaaaggtattatgggatataaaacacttctatgatgtatataagaatatactctgcccctaacttgaataatatcactacgccagatcctcacacatttgacgacatatctgtgacatgcataaggtgttggtcaacaatgagggtcacctttgatgggttctacaggatgccgtcatcggtgagccatccggctacggtccgtcacaggcatctagtcacctgtgacgggtcaagaatggaaccaacgggccatacagatccagctcgtcaaagatgttatgaaaccatctctagtgggtccctttttttccgtcacaggtggaatctatccaacccaatccttatctatcacccaccgacagcctgagaccacccatatctcgtttttttctttcttccttgtccatccctctctctcaatcgtttttctttctttcttccttagcatcgagcgtccacgcgccgagcaccgggtccggtggcggcctctgactccatgcgtgagtagcggccaccgccggccaccggatctggcctatggggcgcggatccggccaccacagcctcttcccccaccgccggccgcttcctcctccgcctcctgaccgccagctgacgctgcctcccccgccttccgaccgccggccgccggatctggcctacagggcgcggtttcggccaccgcggcctctccccccaccgtcggccacttcctcctccgcctcccgaccgccggccgccgccgccttgcccgcctaacgaccgccggcctcgacacgtttggggaacgcggatccggcgcctatcccccgaccgcctgtcgcctcctcctccgccaccccaccgccgcctgccagatccgacgacagctgcaccgccaaccgtcggattcggcggcctctacccccgactgccggcgtcatccaccgtctccttcttcacccgctagcgccgccgccattttcaactcttgtaggttgtgcaaattttcattgccaaatttcagattgggttatactcacggttgcttgtgtggatttgtagttgcttgtgtggatttgtagtttattactcaaagttggtgtggatttgttatgtatattacttgtgtggatgtgcttcatgtgtcaacatatctgtcaatgaaatgcaaagttattctgtcatgatatcttaagatgttcttcatgtcatgagatatggcgtgtgggttgagagctgagagctagaggctgagagcttttgaattttttttggttgatttttcacacctgtgacaggtggtgagttgaacctgtcagaggtgtttgtcacctttgatgggctaaaaagatccactcaggtgttttattcagtctgtcagaggtgtcaatcattattgatgggctttcacccgtttgagatgatgtgtagtcatcagtgaccactaatctgtagccaagaccaaatccgtcaaaggtgagggttagagcccgtgacagataacgggatccggcctagtgtatattaattaaatgttgtatatatgttaattaaatgctcgagttaacagactaccaccatttattagcatataaaagcttgttggtgtcgttctagtcaagacgatagcggagcagtggcgcacgtacaaatgaattatcagatgtaaaaccctctccattggcaaatttaagaacacactctgcatttgactttaaggataaaaatggtacatttttgtcaccacgctcatgccctaaataccaataggcagagaacatgccaaacatatgttaccttagcagtgtacacgattaatccaaattaaaaaaacaactttggtagagcaaccattgagtttgctcccgtgtcgaaatatatatgatttctcacaaaatcaagccaatcttgtcacggggcaagtggatggatccatcatccatcagaattaactaaaattcactaggcaagactataatagacaagcacgacttaacagacgatgaccatttattaccatatattagcttgtcagtgtccttcaattgagatgtcacgtgacaggttcgctcgctagcgttatagatcctctgtaaaatttttttttcgagcccctcctctataaaatatgaagcaaggttataataatttgaaatacaaatttaatctaattgcttttgtactaaattttttttggcagagatagataaccaatatgggacagatggagtaattaagaagatatagcaagatcacatggtaaaatgggctgtatttttgaggactcgaggttgcagtgaccttatcaattataactagcaattattaaacaggaaacgtactttgattacttgaagtcatctcactgggatatacgccatgcagtattattgttttagacctacacagcttgtctttcaataagatagtgtagaagtcttggtcatctcactgggatttcgctgatggctgggctgctcgatttttctctttgatgtagcattacattgtttagtcaagaaggacagctttcccgaatcattcaattcattagacgttgcttccaataatgcatgtaaccaatgctattctaaatggtagacaataaataatagatcacattttgtttacttgttgcagtcaaaaagatagagagaacgtgccaaacatagggtaccatgtcagtatatacatgataatttcaaaaaaacaatatgatcattgatcaaacaacaatctagctcgctcccgtcaaaatatatgcttccttacaagattaagttgtgaggaggcaggcggatggatccatcagaattaattaaaaagactaagcaagaccacaacagaacagtgtttttcagccgctttaatccagccagaacagtgtttttatctcacaacaaatcagccagaacaacagttatcatttgaaaccatagttataagggcatccacaatgtgaccaaaaagcagtccttataactctatatgggtacctttaccattgtgggaggtggcattaggaagagctatatgataagctacccatagctataaagaccacctatatagattaaaatatactatctctctccttttgcttctttcatgagagaactatagcatttggaagtaatttttttagagtgtgggtcccatcttaatgtcaattactatctatatacattgtggaaatataaataacaaaaaaaccacttatgtgggtcccacctatatagactacttggtccatatacattggtgatgccctaacaacatacaagagacttatcatatggaagcctgtcattattgttctggtcaggatatcaaatgttacatctaatatcatgtgagtgtgaccagttcaataatcttcaatcactagtttgatagtcggtccaccatagaaatagaattaggcgtgatttaatttaatgcatctggatcttcaatcggatggtttccaggtttcacaatagtagcaattgctaagttccctacaaaagtattaaacagatggaagtttggatggaaggtacccggcctggtacaagctagatatacctagaggctagagcctatctatcggtatataaaagggagtatgcctacccatttacaccatgactgaagagcagaaggtgtctagctagttgcctagttagcaccgtgttgtactgttgttccactcactcgctcgtgcgcatactcctgctccatcttagcagtcaggttcaggatggcgttcaacgacgatgagaagcctgctactactccaattccgaatggaggtatcgtcttaattccatcagccttccattgatgcattacatactggaatacataccgtttgccgcaatttcgaaatgatcctgcattgaggcggattcaatacatgtatatatgatgtgcagggagcaaacagggcctcgtgacgatgaacatcccgacgtacagcaagaaagatgtggctctgacggcggactcagtgacggctgtggtggagatcaaggcgacgtcctccaccgccgtgagggagggcctggacctggtggccgtggtggacgtgagcggcagcatgcgagggcacaagatcgagagcgtcaagaaggccctgcagttcgtgatcatgaagcttacccccgtggaccgcctctccatcgtcaccttcgaaagcagcgccaagagactcaccaagcttcgtgccatgacccaggacttccggggcgagctcgacggaatcgtcaaatccctcattgccaacggtggcaccgacatcaaggccggccttgacttggggctggctgtcctcgccgaccgcgtgttcacggaatcccgcaccgccaacatcttcctcatgtccgacggcaagctcgagggtaagacctccggtgacccgacgcaagtcaaccccggcgaggtctccgtctacacctttggtttcggccatggcacagaccaccaggtatgtatgtacaattgctagttgctacttgctactccagttgctagctattgctaaccatcctcctgccttgtaattggacgaatggtattgccattggtagctgctcacggacatcgccaagaattcccccggcggaacgtacagcacggtgcccgacgggacgaacctgagcgcgcccttcgcgacgctgctgggtggcctcgtcaccgtggtggcgcaggacgtgcggctgacgctcacccccaagacggccgacggcgacctggacaagatggaggtggccgacggaacggactacacgcagaccaccgacgccaaaggcgagatcaccatcaaattcggcacccttttcagcggggagacacgcaaggtcgccgtcaacttcaccctcaacgaaagccccgacaccgaggagtacaacgcgaccttagcggtggcgaggcacagctacgccgcccaggaggcgccgcagcctgcccagaacatcgtgcggctgcgcaaaccggagccgaccactcccggcagcgacgacggcatcgaggagcggtccgtgcaggccgaggtggtgcgccggaggcacgccgacctgatcggcaaggccagcgagctggcgaatggccagaagctgggcgacgcgcgggaaacgatcatggacgcccagaacgcgctgggggacatcctcctggacgacggcgacaggatggtgaacgcgctccaagccgagctgctgcggctgctggaatacatggagacgcaggcgctctacgacaagctgggccacccctacgcgctcgccaccatcatctcccatcgccgccagcgcgccgctggaaggggcgacgaggaggtcatctccctctacgtcacgccgcgcatgatcgcctacctcgctcaggccaagaagttcgaggagaacccggaagcgccggtgcccagcgctgacgaggatgtcaagcaggagatggctgccaacccactcgccgctatctccgccccgctcggcttctacctggagaacgccatccaggcactgcaggccatccagaagatcatcgccgccaacacaatttgatattatatattgccttgcccgtccaattcgaatttactatcccagtcccagacgcgcatgtgctaagttacgttgttcttcatctctttcaatttcctttctcgcttctgatcatactacttatatgtatgtaaccgatccaataagtgcgccggcccctaagatgtaatcaatctatatatgtaccactgtaatgtaatgcaagaccctttttagagcaactacaatagcacatttaaattcagatttgctcctttgcagacgattgatattttgttattccatcagtcacatgtcttggtgcaaagttttgagcatattagtatgaagttttataatgtgatagttcaaagttttttagcagtgcctgatattttgttttcatatcggtcaactgtcttggtgcaaagttttgagcctattataaagttttataatgtgatagtttaaagttttttaacttaccagtacaaagtttgtattgacatagttcaaagttttatatttttgagtccaaagttttgaacctagcggtacaaaatttttattgtttgagtgatggttaaacaaactttggggctgcctattctgcagtcgattgcaattttttcatttgatcagtcaactttgtgcactattagatatgtatctaacggtaaagctcaaaaaatcaacacgtgacgtgcaaaaacaatcacaacctgatgcagatgtttgggcccaaaagctaacaaaaagcccaaagcccaaagttgtttaaaacacacttttgggtccaaaaaactaacaaaaagcccaatgtttgggccccagttttttgggctgtgttatgggccagcgaaagtgtgggcccgagtctttttttgggctgtagttcagtgagtctggattttcagatttttagctgtgatttgggcttttttcaacaaaacaaatgggctctcacatgatacccgtttttgggctttttagctccgatttgggttctgtcacaaaaatggtc

SEQ ID NO: 49187 - DNA, 10394 bp, Oryza sativa
ttgttcccacctccctccttttatcctcttcctcccatcttttgattttttttttttgctttttttcactttccaccacccccttcctccgaagaacaacatgtgttgaggaaagcacaggaagaacttacgggaaattcctttctgtcttttttttttttttgcttttcttccctttccactatccctgagttttctgctgcttccctacacaaaactttattatataaaaactcataagcaacacaacattaatctggtctatttttttcatgtggttgtaatgcaaaattactgcaaaaaaaaaactgccctcaactatagaaaatcttgtgcagagtgtttgcttttccttatgcccaactaggtgactgaatttctaaagagtgcacaactcagaaatatcttgattcgctaactgttaaaattgcacatttgttctcttgtagtcatgctttgaattatgggagctctcagttcatgcaaatgccattacattgtacagaaaaaaggatgtaatgccatttttttcatctatccaaatgtgcagggcacagaggcagaatcaaatgaagactatgggatgttattcagattatcacaggagggaggcatcacctatacaaatttaatccagcaagtctctgtctcacctaatgcaattcttcctagtgctgaggtggcagtgagtagaaaaaataaaacacatattaaatgaaatatttaactaaaactttatgtgcacagtcataactcccacactgtctttttttttttgcaaaacagggtggtcttcctctgctccaaaacacttatggcagtttcatgcagctattgcaagctcctattgaatcagaggtgtgttcccttttgtttatttgatttgtgctgtgccatcccattatttgattaaaaaacatattcatgattggtgtggatatatctaatctggttaaaaagttcaaatcaaaatagaactataaaaaagatctctttattagaattttttttcttaccactgcagagtgctctatatttgacatccaatagatttgagtatgacaataccttttggggttttgatcctcacaatggttatcaacaaaatgacctgcaaaatgcacaaacagacacctctcagatgtgcaactctttgccataaagtgtagctgtgcatcctcctatggcatctctggacatgctatatgatgaaatgcagaaatcaagcgctgatgttgataatcaagctgagatgtgcaggccaacagtacaattgaaagcatcatctgtagaagtgatttataatgaaatgcagactcaaactattgaggctgatgcctgttttgaccagcactttgagcaagcaacagaagaggatttattgtctgatcatgcaatagttacatttcagcaagttgaggaaatagaacacgataaaagtgcgcaaaatccagatcacaattttagtgaggaagatataaacatatttctggagaatgaaagtgtgtccattgttccaagaagggggccagattcttaaagtgccccttgtccctcattcaccaaggttttgcttattaaaattaaacctttgacttctacaatgggtatgcttatatgggtggtttctctacatgcaaagctagcaattaccatagcagaaaaaccgatgttgtgacaaggcacacgttcaaatgcaacaggtggcggaaaccaagtgatccaaaggagaaggacctgcctgaggttgatgaagttgagaattgtttgcaaacaaacacacaaatccattggtaaaaaagagaacagaataaagtggtttacacaaattgcaaagctgagatggtgataacattgaagaggggcttttggtacattacaaggctcaatctagagcacaatcatccactatctccaccagaagaaagaaattcctaaggtctcacaaacatatgacagaccaggagaaacttttgataagaactctgaacaaaatcaatgtgcccacaaggatgattatgtctgttttgtcatatgttaggggtggcttgtctgcagttgcttacacaaaaaaggctgtgagcaattatagagattttgttagaagagaaagtgggaaaaatgacatgatgcagtgtttggatttttttgagaagaaaagatcagaggatccattgttttatttcagattcagaactgatgagaacaatgttgtgaagagtctgttttggtccgatgggaacagcagaaaattttatgagatgtttggtgacatagttagttttgacatgacgtacaagacaaacaggtatgatttgccctttgctccatttgtagggataactagtcatggtgacaattgcctatttggttatgcattcctacaagatgaaacaagtgagacttttcagtggttattcaatacgttccttgattgtatgggtggcaaggttcctgctactattataactgatcaagacttggcaatgaagactgctattgccatagtttttccagacactgttcataggaattgcctgttccatatgttatcaaatgcaagggacaaaacaggaaggacattcaattaagaggatgaagaagtttacaaggatttccatgatattgttacaaaatctcagacagaggctgaatttgaatatttgtggaaagatttcataagaagaaacaatctgtataatgttaggtattttcagcttatgtgggtcactagaaagagatgggcaccagtttacttcaaaagcaattggtgccctttgattcagacaacagcaaggagtgaggggacaaattcaaggtactaagctgacatttgttcatctcatagtgtttctgcattcctagcacagtatgaaaggattgcagaaacaatttatgagtgcttcaaagaacaggaatcgctgactaggaatactgttctagatacttggtcagaatatcaatttgagaagcaagctacaaaattgtatactaggaagatattttgggcatttcagcgtatcttgcaaagctataccaagtatgatgtgaccgtgaaagtgcgtgattctatttttgaggtgtacaaatcagagattcatgaactacaggatttcagaaaaagaaagtacattgtggttgttgatactatatctgaagaatatgaatgtatctgttcaagatttaagaaggatggtattttgtgtgttcatgtgctcaaagtactcattcacttgaacataacaaaactacctgagaaatattttattgaaagatggaggctgaaagacaaaaaccaagaattatctgtgccaaacacattgatgtctgctactgttcttgaatgcaaccctttactcaggttcaacatcttgtcacagaaaatgattaagttggcttcagatgcatcaaaaacaaaacaaaagtttatatatgtgatgaatgaaagtgacaagattgaagatgggttgaaggcaatgagtgatacggctcctaacgaggctactgttcatgttcaggatgcggcggcgatgtcacgccctaaaaatcttaaatatataaattgttgtttaattggaatttttagaaattattttaaaagcctacaagctaaaccctaattttctaggaaaattttcaatataaaaatgagctagataaaattttattaaatactatcttgctcctctatttctagaattttctgggaattatttgagcaagggaagtatttttaataattgaaacaacatttcacaaattgtttttatttaaaaagttcaaaaatccccctcctaggccgttgggccgatttcggcccgactcctctctctccccgcgcgcggcccatgcctgcccaagccgccgctcctcctctcctcagccgccgacaggtggggcccacctgtcggggtcgtcccctacctccggccgccgccgcgcaagccgtctgagtcgccgttttgcgccgccaaatccgcccaaatccgacccggtttcttccgattgttagaggggttttgttcctctcgttctcctctttcttttcccccaagaatcaaagagaatcgttgaggatttgatccgaatcgagttcgttttgattttatccctaaaaccgagtttgatttcttcccaaatcgattcctctcgtttggagctcgatctcttcgatccaatgccatataaagcgtcccctcatcgtcctctttcgtttgccccctctcccgagttctcccgtgcctcctagcgccgccgcgacgtgctccaagtccgccgccgccgccggccgtcttcggcatcgtcgccgcgccgtctccgtcgtcgccgccgcttgccgtcgccgccgttaggtgcgccgtggtgagaggaagctcggccgcccctcctctttcgccgccgaccaccggagcccctccgtcgccgtcgacccgagccgccgcgccgcttcttctcgtcgccggccgccgtcgcgcaccgtttgttgtcgtggtgagtaccaatgggttcgcctcgttgtcctctacgcgtagatgccctccgtttccgcggccgacctctctagctccggcgagctctccaacccgagccggccgccgttgctgacgtcagcgtgacgtcatcgccagggctgacgtcatctctagggctgacgtcatcgtccccttttctttttctttttcccgattttctaatagattaaaacttcggaaaatcataactaaataaccgtagatccgttttaggtggttcaagtttctaaatttttctaaaatcaagatctacatgataaaaatatccacatatactgttcatgcttgtttttgtactgttttgttgattttgtttatttgctttagtttccgacgttccggaggagagcgtttccgttgaggaaggtttagaagcgtttgtggaagcccaaggcaagtcacacagatcccaaacaaccctttgagcatgttgatcccgtttaaagctattattttatttcaactatgcattgttttcgaatgtcatcgggtggaaaacctttcccagttaattaatggccgaagatgactttattttcctatgggttataatttgattatcatgaaccttatatattggattggtttagctaaatgctatatataggtttgcttagtcatgcttagaaacattagctaactaaaaggggttaaatataagttttattgcataattattattgttaataatggttatatttaatggtagctcacgatggtcaatcgtgcgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgatttgttatagtgcgccagactgagaagtggcgagaagtccacgggggtcgctggggagtccatgccttgtttttaaagggggtgattatgatccaggaaaggtgcactgtaatgggttacgttgtgcaaggggtattgtcacaattcctttccgagataccgtggtggtattgaggcacatggtgacatgatgtggggttgtgtcttgtgggtacagtggtacaactctgatcagagtttaaactattcgaatagccgtacccgcggttatgggtgagttgagcaatgttttttgttattagtctcacactactcattaatggtaattatgtggtaactaatttaattcctggtttggaggtttaatttgttcaactggggttggttgttcaaatgtggttgggcctatgcaacatgggtgtgttgtatggtgtttatttaatattgattaattattcaactgtttttactattctcttaaatatttattaaatgatgttttctgcaaatgagctatattgtgccatcctttgttatcctgtgcacttgcatatttgctgtgtggcttgttgagtatgtcatatgctcattcttgcaatattcattcatcagaagaagagtatctcagtgaaggtgatgatctggaggaataggcttgttctcggttaagatgcctgtggagtggagtcgccatagctgttccgtagtttgttttagttttgttttccgctgcgtagaatgttattttctttgagaggaactatctacctctgtaataattttaatttgtgactattcgatagttatttatttgtactctattatcaaattgtcattgtgtgcctcggttgattcctggacgagggcttaacacacatgtaagcgtttggaattttggatagaaattccgggcgtgacaggcgacaacttgtggtgtagcttctgttggtgctcaaactggtatattgatgggtcctagtggtgttggtattgatgctgagagcacaaagggtgcggttgctgaaactgaaataatagatatggttggaattgcttctacttctgttttactggatccaaaatgctctaatagcaaaggcaggcacaagagtgagccaagaaaaaagaggctgatagatgtgattagaagcaagggtttggtgacatgtagtggttgtggatcccatgaccataacattcgcacttatcccaaaaaaaagagaagccaaatgcaacagaagtgatgcaggagaggaaatctagagaactttagggacatagaactttttgggtagcaaaaaaatgactggcctatgtcttatgagtagaaacatcaagaaaaaaatggcattccacattatgtctttacccccctttttgtttgtgtgttttttggatggtgcaaatacaattacatggttggctttgcaggcataactgattattaaaaagaaaaagaattgcttgtgtgaaaaatggcgtaccgtagtttgtcttcactcccttctgttgtgtttaacgtatatctatcctccccccactccctaccccccatcccccaaaaaaacaattggacctgcacacagttgaaaggagaaaaaaagtcactcatcagatatctctcattagtaagacgatcagtatcatgtaaaacacataaaagaaaaatccaggtccttttttaatatttgggtgttatgatattggatttatcatatctagtacaggaattaagctccacataagagaacacgtagcacacaattttgctgaacatgtcctagaatttagaactcagctgtagtacatagaatacaagcaagcacaaaagtatttgtatatataagtgtatcttatatttgtgcaccaaaacaaaactgaaactgtatgttactagatagtattttttttcaataggttgaggactgagataaacccaaaaactgcatgggcttgaaaaaaaaagaaaatgtgacatctctctctctcttactacctggtagtgtgtggccccatctcatgggctatacagaaaaaacaggattgtctaatctgttggtacagaaacaaaaacatctcactgttgccttgcatattttccatgctttgttggattgaagcttctagctagcatttttgcttcttcttgtgaattgtattctgagaacaataggtcatttgcaatttgcttcctcatgtttgggatatattctggtctgatcatatctttcaagtgcatccttgggtttcaccattccatgcacttcatagcgtagattccgcaatcatgccttgatgagacaaaaacaaaaataaatcatttaagaaaaacaaaatcatggaaaaaaagggaggagttttggacaaaaaagaaaatgatatgtaatttgtggatgattgttggggttgataggtagttacccattgttttggcgagtaattggtgggtattggatatcaaatttactaaagtatttctccacatctgagaattcttcccacattgcaatgaatcctggtatctgtgtataaacaagaggagcatgaaaaaaaaccagaaaaaaaatcagtggacgcggtctttttaaattttaaaaaaaaaaaaaacaaaaattggtatggaaaaaaaagaaccaaatttgtatagctcacacatagcccttggattttcttatgaaaattgccattttcctcataaatggagttcaggaaaaaaaagtgatgccccctgaagttccccggtaaccccaacccattattgttcatccaacaatgggaaattaagttccataccataaaacccaaaggggcttccttttatgttattcccccccccaaaaaaaaggatcatttttatgtttgaaaaagaaaaatgaccaaaccaagtcatagtagtgcagaggtttcttgttctggcaaatgtaaaagcttgtcttgcgcaattttcatagtcttcctcttttccagcaccttcccaattcttcaagaaataaacctgtgaaaaaaaggtagagaattttgaagtgatacaactggagatgagaaaaaaaatgtatgtgatagaaagtatgaaaaaaacacatacactagttctatggaagaagtaaaaattcatgtattcattttcttggtaattctggtcgttggcaatcttcttggcatacgcgttgaggacatatgtatccaccactccccttggtgataaagatttagacaatgatgatcatgtgacttttacattgtccattagaactgcaattttactgtaccacaaataaagaagataaatgcttttagtaatgcttagtactcttaaggcagaaagagtacaaaacaaaaaagttcagattacttaatttcagaaaattggaatagtcagcacaagctgtttgttatgcatattatgaaaaaatgcaaaaataatttgtaatgtcatagatttttcacccttctttgcatgccttgttgtgttaaacaaaaagtgataaactttcatttggttgtcaatgcaaatttcagctgcgcctaccaattcaggatgatcatacaaaatataaaatctatgagacatatgtatcaaatctatctgttttcaagcatttctttttgttatctatggtgctttttagatgcctgctcttcttttaaaaaaaaatttaaggattggatcatttcttcttttctgaagtcttctggatgacaacttggctgacaaagtgaaaactgaaaaaactgaagtgctacttgttttcaattgaaaagaaatgcaaaataggatgtggtttgcacacgttagtaactgcatggttagattgccaaacaaaatcgcttttgaattaaggtgtagattaacgaagaacagggccaaattcatccgagaattcacattgcactattggttgattgcagaaataatgatgcgctaaatgcacccccagttcatgaactatagtcgctaatgctttgttgcttgtgaggtctgtcagaactgactgccgtcaccagtgatgcaaaaatgttcaggtgataggggtacaaatcaagcaccgacaaacaaggaacatacatgctgccattaatcgaactgctgctacaacaactacacttttactcccagtaatgtgcaagtttcaaaatatttcagaatgggcagaactgagcaatgaccacaagtatggtcaaaaagatagacaaaagtatttatccactgcctgaataactaaaacgaaaaaaataactactgtacatagccacacatagcagatgatatagcagaactgttgctgaacactggtccgctaatcccagatcagacatctatgcactaatcccagtggtacatgtaaccatccaaaatcatccaaaccctagcaaaaatttctctctgccctgtagatgcatgatgggatctcatcaaccctctgaacaaaacgaagaaaaaaaaactacaattccctgccccgtcacttgttgtctgtggctgccacttcctgcgccactccctcattccagaagcagaggcgcaagagcgccactcccccatgacacccagaatgcacttcagcggtacatgttcgactatgtgttttgaacaacgtttgtaaaaactagagaaaaacacccccctcccatttatttttaaatagaaaagcttgaaatgatcacaaaatctaaaaaaagcaaatgtaaaaatgcaaccattataatgttgttttgtgacacttactatttatattgttgcgtctcaccaatgctgagtatgttgttgtagtgattgagttcagctgccaagattgtttggtgccgtgtgtagttgtcatatggtgagctcttgtatttacttggatgtacaattcttttagggcgataaagattgtgtctggtaccagaacagttgccagaagcatttagtgagtcgatgattcttgtcattgaatattgtctttcttctggttgatcatg

SEQ ID NO: 49188 - DNA, 4608 bp, Oryza sativa
atttgcattacttgttttgtagcaggtgtccttgcagaagcaatgtttatgtgcagtggtgtttgagggctactttgctcattgtttatttgtggttgctgcaaggatgaaattgtccaataaggagcatacccaaaaaagggttgatgtttgaaaaaaaaagacaagtaaaaaaaatcagaggttattaccgcacgttgttcaaccatatcgatgttatctgatggttcctcttcatataagaattctgcaaagtcatcttggtactcgttttcatcacagtgttgtccctcaagcctcctattccccatgtttgcagtgaagtttgctaacaaaaaatcatccacataaaaaataaaaaaaaagtaacaagaaaaaacatctaacatgattgtgcaaatataaatttggctagataatctttttattctttctagacattttgattccccccctctgattgttactatttacgtctataaaataaattaattatagtacaaaaaaataattttatgtgtatagagaaaaagggtcaaagttgtacctgataaatgttgaactccatctttattgtttatgcatgttttgggtgtgtgcatgtacctctccccctgcatcacctgcatgctgctatgttcaatgtccatgatgtttgtacctgatgttgtttgggacaagaagtgcccaaggctggcacttttgtttgcttttgatttatcatcaaaatgatataagcattcaaatttgggttgctgtgtgtgagttacatgagaagaaattaaaaagttacaaatcaggatagataaaaaaaataaggtacattttttgtacattaaagtgcaacacagatataaaaaaaatgtaagtttatcagtcaatcaatgctgcaaatatttacaggattaaaataaaaaataataaaacaaatcagtaaacagtactggtagaaaaaaaagtgacaaaccaaaattttattacatgtggagtttagattttgttcttgatgtgtataagataagatgacactgtaaattaaaagatgacccaaaaaaataaaagtgatttagaaaacacctctatgcttctatgctctagtttcatctgttctctaaaatttgaactctacataggcacaacagtctatcgttttgtgtatagaggtgttttctaaaacaatgtctatccgcttctaaaaaattcatccacacatatataatatgtacaaaacaaaaatatggaccagtgtacaatgcaaaacaaacattatataaaaaaaatagaggcgtataatacacaaaaaaaagagaaagtgagaaaaaaagcagtttgttgctcacaaaacaaacactaaaaaaactaagaaatactagtgctttaaaatgcatgatatatgtttgatacatttgtgctcttgtgtggaatgttgtctgattcatcttgtgtaggatcttggctcttatgatcttctgaagagtttgaataattcacaagaatgaacttcgtcttatcctaaaaatattaaaagagcataataaaaaaagatataaattgattaaaatcgttgaaacaaaaatggaacaaaaaaaatatattaccattgtgtgacctgttatgtcttcaatatcatatggaccctctatatcgataacaaactctgtagagttgctttcaagatccttagtgggctgcaccttttttgcaaaaaaaagaaagacatatgtagtgaaaaagccaggaggaaaaagtataaatggtttgaaatttatattatgcaaacagtttttgtatataatgatatgacataaaaaagtaaatagtgtttttacctgtttccttactgctttgcgaatcttttggtcagaagaattttttttcgatgggctaattgatacaaccgacaaaggggatgctgaatgtaatctcttagctctagtcctggatgccacagagttgtttgattgctgactacaaacaaagtccttactggatgcttttttatctggaaaatgattgttttagagtgaaattatgctaaacaagacattgcttaagcgtgctaaacaaaagatacaaacataccagaaaagaaactggaaaaaaaatgaacaaaacaagataatgctatagtacaaaattgaataaaaaaaacttgcatgctgtgtttctttgcaagcgttgtccttgttgctgtttgactttgagttttcttgttcagttggttttgatggtggtgtggtttgtagttgggaacatgtaacattctctgaaaaaaagtttgtttcagaaaaaaagtattgctgtcaaaacagatattaaaagaaaaacagctaccagtaagacaacataaaaaaatggagtagatggtgtgcagtgagattatattttcagattcaaaaattttcagcttgcaaaagctatggaccgtggcatagctgaatcctggagcatattacagcttaaaaaattggtgataaaaaataaaactaatcagtgtgatccatgggtagcctactggaacaaaagaacaagatttatatgggtagcctactggaacaaaagaacaagatttatgtgaaaaagattgaatgaacaacatatagttgttcgctttgaaaaaaattaattgagcaatagactaatagggctctgtatgaacatcataatatatcttctatatttgtgaaatacaaaacatatatttgggcctggtaacttatggttctaataacattgagtactgacacagaactaggctatgcttaatcctgttccagattttaaagaaagtatacatgcccagtaaaaaaaaatgctatagtccagaatgaacattttttttggactggatatattggtgttggtggtagggaaattttgcttagcattggcacaaattatttgaatctgttgggtttgtgtgctatttgtctaaaaagaaaaatttacaaactaacagaataataacatatacctgtagggggtgctcctttgctagtgctggtgttgttgatgttagactttgttttatgctctgcagttgattttgtttgtggtgtcttgggtagttgggaacagacatcagtgttgttttggtttttttgttctaggggtggggcattaccattatgtgctacattgctggcaccctgcttgcttccccccttgctcttctcttctccactcttctcttcccttgttgtggtgctatctttttgtgtgaataggcttgcttttgacatgtagacgcaatccaaaaccttggcagctagttgtgcattttttttcatatgttgtgtcagaatgttctcttgtgaaccacttgcaagctgtggaaatgtcatcaatgagctgcatttaaaaaaaaacacaaataggagtgagtgtattggagcatgcatatacaaaactaagaaaacaatttttttaaaaaaacagagcatttggaggagcaaaagaattacccttgggttaaatgatttgctatggtattgctggagagcatcgctgcatgacatgttgctattgttgccctgttgcttaatgcagcgggcccctgaacatattgcgtcataacttaatttctccattgctttgatctgagaaaataaacaaagtatgatctaagaaaaaaaagaaacaaattgacacaataaaatttttctgttgattttacttactagtcgctttccaaaatctcctgttttgcattcatccatttttgaatactcttttatcattccgcctttccaaacagagattcttggtggtggaccaattggaatacttctaattccaaaatctttgaaatcaagatatttaatctaaggaaacaacccaaaagaaaaagaataagtcaatgtttagaaatattatgggtataaaaaatgacttaagtaataaaaaagagatgcatacagcaagtaagtgtccgcagccgccaagggtttttgatgtttgttcctttgatttactctccttttggaacttggctatgtatgtcataagccattcataaacaaactttgaccagttccactttgagctggacttgacatcaatcagaggttcgaggtattttgggctagggtgagtgtctaagttggggcaaagaaaggttgatagtgcaaccaccatgaaacaacgtaggacatcatcttctgatagtttgttcacacccttgtcgctaagcaacttagtgccaaagaaggaaattaagggttttgtgctcccataatgctgatgaaaaaaatgttttcctacatcattgtcatgcttgatcgctaaacctccatttgggataccaagtatgaagttggtggtgtttggattgattggtatggatctcccattgacaactatatctgagcagctaaagtcagtgtgactagctatccatttgacaaaagatagtagtatagcacacctttgaaagtttagaagtgaaccaaaagcagatttctcaataattgtcctttgctcgttgctgagcccttcaatcaaattggaaaagtatgtgatgtttagtctgcttcttggttttggggactctgcacttccagaatgatcttggtcatattcaagttttgtgcgctggaagaaaaaaaa

SEQ ID NO: 49189 - DNA, 18336 bp, Oryza sativa
gtcatgtcacttgccatgctggaaaaaaaagaactagagaagtaagtacattaaaaggaaaagagagggatcttgtcaaatgtcttgatattttcatgtgtaaccaatcaaaacaaaaaaaaaactctcaatgtcctgataggctgctaagccacatgttaaattgtaccaaaaaaaaagaaccagtgccaaattgaaacaaaatgtataattgtgaacctgtttgataccccttgcacgaaatcttaaaaaaatcaaacaagatgcaagttgtatcttgttgctaactcattttaatcagcactgaagaatttttagcaaaaaccagcttgcatgaaagttaacatcgacaaaaaaaataataataaaatgttttttgaagctctataactgcaaattaatgtgttgaaccaaaatttgattacagttacatatacttgataaaaatgtcaactacaacatcttggtattgcaaaaattgtgttaactattcgcatgattatagttgcacaaaattataattaaagttgtacaaatttaaaaccaaagttgcacaacatttaaaaatggcaactatagaaacatacggatgcaattgctataggacgatgaaaaaacttgttttagttagtaaataatagtactatgtataccatatttcaaagtgatacgactctattatatatttgtacaaactcagcttatctgcatataagtaaatgtcaaaaacaaacatctttgtgttgcgaaaaaaaatgtattaactattagcatgattatagttgcacaaaaatcataattaaagttgcacgaatcactaaccaaaaagttgtacaacattaaaaaatgacgactgtaggaacaggaaggtgcaatttttgcatataaaaaaagtaacaaaactggatggatatgacattattcaaccacccacatgtccaagctcagcagcaaatcaaaatcttagcagaaggaaatgtactttttttaccctgcagcaagctccacccccccccccccggggtagaatccaacgctccctgaaaacaaaaatcgtagtgagctactacatctgagcatacaatcagtctgaagttgtgcttgtttataaccaaaattaggaaaaaaatcgtatagtagtcagctaaaaaagaattagttgcacaatttaataattgaaattgcatatatttataacataacttgcacgaaatgtatagtattagttgattttgctatttggacaatgctactggtatgtagatggttcaagcgggaaaaacacagtacatgaaaaaaagagaggcacgcttgctgtcgtgtgttgatgagaaaaaaaaaagattcaacataaaaagtagtatgggttgcaaaaagcaaaaacaaatgaaaagttcgacataattactaagaaaacaagttgtctaccaaaaaaagtccccagttgtatgcatgttttcctaaaacacaaacgctatttatcaaagtaaacggaaaaattggctcaaaaaacattaaatgcacaaacttattacacgacttgcacgaaaaatcaaaatggctactacaatagtcagggagtgcaactagcatagataatctcaaaaaaacataatttcaaaaagattactctcctctctcaatgctctgctggtaatctcaaaaagattaaacataattgataggagcagagcctagagttcattttcagggaggcttatctcagattgatcactgatggaatggaagcaaaagtggcttagtatgtcacagttgagcagaactactgttaaaaaaaatacacagcacacaaaaacaaaagatagctttttctgtatacaagcacaaaaaaatctccctgtatagagtgaccactaaaatggactgattaactcaaaccctctatgcacaaaatggatctgacaatgctgagggacaaaaggtaagagcatttgtagggatttaatgaaaatattggttagttgttgagctcaaattgctaccaaatccctaaacccctctctaaaatgccacggcacagaggtcatcactggcctacaggataaaaacgactaaatctagagcaaaaccatgtgtgtgcctaacaaatgaagttagggagaaaaataattagggagaaaaaactaggcagaggcacagcccacctcccaccgactatatcataaacgatgtgcggtaaaaaccctaaaaaaaatttccccaactacaccaaacaaaacatcaaagcacacacatcatgtgggtttcagatctagggatgctttgctcgacattggtccccccatcccgccccctgctactcgtgccctgcaccaactacgccgcacacgggttgatctgttgggtcggatcgtgggttttgttggcgacaaaaaaaggcccacggtctccatgtcttttttaatttgaacaagtatatatattggttatatggaatattttgatttcacatgatgacttaattgttcaaaaatctgagtagtaaaaatatgtgtaaaattatcaagatgctgcaattgcatacaaatctatcgatttcttcatttgcaattatcaaaaagatattggaaaattgttgacctaacttgttctgaattgtgctcccaggtaatcatgaaacatgcagctgttgtctaacaaaaaaaatcataataacttcaaatttcaggagacgtgcaggagtctaaagttgccagatggctggagaatggcatggtaaataatccttaacatatgtttgacctccttaacatatgtttcatgaagaaaaaaaaattcagtaaaatgatttaagctaatatctatttgacctcctctagacatagcttggtgttaacgttactactcagatatatagtcttgtttaggttcacaactagtttcaggaaactgggtgttcaggtattaaatgacaaaaaatataatctgttgtgctgaattaatttttcctctagtctcaggagaggcactggcgtgtgggtttggcaaaaaagaaagctgaaaggagttgatattactcgaggtatttgagaaaaaaaactaaacaaaattatacttacatttgactgatatgaggcatttaatcttgcccctgcatattatctagattaacataaataatatgaattggcacacaaatatattgacctctgaatcttgtacctctgctatgtcaggttttaacaaagtacacatatctgaatatgagaactgtaccttgcagctacaaaacaaactgctacaaaattgcagctagagttcagacaaaattaactattgacaactatctctgtctccaatgacagaactgcttataactatttctaaaaaaaatgacaaaacctatttctctatacattatgtttcaagttgggagcaaaaaactgaagtaagcatgttattcctctaattccagctcggatggtctgtctgatgagtactccataatgagaatgacccaatggtaagcatgtttattcgcaaatttatgggctatatatatccagttattcttcataaatggggaaatgatttacatcaaaagaaaataattagtgagaaaatgaagttagggagaaaataattagtggcaaggtttagaaccaggcagaggtgcagcccacctcctgccgactatatcatacgcgatgtgcagtaaaaaccctaaaaaaattttccctaactacaccgaacaaaacttcaaagcacacacatcatgtggtttcagatccaggatgctttactcgacattgggcaaaatcaactcaaaaacatatacccagtaaactccaaagcatcaaggaatgaaaaaaaactccgcgggattccccccccctcccttgaaatggtagccaatccagccctaaacaactcacaaaatccacatgatagaaaatctgaagctgaggggatcaggccgtcgcggtgtgagatttgaacaaaaaagagagaagaaaaaacctgaagtgcctcaactcaagcgcgctcgccttcgaaggcacactcgcggtgccttccccggcgccgtccgcggccgctcgcggtgcacagcccacctccctgtgccccccctccccccccgcctccccttccacctcctgccttggaagaatctccggcaccttccgctcgcaggactccgcctccccctgctcgagaaaaacacaaatgctatctactcgagaagcagaagcgctttctagatgagtcacgggtgcgggcggatttttccagagctatttgtgggctgtgggctgtaggctgtgggctgtgggctgcggactttgggcttattagcaagggaaagatgatggcgcgcacaaaatcaagacacataatcgacggtcgatgcgatcgactgatggattaaaatttgaatttggatctctaaactgggtctctaatcgggctctccaacttgaagtacgtccatcagcaaactaatcagacgaacatgccacgcgagaaggcattcaacctgatcaagccccgcgtgcatgtacttacggaacgtgaacgcttggacattatcgcgcgcggctgatcgttgttatttcctcgtaaaaaactttgaaagtgagacaaccttgaatgcgataatttcatgttcaactaatgccaatatttgtaggcaatacgattaatttctttgcttgtcaataatacatgtacatacatacacacacaagcgtacaacaaacaaaaggtgttacaatgcagctctgaaccctcatcgttcatgtccgtgcaacgaagtattgcactcatgctagccctagctttgtctctcctaccaactaccggcgatgtcgcaggctggcactgtcggcctccttgaaccaccggtgccggagtgcttgcgccaccgtcatcctcttctccgggttgcacgtcagaagtccactcaacacctcgaacccagcctccgacaatggcggccggcggagcatcctggcgtcggccggagatgggaagaagccacgaagaaagctgtccggcccgcatcctcccagcagccgctgccccttgtagcctcgccaccgcttgatgtcgttcacgccgaggacgtcgacgatctcgccgagctgctccctgtccgagctcccgcggaacagcggcttccgggcgaggagctccgccatgatgcagccgagcgaccacgcgtcgacgcgctcgtcgtagtccgtcgacccgaggaggatctccggcgcgcagtaccaccgcgtgccgatcgggttggagtagggcggcggtgaggcggtgctctgcgacaggccgaggtcgcagatcttgaggttgccgcgcgcgtcgacgaggacgttgtccggcttgaggtcccggtgcatgaggccggcgtcgtgcatcctcttggcgccggagagcagctgccgcatggcgacgcggacctcgagctccgaccgccgcgtcctcccgccccgctcgcgcctcaagacttgacgcagcgtcggccccacgaactccatgacgaggacggcctcgccatcgtcgcatcggccgtgcgcgcgaggctgcacgatgtaggggtggcccctgcacacctccatggcggcgacctcgcggtcgaagtcggagcggtcgacgagctccccgcagtcgtctcggtacgagcggatgcacttcatggcgacgatctcgccggagcggcagtcgcgcgcgcggtagacgacgccgcatcctcccgaggcgagctcgtcgagcttgacgaagcggcttgtggagattatggatatcccatatctacacggcgatggtatttgggctgaatacaggataccaaatatagatagaatatcttatttgtgtctcgggtttgttctcaacttggacatcaaggaaataccttgaaacttagtcggctacgactgtattttatctgtatctgcctattccgttagggatatagattatcttttgtaacacggactccttcccatatataaggggggtccgggtgcctctaggggcagaggttgattttctccaaatcatataatcaataagacactcggcggattcatccccggacaggaatagggtattacttcttcaataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaatgggtttcgtctccggcatcgacgacctcgtcttcccatccgggcagacgtttcggttcggcagcctcgacttcgtcaccaacaacttcggcaagatctctctccttgactcggagtcaaaccagccgggagagaaccggatttcagtcccgtttggactcccaaacacggctgaaagttacttcaagaccatctcaaccgagtcggcttcaaaccactcgggcgagatcgcatcttctccaacgtcaccagatcaagatgatggggcttacccaccgatcctgatgaggctccccgacgatttggcggccatctccatcacgacagcgtctctatcccgtaggcctaggcggaagtcggcttcaacaccgatttcgcctagcttcagggaagtcggcgtcatcctccaaccactcggcacggtttcgacggatcagctggatggctactacagctctcccaccgtcgactcgcgccccaccgacaccgtggagtatgacgagtttagctctcgctacaacgacccggatctcgacgacttcgacggaagcctagatgacaactacacccctctctacttcggcgtcttcatggccgaaaacgagacggaggagcaacgccaagcccgggagaccgaagcacgtcgcgaaactgagcgtcgccgactggaggaggagcatcaagcacaaggacaagaacgactacggcgtgagcagcaggagcgtgagcggacagtgaaggaggctgaggatcgacggcagcgagctttggaagcagggcgccgagcgcgtgatctcatcggccaacaagatgttgaagggacaccggttttccgcacccctcagcagaacacggttgccgcgatcactctcctcgacaccgtcctcaaggaaaacgagctcaatcaatctaatcacgtcgtcaacatcttgaaccagacgaagaccatgattgcggcttcagtcccagttaactctgaaagcatccacacgccgactggcagccgggtcccacacttccgatctcatgattaccgtcatccaagcctcagcatcaccggcgcaggatccaatcgcaggagcaggggtcacgacgagcggtccgttcactcacctcccgaccatcatagggagcgccgagtggaacggcctcactcaccacctcatcgccgccccgtcgatcttcgcgacacaatcatacagcgccgagcagctcgaggccatcatcattcgccagaccgccacgacgacgaccttgacggagtaccagccttcactgacgacctgcgtcgagtggattggccagccggcttcaagccgactggaatagagaagtatgacggtaccactaacccagaatcgtggcttaccgtctacggtctcgcaatccgcgcagcaggaggagacagcaaagccatggcgaactatttaccagtggctttagcggattccgcccgatcttggctccatggattgacccgtggtacaattggatcttgggctgaattacgcgaccacttcatcgccaactttcaaggcaccttcgagcgtcccggcacacaatacgacctctacaacgttattcagaaatccggagaatcccttcgagattacatccgacgattttccgaacaacgtaacaagatctccgacatcaccgacgacgttatcatcgccgcattcaccaaagggattcgccacgaagaattggtcggcaagttcgggcgtaagcctcccaagacagtcaagcttatgttcgaaaaagccaacgagtatgccaaggccgaagacgccgtcaccgcatcaaagcagtcaggtcccagttggaagccaaacaagggtacgccggctaagggaggaggtggaagtaacaatcataaggaccgcaagcgtaagcctgaggaacttgttgcaaccgccactcactcttctcgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactccgacgaagaacaaagtacgtcgaggaagaaggacgacggcgacaccccggcaggatttcaagaccaccgtaaggagctcaaccatatctttggcggccccctggcttatgagtctaaaaggaagcaaaagttgactgaacgggagatcaacgctgttcagcccgacacgccccattatcttcgatggtcagaaattgcaatcaagtttgaccgctcggatcatcctgaccgagtggtccacccggggcggtaccccctggtactagacccagtggtccgtaacgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagtttatggtacatcggaggaagacaagagtactcgggaagagcaggctcaggattctgaacataaaaccaagtcgcatgccaccctttgtttgaagtcttgaaaggcattgagaagtacttctggctaagagtccccctcagctggaatccggccccgcccactacacatggcttacttttggttgggtgggggttggaaaaaaaagattcggcaaaccaaaccaaagtggggtttaattcccaaaaaggcttcacaaacatggatgaaatggccgatgtggactatggaatttggatttaggtgatgcaagctgattccatagaagcttaatatcccgcggaaaaattttgaggtcggaagagcgaagccgccatagaagaaatgggaaaagactacaacctcgtgtgtatcgggggacggaaaagcctcaccgcacgctggccgccacccgatgatctccttggcaggaagaacgccgtgcgccaccatctccttcaggttctcctccgtcacgtcggatggtgcccattggccttcaaagctttctttctcttccgccatcgattttacccgaatgcactgatttgattcgagggatggctagggagaggtgagggattgaggcggtggatcacgggaaggattttgatgaactttttgaaggtggattcgagtggaatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagcccaatacttttgacagcgtggcccattgtgttccttagggacttaggcattttttttgctttggcaatttatgcgcacaatagtgttgcccaatgctgataaaatcctttttatgcggtcatataattctttggaattattgcaatgcaaattaaaaggtgcccgacagaaaggtgttatactgttttttgtcagctttattaggctacaaaagctgtttgggttaacttggaatgacttgtttttaccatagtcatttccttggtatgttatatgcctgctttctttatggtgaatagtcatagcctaggctattagacttattcattaccataatttttataatatttggtgggtaatctttagagtttttattcggatgcctgtcaagtgtgttcattcgtgaaccttttagagtgttaaccactcggattccttttattatggctaaaaagcagtcggctaaaatgcctctttaggcgccgcgtatgcttttgtcatatgacgcacgattgtgctattattttgttctcgactatatgtttagtttgttaactaatcacatagttgggggctacacctaattaggtgcatctattcgatgcaccatattctttgtcttttcgccctttacagtctttgtcttcgccactcggcaggccttggcatgagaagtttgaagcactcggatcattatctttgagaaggctatgatggttgactgcaaaggtcgtgggggctactgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcctattccgttagggatatagattatcttttgtaacacggactccttcccatatataaggggggtccgggtgcctctaggggcagaggttgattttctccaaatcatataatcaataagacactcggcggattcatccccggacaggaatagggtattacttcttcaataagaaggcctgaacctgtataaatcctttgtctccaaacccatacacttttccagcttgatagccacccccttttattattgccgaaatctagtttcgacacggctgatcacgacggaggaggccgtcgccatcgccatggccgccgagataggtagcctagctagggttttcttttccgtcctctttctttcgtggcactcgagtcgatatgacgcaaatgcaaacgggttcaggaggagagaggtagcaatctatttatggctggctgggctacgcacgtgcgtagcaacatgagtccgatgcggtctcgacgaagtagtcttggcgcgaagccgcgaacgcagtgatgctcgcatgcacacgtattcggactccgagttgaaatcaggggattgatatatttggtgacagagatatatatgttccatttcatgtgtaacgcagctaaacaaggtttttacacgtgtatgcatgcatccgtattccgtgcgtcggtgcgtgcaatttcgccgtggcctgtagataactagcgtgcgcgcgcgtgccaattcatttcacttcgggtttccgaatatgcggggacgcggccgctcgaccagctgtgcaaagggatgaaaacggtcggaatcggtagcatatctttgaaaacgatacttgatcggccggtaattgaccatatttatcatttaaactattgatcagtgtcgacattaatacgatgcagaaaaaaatagaaaaaaacaaaatttaaaaatagcaaaaaagggtacgtataggcggaaacggtaccccttacacggaaacaacgctcggtcgattgggaatttccatgactgtgtgagtcagcctgtgcatatgtagagagcggcgatcgcgccggcgccacttcctggcctccgcatttcgctctcaaccacggcaccaccacccgctcacgttccgccccgcctctcctaggccgggcccacttacatctggtagcttttataggtcatagactgccctcacagaccaacacaagtctttctgcaaactttgtcctcactcgtgcgcacccgggaagattttcccggtcggtcacccatccctaaattgctctaggcttgtcctcactcgtgcgcactcgggaagaatttcctggtcggtcacccatccctaaattgctccaggccaagtacgcttaacctcagagttctttagagatcggcttccagaaaagaagttgcaacttgttgatatgagtattctattaatcctattaagccctgggttaggatgtcacacctccgcttctatctggtagctatgtctcgtgctgccatggcgccatcatccccttgctccccagcccgtcccctccacgtctatctagcacctgcgccgcgcgacgccagggcgccactacgcccactcgcgctccacccgttcacgcccgccacctctgacctctgtgtcacacctccactgtgcgcgtcaccaccgtgccactaccgcctttgtgcagtcgagcgctatatacctgcacctgcgcgacctccatcccattcctgtgccgcaccacgccctgtcttgtccttcggtggctagcctctgctactctatcctccccttctccccatcgtctccatatctgaattgtaaagctttgccaaaagttcatgttaatttgttgagtaaactatatataccactggtccttcaagatgaggccaagtgtcacttaagtccacaattttataattcggcatttagatccatgatcttgtctaagtgaataatcgtgggtccaaagcccatttgacaagattgatttgcctacgtggctccattgtgaccgtatctttgcatttaacctcctctgcacccgatcgaccaacttctcaccaaatatcccctcttctttgttgtttaaatttagggtttcagcggcggcaataggggcggtagtggtgatgtgactaggacagcaacgacgagggaggcaggtagggcggcgccgacaagggtggtggttaggcggattcctgaagcatgccaataggggaagccaatcagccatggctactttaagcaacgggtcttttcaagtgcatagaggaaaaggatcaatctcccgttgattatgtgcccttgttgccttgcaaaacacatctccaaacactgcggaagcgcggacagcccacaatcatcatcgcagcccttggaatcattgcaatcatgcgggggtggatggttgagtgttcgacagagcgtgggagcagtggccacaggtagaggggatatttggaggagaagtgggtgactaggcatgaaagggactaagtaaaatttgtggtcacactagacagccacgtaagccggtgaacccgatcagacgggctttggacttatgatggttcactaaaacatgatcatggacatagaggttgaatttacaagattattaacctaagtaacatcatgccctaactttatgaatcggcggtgtattttactctaattttttagagggggatactaccaagccttgtctcgtagtgtaactttataactacaaataaaacagagttttacatagcaaatacaaaagaaaactaataagcaattacaaatgttgtaatcaatcagcaacttcctacacatacataggagaacatcattccgaaaagcaaaccaccagctatcaaaaatggagtaatattttcaaaactcttcccattttttcttccaaatgtgccaataggctatgaagaaaacataaaagaacccttttcgcttgaaccgaagtattgctaaatccactattttaaaaaaaaattgaaacggatattccaagggatacccaacttctttcagcaccttttactgaaaggacggcttgtttggctgcaaggtacaacactgccatacaactgaaccacaacctattgatcatttgtttgctgcatggtgtaatacccggctggctgtatggcaacactgcactaggcagccgaacaaagccaaaggaaatacagatgcaagagagtttccctttattgtgtagagcaaagaacacaggttaagttagcgtgaagagaggtacaattctttctatcgaacatgtcccttatgttaagacggtctcgaaacaggagctagatgaaggttttgattttcatcccacactcagttttctataaccacaagtttctcttaattcactatcttatatcttacatttgtttgcaaatttctgcaagtcacattaattcacgtttgtgtggaagtttctgttgatatttctcgcccttctgtttgtctctttttttttttttttgctgccatcgcatctgaaactagaccgggtcaacccaccataagagcaccatatatgagttagactatgagtagggttagactaatgtgtgggtcgggttgactgatagcttgcagttttctgcccgattcaactgcacccctaaatataatgacagagccagaaagatttttaaaaccgagtaaaacttaactgtatctagtatttcttacagagattctatggttatttcagttgctaaaaattcgttggaacgtatgatggtcaacctgggcaagtagctgcctgtggtagccggacagtggtcagtggctctgcctcaggtttggctaagctcatattttgtcggcccactactcaatgcatacgaaccatggcatctgggcctaaggcctggagggacatccttaccattttccgatttacgtacattttgctgtgcaaaagacttactccgtaactaccaccattgcagccatgagccgtggcagctaaaccaaagcatgcagtgacgctgaactaggttggaacatggagaccgagtcttatccataattaatatcctgtagcatcttgttcatcctacacaagctaattttcttgagggtaattaagtctgattagccctctaaacttttgcagacgtttgaattacctcatctattcctataccagatattaacatccaaactattgaaacaagacgaaatatatctctctaacacaatcaacgtacagtagtttttgagcctagaaaagtcaacaaatcagtaaaaaaaaatttaaaaaatcttaatctctctctctttcttactctatcgggcagcaggcccatcgatatctagaaagacgaaatgagatttttttttacggtgtttgatctaatggtccacaataaaaggtatcacttaaaaagatatttaagtattgatataggtacttaggtagtaagggtaaaatgataatttttctaagaaatagagaagggcataattatcttcgtattagttctaagtacataagtgccgcatcggtaccttatctccagtatgcctgatgattctccatacattatttacatgttgtcttttcagatttacattcttttcctaagaacatgatcaccggtaatcctccattccgatatttacgtgtttttttaatttaccttttctccctaagaacatgatcatgatatttttaaggttgatgtcatgttcctaataataccatcagataaaatatgactgaatgtttgcgtgattattttaagatttatattttatcacaagaaacatacaacctcggtaaatcaccggttgtaggttcaaatgtaattcatcgtcaatatgctatatttacatggtttgttcaactttgcatattctctccgaatgaacatgaacatagatactataaattcaaagtacaatcttaaaacaaaaaaaaatcaaagtacaacatatgatagtaagtgaagaaggaaatggatcagatatgttttttttttatcatgcagccatgttgtttggggcgaaaaaatgtgtctttttttattattgtgttgatcagagtgcaatcgctacaattgaggaaattcttttaaaaagtatttttctctttaattgtacggtaatcaacaacgttaattactgagatcctgatcctgttctcgcatgctagaaattaggggctaatttggttattattgtttccaacttaatcatcatgcatgcatgtatgcatgctaaaatttaggagctaatttgactgctatgtacgctactttatatagaaacacgcatgtccacttaattttaaatttgtgatgcatgaaaccacacaaaaatacatattcaaatattataaaataataaaatttatttcgaagacaaaatgtatgggaagatttatattttctccactgaacgatacaaaatgtattggagacaaaatgcctcggaagattgacatatttttctactaaacaataccgatcaattcaatttcagccaggtatttgagtaacccaaaatgccaatattttactagataattacttcactgccatcggttacgataatttttattccgtaacttacccttctcttgatcaacggttcatattgatctacctctcaatacctctagatacctcgcaaacactgtaaaagctctcaaagagtaataacagggacagcatacggcagccatgagaaggaggaggacccatcggccacccgcctgctacaacttccttcgctctacggcagtacgccgtacgcatatcggcgcgtcggctctcctccgccttcgcggcggtgttcgtgagagtggaggtgtgcaggcgacgatgcctccgatgcgacggccgaaaattcacggtggcgtacgtcgagttgtgacagcggacggcaatgagggcaggcgcgtggtcctagcagggaaatgtcaccggcggcccgacaccatgaggaaaagagagtgatgtggcctccgtgctccgtgcttcatgccaaattggatctgaccggatgggagctaagctccatgcactcccgtggtggccggggtgcaggcgcggcagtgtttgggcagccaggatgagttatgactctgcatcggtctctcagccatcgtctccgctgatgatgattgttcaattcctcttcgattcccctctcccagcgaaggcgccagcgctttctcccccgaccctctcccaagcacaccactgccagactcgagacacccaccattgagacgtaagtaggtcaaaccacaaattagtgagtaacacacaaattgatcgatctgtggttatctactaatttgatctataagtgtgttcacggattgacccacttacacttctagatacagcaagccaagccacgatatatgaacccgttggttttacccacttatatattttacttataagtgccttcacgggtcagtccacttacacaaccagggttgtgggatccaatagcaaaaataaactggcctacactaaaatggatgtattttggatagatatttcggacgaattttaatcaaatatgaacaaaatttgaatcaaatggagatgaatttaggggataatattgtctcggacctcaccgagatgggcaaatttcaccaaaattcggatctttcggtccgaatcccagaaccctgatccctatttccccattgggctctagcctcaagcccttaccgtcgtcaacactgaagagagcagggaagtggggtgaagaatgacgagagagaaagacatatgcagctagctattttttttaaaaaaaaattgatggctcattctagcacatgggaccaaaaccaccttataaacagcccggcgtagattaagggtgaaagatcgatctgtgaggtcgtcacacctatcttacgccgccgttgatcgcttgccaatggagaagaatagccgatttggtgctgcgggcggacatggcaactctgctgctcgtgggttccatcctgctgcgggcggtcatggcaactctgctcgtgggttccatcctagttttggcggcgggagtcagcaaggtggtagggaccgaggttgaggaaggggagggttcggcggtcgaggtcgccatgatcatcctcaaggtcctcaaggtggaagatggtttggcagtgggcatggttggaacaatgggttcgggatgaatgcaggtccgaacgtcggcaatttcagtggtggtggtcagattggtttcaatcctaacttagggtttcagccacagtttggtgcttccggtagccatggtggtaatccagttggcccttttctgccatcaggtgagcctgtgaccaggggttcatctgtagttggtggcgcattccctgtgggtggcggtgctgctttggctggtgtgtctgtccctgtgccggctggtgctggttgtggtgtacatgcgcaagctggtgctgcatatcctgtgggtggcggcggaggttctggtgctgttcttggtggagatgcggtgcctggtggagctgctttttcagttgctgttgcttccttgccgaaggtcgggggagttcagcctagtggctcagctaatgccgcatcaggtggtgcaatcgctcaggtaactggtggttctggtggtatgtaggggcaaggtgttgccggatcagttaaaggcaagattggtatggatgcttcggtaggtgggtg

SEQ ID NO: 49190 - DNA, 6843 bp, Oryza sativa
  unsure (1)..(6843): unsure at all n locations
caaagggttaggtaacccatattgtttccggtgttacactaaagggcatacaatgcaagaatgttcttccaagttatactgtgaaatttgtgaaagtaaggatcatgttgctactcgttgcccgatatttaggtcaactaataaacctattgctcagttatgtggctatgctgcagatggtcttggttttttccatattccactttcagctggacagaggattaggcatgatccaaaggctgttttggttaaagtgactaacggtcagatgacaataaatgctgtcatatctgagctacatagattaatccctggtaagtgggagtgggtggttcatgacaatggagatggtacttttcgcactatctttccttctgcagctaaattgagtcgcatggtggagtggggcaaggtacacactaaggttagtgaggctcagatggagattgtagaatggggtgtaggaaatgaggtgaaatatgtggttccgaaggtgtgggtacagtgcaaaggccttccttctgaattgagggagtttttaattatttgggctgttggttccattcttggcattactaaagccgtggatatggttttcactagaaggtatgacatcgctcgtctgcaggttttggtccttgacccatctttgattccggatgtagtggatgtggttattggggatcacctgtatgagctaacctttagagttgaacctgaaaatgggcctgaggagcctatgcccatggagatggaaaatttggaggatggagatgtggagaagaatgatgaggggaatataaatcagaaagttgggaaggaagctggtcttgatgattcaggaaacggttctaagttgggttctggtgttcagtttagtgagaggggttgcccacctgctccttcctcacagctaaatctgatacatgaatatgatggcttgactgcttctgatgaagattttgatggctttgttgaagatactttaatggttgacaaggttcagactcagcaaaatttggtggcaaaactctctgctatccctgaggcagtactctctccatcaaggaagagtaagagaagagcaagtgacagtgatcagcttgttcttgaaagggcggagaagttgaaggctgataagaacttggagaatctgcatactaaaggtatttatttaataatgtttcttttactgaattttcaaataatcaaatttctgcttatttggatagtcttggtgttatacctacttctgaaaatgttgttttagatgatgtaattaatgatttgaaatgtgtggagagtaagagattaagtgaatatgattgttctgctattaatcaggtttctacccctaatgttgatactgagtcattagatgactagttggaggacaattttctactacaacatctatgtagtgaaattatggaggaggtcatggatttcagtgaggactgtgagaacaatcttacaaatactttaaatcccttggcatctccctctaactctaagaataagagtaaaaaggggaagaagaagaagaaaatttaaaacaatttaaatgaagggaatcttttggaattgtgatgggttcaaggacccgaaaaaacacaagtttatttctgacttaaccaaggaacatcaacttgactttatagctttgtctgagacggttaaaaaagagtttactccggctgcacttaaaaatctttgtgctggtaaggagtttttgtggccctgtaaacctcctagaggtaggtctggggggcttcttttgggcatcaatttactaaatgttgatattggtttaattgatgagggcgatttctatattaagttccatttatgtaacaaagtggataagttcaagtgggctttacttttggtttatggaccagcacaaaatgaacttaaggatcaatttctcgctgaattagttaatttgtgcagtcatgaatctttaccaattcttattggtggtgattttaatattttacgtagctcagaggaaaaaaataatgacaactttgatgatagatggccctttctttttaatgctattattgatggtctgagccttagggagttgcagatgtcgggtaggaattttacttgggcaaataacttagcaaatccgacctatgagaaactagataggattttgatgtccactgagtgggaacataagtttcctctttcatcagtggttgctcttaatagagatatttcggatcatactcctttacttttaaatacaaactcatcttctgtgggtaatacacaccatagttttaaatttgaacttggttggttgttacgtgatggctttgttgacatggtgaaggaggtctggtctagtgtcaatgagggtaatactcctatggagcgttggcaggagaagattcgtcgtttaagacaacatttgagaggttgggctaaacatacaagtggtatgtataaaaaagaaaaaaaaggagattctggataggttggatttgctggataaaaaggctgaatctgatcttttaactcaggaggaaattgattttagatggttttgtaggaatagattatctacacttttgagagaagaagaaattaggtggtatcaaagggctaaaactaaggatattttggagggtgattcaaatacaaaatattttcatttggttgctaatggtaaacataggaaaaccagaatttatcaacttcaagatggggatcaagtaataaatggtgatgcgaatctaaaatcgcatattaccacttattataaaggcctttttggtcctcctgatgattctgatctccaatttaatgaaaatcattttgtttacattcctcaagtttctcaattggagaatgaagctttaatacaggactttactgaaaaggaaattaaagatgcaatttttcaaatggaacataataaagctccgggtcctgatggatttcctgctgagttttatcaggttttttgggatgtcattaaagatgatttattaaaccttttcagagatttccataatggtacattgcctttattctcccttaactttggtactattattctcttgcctaagtgtgcggaggctatgagaattcaacaatatagacctatttgcttacttaatgttagttttaagatctttaccaaagttgctacgaataggataatgagcgttgctcaaaaggtgattagtcccaactcaaactgattttagccctagaaaggaatattatggaaagggttgttatcgtacatgaaactatgcatgaattgcttcgaaaaaataaaagtgttgtcatttttaagattgcctttgaaaaagcatatgataaggttaaatggtcttttgttcaacaaacactaaggatgaagggcttccctcctaaatggtgcaaatggatagcttcttttattcaagggggtcatgttggtattaaagtaaatgatcaaactggtaataattttcaaacgcacaaaaggtctaaggcaaggagatcctttgtcaccaattctttttaatatagtagcggatatgcttactttattaattaagagggctaaggatgttggttcgttgaatggggttgtccctcatttagtggatgatggtttgtccattttacagtatgctgatgataccatcatttttttggagcatgatttacaacaaacgaagaatctaaaattgattttatccgtgtttgaaaaattgtctggcttgaaaataaattttcacaagagtgaactattttgttttggccaggcaaaggaatattatgaccagtactcttaacatctttggttgtaagcgtggctcttttcctgttaaatatcttggtatcccaatgcattatagaaaattaaataattaggattggaaggtgattgagcaaagaattgagaaaaaacttagcagttggaaaggaaaacatttatctgttgggggtagactggttttgattaactctgtgctttcaagtctagctatgtttatgatatcattttttgagatacctaaaggggttcttcaaaaaattgattattatagatctcgtttcttttggcaaggggatgattataaagaaaagtgtagacttactagatgagatataatttgtcaacccaaagatcagggaggtttaggggtccataatttggaaatacaaaataaatgcctcttgagtaaatagttgtttaaattgattaatgaggaaggggtctgtcagaccttattaaagagaaagtatctttataatcagtctataacccaagttaataggaaacaaggggattcacaattttggtcagggctcatgaaggtcaaaaataccttcttaaatatgggttcatggattgtaaataatggaagacaaataaggttctgggaagataaatggctaggtaacttggcttttaaagacaaatatccacctttatattctattgttcgaaggaaaagttctactattgctagtgttatgagttctgttccacttaatgtttcctttaggagaggcttagttggccataatcttacatattggcatgaattgtgtacttctattatgcatattcaattgaaccgttcttctgattgcttaagatggaattatcatcagagtggtagtttttctgttaggtcaatgcatctagctttaattaataatggatatatcgaaagaaataagattatttggaatcttaagatgccactcaagattaagatctttatgtggtacttgcttaaaggggttgtgctgactaaggacaatttggcaagacgaaattggaatggcaatttaagatgttgtttctgcatgaaaaatgagaccatacaacatctttttcttgactatcattatgcaagatttgtttggagagtagtacaattctctttaggtttaaaccttccaagtaccatatctaatatgtttgatgggtggcttatgggggttaataagaagaagtgtaatctcatacttgtaagagcatctgccttatgttgggccctatggttgagtaggaatgatttagtgtttaacaaatcaccatatacttcatatatgcaggtaatattcaaggtaatatattggctccggttttgggcaaagctgcaaaagtgtgaagaggatggtgaacttatgaaggttgcatgtcgcaaactcgagacgacggtgatgccactttttgccaactaaggatggagattccccaataaacttgaaataaagtggactccttatcctgggttgccttttaatttggtgagggcggttgattacatttgaactaccctctttgtatgagtgatactttgtaataattggctgtagctctgtcgagtcaaggccgggatataaattccgttatctaaaaaaaatttgagtaaggggccgaacacatttcttgaacatcgtttacccttccaccatgtagttttctttcttaattaggtctatttttgataatagaaacggttgacgtctccggtctctgccaacatatatacaccaagtaatgttgttgataaagaaaatttcaaacgacgggactagtccgaacctgcttaaaaaaagaccagttggctgattaaaatttaaaaagcaagtaattttataagtagtatgccatctaaaacggaacagaacacgttttgcaaccggttcaaaaattttagcaccatgtagtattagtgtttgcatgcttttctttgtgatagtagcatatcccaagagtagggccttgtgtgtttttacaaagtggatgacaaaagaaggccgatatgattagattggagttttattaagagcataacaaattgggaaaaactttgcggcccccctaatcattgatcgtcatatcaggcaaaaacaaaccaaaaaaatcaaccccccgaacaatctgcatctcgagactccaattctttcagttccaaggttatctacctcccattgaaatttccattctattttattctttctccgaaagaggaaaaactattatttcttctagttaaaaaaaaacgaaatatgatccatacatgtagttacatcggaaatatatataagttacctctagaaattagttccaaaatttgtattacaaaattaaatcatgcatctgaaatatgtaggtacgtactccatgatgacaagcactgcgccatcccacagccgtccatgtcgcacaagacgtgtgaaataggaattccaaccaaaaaagctagaagattagcgcaatgagcagaagacgcgcgcgcatccgaaaatagtaggcttccagataatttaaatgaagccatcctactaaggactagtgttatctgccaaaggccctgtttagattccaacttttttattcaaacttctaactttttcgtcacatcgaacttttctacacatacacaaatttttaactttttcgtcacattgttctaattttttcaaactatcaattttagcgtggaactaaacacaccaaagttgtcatgtctttattgcaggtttcagttggatgaaaactataagttatgtggttgttcacaagtgtaggcctatgctatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49191 - DNA, 1583 bp, Oryza sativa
atatacggttttcttatttaattcgtatatttgtatgtattatgaagatgagatagcaaaatgtgtatattgatgcgagtaataaccattaactactcacatcggactctcatcattaatttttctcttcatttaaaaaaaaacattttatggtgaattattgggggggggggggggggtgattgtacaggccatccccccacctgaaatattgggggagatatatccccccatccccccgggatcgacacccatgcatggtacaatccttttttctttaagccaataattgctttgtcatcacgaattaaatgaaactcatgaaaagcactttaatataagtaaaagttattagttattattataaaaaatgttacggtctcatctgttaaagggaacattgttcagatgattgatagtggtgcttatgtagtgacttcaatgctagatgtacaattaaaaataatctgaaaatttgagtgaaaacggactattattaatgatacaaattgggaaaaactgatctgatcgataacttaattctcccaactatattgcattttaggttaatgtaaatcgtcacacagcactaaattggctctacatatcattccagacatttaagtgttgacagattttcaatagcctgttttatgtcttttttcatggaaaatcggtttggaaaattcaaaaatggttgggagattttactgttaatcactgttagagggtgttgaccagcgaaacattctcagaaaaccattaatatctttgtggtttgagatttttttcaggattttttgcatgttagagggctagtacagtagaaggaagatagtaagtaacatttcatacagaaattaagcaatttttttcatcaactttcaactatgttaccgagtcactttaaagtggctttaacatcttctaatatattcacatttgcttttatttccgtcctaccttgttcactagaagcttggcaaatcgtttgcctttctcgaagttttcaagtccaacactattcgacgcatcaaacgcaaagtagatatccagggcggaagagtttgatagatcgattgtacgcttccttcgtctactaccggagtttgaagtggtgttattgaaacccaccccgaagcccccgtcgatggccatttcgtcgaaggcctttcccaggccgctcgtcactcgagcgaattcgtcgaactcatcacgaccttgatgggaaacagtacatttatataattaaaaaagtatatatcgaggggtcagtgacacaaagacgtaattctattttggccgttttgagaaaaagtggtttatgtgtccctgagcacttgggccttaaggagttaagtctatgcttcactagccaatgacttcattgggggtattgggtggaattaagtctgtgtgtttcctggaaagcccacatttctctgaacattttaatatcaagtactcattttggcaaaatatggagttaagtctttgtgtcactgaaccctcgatatattttacaagatagggctgaatggtgcacttatcagtattattcatcaacgtaaaaactctttcaa

SEQ ID NO: 49192 - DNA, 15579 bp, Oryza sativa
gggagggtatccagatattgatgaggggagggtaaatcttccctaacgcaaaagaaggccagattgtaagtatccttgatgtctttgttagagactcgctgtgttagggagctgttagtttgatagtcatctggtagtgattttgacaccttgaaataggaaatttcccttattctaatacactcgtacgtcatcagagaatcagccataatctcaaccagtggcgtagcatgagtccacccatttagggggctctccaatgatatgggggtggggaaggggcgtctccggtcttacttttttacaaggttacaagcttagggggtttgggtgtttactagatgagaggtaatggtgcgggaggttgtccgggcgtctttttataattgtcctgttccttttctgtcttttcccggtcttttttcttttaattttacccttcaacagaggagggaacacgtgcccgctgtagctacgccactgatctcaacattctttaggaacttcgtctctcttgttcttcttactcatgcatcttggcatctctccagtccactccccagaaaacgtacacatcctctcttcagaaccaaccatctcgtaaccaccgttacatcgaaaacggacataggtgttcactctgtactgcggaatggcgactttggagccgtgtatggggttccccaaggcgggacagtagtactctgtcatgataataaaatcagttagtgggccttaacattataccgcagtcacattgctaaactacttcaaacctaccgcagaccgaccagttttggccgttgacagtaatatatattttgttgctgtctgcatttttgtcggcctcgttggtgtgactgaggtattacagttataagacaaagttacgaatcaaacaaaaatttgatcctaattttgaatcttctctttatcaacgcaatgtaggctttaagatacaatcgattcctttgcaaaaaaccgagctaaattcatctagatcagatctgttctgcacgaaatacagctttatcatgaacgatccttaacacccactccatcaattttattcttggatgcgatcaggtaaacgactcaagtctgcaaaatgtagaacaaatcgctatctgaaatcctttaattattccctgttcaataagggcttacaccaagccacattaaagataaagatgagttctggtaaaaaaagaaaataactgaaattctcaaagaatcaaacgaaacttacactgaatgttcaagattacaaataaatgtcatttgccaaacaattttggtaaaaaaatgtatactggctgagtaatgagcatagaaagattaggaaatcaaggttagtagccccgacaccatttgtgtagtcccaaatacaacaagtttctgtgtacagtgcttgttactttaccaagactgggccaaattgattatgattttgatgactccagaacattgcagtacacaccaatacttacatgatccattccacaccttttctttcacaatgcaatcggatgaccagaactcacctttatctttaaatacgtcaataattgttgataagagtgtaatgattgtccaaatgtaaatgctcatattttgtacaagtcctgtcatgccaatcgacactgcaaactaatgcgaaaagggtgatcttgataattaaccatttataaagctagactaaagtttcccctctgtacctgcttgattcaacagtctctgattttcagttggcctctctctttctcagaaccctgttccaggagatgcaaccacacatgattgaactttctacaacagccgagtaaaagagtttcagatatgaattttcgacatggaaagacttaaagcccgtctgcactaatttatccagggggattagacctccgtgcaaggtcactgacaggtggttacctcatcaaataagctctcaattaacataagaaaaagaggatcatggggaccacttcaggcaccgattaggcattgtttgctatatagagggcgcaagtagctattagtagttcagtggggttttaagcttcctcaagaggtggagactacaattatgatggacatctttactttgttcgtcccaacttaatttgttgccgatcagaatgccgagatacttatcagagacctttaaattgttttaaagggatcaggtaactttgtgtcagattctgaaacaaaatcctggatttagctcatgctgcaatgataattataaacgtttaggtcagtcaggaaccccatgaattttacaagccgatcgcctgtctgattatcaaggtatttatgattggacttacaaattatgaaaaccgtttaccaaacggttttcataacactacagtctattgggggaaaaggagtattgtaaaaccggtcactcaaagatgtttacttttttgaggcacttattgatcattttgaagcgcgatttttagggcttcaatattacaccatatcacagacactgataacacgtaggaccgtgcatctcatatttaacattgctaaacgatgcctttaacccgttgactactgaattatcatattcccatagacttaacacagggagcaccaggtttcagtaagcaatgggttaaacatagaattgaatcatcactttgaagttgatttcactatgatttggagtggattaaatctgaaaggaagtaacaaaggaaataatccctccgcaaatgactcctggaaaaaaagagaatttccggtaacagagtaaaaataacattatcgcaaagactatacaaaaaacataaaggtaatgcaatttcaatggccttgtcacctattcaactggatgaacatgacaatgacgtattatgtaatcccaacatgatttatattggttatacaatgtggtattatagttaccaatgagttgattttgatttgttcatagttcaagtttttatttccacatctgattttaaaaaacacaagtacaccttatatgcatataggcaaatcagaggctatattttgtaaggactttaagaaagttaagggtagacaatacacttataccccattcacagtggcctcaaacaccgcgacagcagcgggtgatttgtttacttacctatcactgacctcttttctccagcaatggggaacataaagtgaatagaaataaagtaaccagtggattcaaattgattttattattatgtagatattataattatccaaataaaaatatttcacacttcaaaaaattaaaatattctgactggaagcaataaaaatgctagttttttaaaaagtaatatgatcgaggatacaaaaagcaacttgacatgtttaccttttgcaagagtgtgtaaagtacagctagcgcgcgcaatttcaagcgatcgaaaaccccgcgctgaagtatttccggtcatatcggggtcactcgcgggtcatgagccatgcatacacgtgtttgttacggaggtaataaaaatcacccgctgcagcgtgaatgggtacatgatatttatcccgctgctgcagcgggataacttttctactgtgaatgcatttgtagcggtgttatggcggtgtcgccgctccgctacaacgccgctacaaatttcaaaaccactgtgaatggggtataattgttcttttctacaagtccctaatccagagtgttctgacgtacaacctagtctgctactttgctaatgctacaaaaattgaccagaagaagctcaataaacccaggaaaatagttcaacgtatactagggatagacttgccactacttgataatctgtaccaagagagagtttcatctaaattaagacaggttatgcaggaccccacccacccactcaacgagaactttaaatttaaccgttcaggcatacgtttgtgcgcaccgcgcacacagaaaacccgtttcaggcaatcttttgttcccaacgccattcaccacttcaatgcacaagcccggaggtctggaactcaaacttaaatactggtctcaacttatactttgttctgaatttaattttcgctagggctcataatattaaactcacctatattctcaaataaacagcgagcttaatgttcgaatttttcacctggaatgccatgtttatgttatactgcaatcatgtattcgttttgttccgtttccattgcaacaatcactttcaaaatgtaactacgtttgtaacgatgtacatttgataattattgtattatgtattgttcctgtattatgtatatatgtacaaagactgttaaaccagtgaaaaaagaatttcccgtaagggacaataaattttcaattcaattcaattcaattcaatataattatagataaacgttaaaatgaaacatcttcaatttaaaccataatgtagtgggggaaagaacaaaggctaatagcctatcaagaatattcccagagataattacatttacataaaaagtttcttaaacgtactaaaacgagatagaaatacagagattaaaataacacaaagcaacattatacagaatttaaaccagacaaatccattacaacaaaagaaaagaaaaggaaaggcatttatgtaaaaaaaaaaaaaaaaaaaaatcctagttatacacattcatttaagagatctttcttgagctttcttttgaaaattgatactgttgggtattttgttccataattttggtccggcatcaataattgttgtgtaaatagtaacaaatgacaagcgccggaagaaaagtcaaaccgtcagcaacatcagcaagcaatccgtgcttttcacacccacaacaaatacatcggtttaattaccttcactgtggcatgacgtcagagtaccattccagtgaccatcaggttgacacaccctctcacttgaccccagcagctctagatgtgaccgacacctgagggtcatcaccgttcctacgggccaagaattcgtggcgccttgtccgtttctcggcgagaaagaaatctcgtcgttgtcaaggtgacgggaacccggatggggacacctggcgactacatcataatttaaagaaaacaagaagaagagttaattcttacacctcaataggactccatactgatcccaaacaaaacgatcgattggcaattaatgtattaatactattattttgttcgatcttttgttgatgatgtgccagtctcgtggatgtgactgaggttttactattaaaagaatagtggaggctcattcacagatcaaactaaaatataaggagtaatgtacgtaaaagaaattaattctcattatcaataagagtatcacaaacctttgcaggttggtacgttatcggaccatattccattgggtccaccgtgactctgacatacttgccagcttattccatcgacgagatacccttcgttacattcatattggaccatctgtggataaagatggaaaatactcattgaaattgaacttctttttattgcaacaacaacacaaaaaacaacaacatcgaagcacatataatgaaataatgaaggtatggacgcaaatatgtgggggaaaaaaaatcattttcaagtgatgtcgcaaatctgattaaccactcaataaaatgcgataaaacaaccgaatcattaatcaactaacttattaagaataaattcagattaaaaattatattcttgtgaacccaaaatcctgatgaactactcgataatccggttttaactagtcaatcaactgattaacaaattaatcaaccgattaattagtgaataaatatctaattaatgtgtcaagggattgtcaacgaatcaagggcgagatgcttattgacaaaactactgtttaaatcaagcatgtaaccctcaaagcattcccccaatgaatcgtacaaacctaatcaaacaattataataacatttattttaaaaaatcatcaatcagccaaaaaaagaattgacagtcagagtatcaagcgattaaccaactgaacatcaagtcagtgaacgcatcagataaatatataaatgtaatattaacgaatccacaatccattaagaaatgctcaagtattttgttgttgacattaataagtttgatttcttttgttccccaaataatgagagacacctaacgacttacttctccaacatggtaggtcctgttctcaatattgtgtgtaccattctctatgggctccaggatgggtggggcacagatgatccctgcaatattcaagttcaagtgcaattttatttccacttgaaaaacatttacaaatcattaacatatacatatgaattataaacgtaccaacatgcgactcattgattgagagttacaggtctatacatgtactgggtccgtaggaaagagagtggctcccgcaccaacccccttttttagaattaatatacatcatttaacgtttttgttttgccgttttgcctaattaatcaaacaacacattagaattggtgagtgatttttttttaaaacctctccttttgaaatgatttaaagcttatctgccatagtttacaggagggattagaccgccctgcaaggtcactggacaggtggttatctcatcaactcagctctcagttaacataagaaaaagaggatcatgggggaccaatggtcaccgattacgcatcgtttgttatatagagggcgcaagtagctacaagtagtgcagtgggcctttaaacatcaactcacacgatacctcacaggtggtatggtaatttattgccactgatttaaaccagtagggggggggggggttggctccattggttgattgattgattcttattcgacaagcttccaacctacaccaatatacaatactaacagatcaaaattaagtcagcttgaacaggagaaagattaaaaggatgaaaaataataatgaacccttatgcaagttacactttaccaacaaaagaagaaggagaagatgcatccctttattttacgtccgtaacaaattaaacatttgatatgattccaatctcatttcaatttgtcaaaaaggacggggatgcagaggtgcccctacggtgtatgaattcacccgacctatttttttcgacgcccctccatctgcccatccgctacccgcgttttgcaaaatacagagcccccccccccccaagacagatttcaatcaatttagttcaactcgttaatattatattatgtacaagaaaatgaacactgaaccttactgttgcattctgggacatccgcatccgcttcccaggtgccattctgacacgtgattgtgacgtccccggttggatggtatcctgtttggcaggtatagttgaacactgtgcgttcggtgtagagatcaccgcgtttgattccagagttttcatcaagaaccaaggctagcatcccggatggttcgtttgggttagggcatgatagaggtcctagaaatttcaagaacaaaatttagacgatatttttagaatattagtgaaataatgacgggcaaaatagcaagatgctttaatgatgacaaaataccctcgttttttttgcaaacagtgatataactacattcattttctctttaccaactgcccaatatttaaaatatttcatacagtattgagtttagaaaatattgcggaaacgaagggagcaaaaccccgaaaggaggagctcaattgggaacaccatatggacaattcaagtaaggcttacgttgaataaacattgttatatgaatatgttttgtacaagtcaaagcaaagaattcgagaatttagaaggagattcaattcacgaggaaaaagtataggagaaaattgacatgcacagaccaatgatgctatttaaacggatatcactggccatattgttaaaagcttattctctagagtatatgagttaggccagcgcatggtaacagagaaatttataaacttgagtcaaccccaaatgtgcagatttaatcaatttccaatcagagataatattgattatcgaaaaacagataacatttaaacgtttatatagttacgtttaatagaaacttactgaaacatcgaggtgcatctccctgccaactacccgtagtctcgttgcagaccaccgttctttgtccatggagctcgaaaccagggttacagcgatacacagcaatgcttcttgcagatttaccacgcatgcgcacatacccgttgacagggctctcgggaggacgaaaacatactagcggagctggaataacagagatattatatagaaattaaaattaaatttaaatgaacagctgcaacataaaaatcttatgtcacatggttttaaacgaccgtgtcttattaaaatcaaattgatatgaaacaattaaaacgtacgaatcgtatgttacatggttgtaagcttttgttatcaaaattaaattgatatgaaacaattaaagcatacaatattcttaatcaaatattgaaattcattcgtaagtaactttataccaaaattttgaaaagaacaagaaaaaccttaaaatattaatgactataaataacttacaggatagacgaaagaaaaaatggtttcccatcttattttatgccagaaacactaaactgacaaatgatcaacttgctaatttatttctccaataggggcctattgcttatatcctcacgtcactatgtgttactcgaacattccattcaggattgttgcagcaatttcatctttttttctcaaacaagagaagaagaaattgttgacatagtacgttatataaaaatgattaacagttgtggttttgaagaaattatctatcatatatcttctcttctttcatatatttttttaaattttctgtaaatacagggaatctcactaataaatttgaaattaggaaattattccagtacttaaaaaagatgaccgtcaatcattttcttactatcgaccaattccacaacttcctttgcgtttctaaaatacttgaaagaatcatttatagcggatttatttcccattaaataacatttatctgttaagtaactctcagtatggcttcagatgtaatcactctgacttgtgactctgctcgtattacatgacagatttactaataatattaatcacaaacttcactctgttggaatatctcttgatctttctaaagcgttggatttagttaaccatgaaatcattttgtccaaactcccagactttggaatacctgaaatttgtcttaattagtttaaagaatacctatgtgatcggttccaatacacttcatgtaacatatacaattctcctttaaactaaagtcaattctcattttgttatatttcaatgatttatgcactgtctcatcatttcttgatgttttgttatttttgcagaagatactacattgatgtatttacatagtaacttaaatcagttgatttattttgcaaatattttaactgtgtatagatatcagatttgttcacaatgcaatgcaataatagtaaactactcaaaatgcaatgtgtgatgttatcaagttagaaattaatgatattcaacttattacttctacttccacaatattcctttgcgttttactggataccgtactgaacattgtcaaagcagatctaagaatgtttatatattgttcaaactaagctacattctatctgaaaggcatttggttatgttgtgtgactcgttaattctcccatattatcgcaatatttgatgagttagttcatgaaattctaaacctgaacccattcataagttacaaaaaaaagaactttgaatttgtttctcatcttccttcctgtcttcatcaaatccaatttttaacaatctaaagacttttaatttagtaagacatacacgaatgtcaaattgctgtatttatgtttaagataaaagaaaatacagttccaaccaaaactgcaatttcttgttttgttaatgtgaatataagataaatatacataattatgatacttgatcgggttgcaaattacatttgaaaaaagcttattccaccaatttgttacaatccttcaggcgccaaggtcctcgaatttggaattaacttgagaaagtaattaaatctgctacaactttgaatacaatcaaagacaagtaaagataatatattcttgtcaaaagaataaagtttcgaagtcaattgatataaaatgatcatgccatttatgtacttccacttttctgtcgtttaaacttttgtctgaattccccacccctctctctcaaccgcgaaatcattcaagcaacgtcctggagcagggcaaattcagcgattggggctggtgtgatcaccacaccatagtttagtacgaaatcgtttggaacctgcaaccttgacaacttggccactatgacttcatacttaggtactatataggcgtaagcattgaaatcatccatagaataaacagtggggcaacaacacaacataaggaaacaatacttccgttttggctggtcaaacttcctgattttcccggattttaatttgagttttttttcccctcctaaattccttgacgttcactgactgaaaacaaaaaggagaactatttttccgagataattgtgaaccctgtgaaacaatcgaacccatgcatatatttcagggataaatgtatgttagaaataaatcttcagtttgtaactctacgacggttcgagggaaagatgtgggtattaaagataaactttagtactggaaataagattgcattgtgaaagaaaaggtgtggaaaggatcagaaacaaaataaattcaagaggaaagccctcagtagtgctccgtgctattgtacatgatcagctggaatttagaacaaatcttcatttcttagtatgtttatgatatgcctatacatttaaaggcacactgtcctacttgtacatgtagctacttgctccctctatatagaaaacttccccaatcggtgcctgttggtcccccatgatcctctttttcttatgttaaatgagagctgagttaatgagatagccacctgtcacagtgacctcgctggctctctgggtggtctaatcccttctagctgaagtagtaaagcctgcctttaaagctaactcagtaataatatcttggattaaattgaattaccgtggcaatatgggtagtcactccactttccgttgtcttgacagataatgaactcatctcctacaagcgttgcgttaggctcacactctgcgcgcacgatgtaattcacagggagatgcgtcaatccatagtctgtactgttctgatattcgtaacgtcctttccgtaaactcctcggtcgacgacagctagtaccctctgaaagaatgccaaatacaatgtttgattattggaaaagaagcatgcggacagtttaaataacataattaggaatgtgatattcgatccatgatttcccatattctacacaattatttttttggaataaagtaggcctactttcaatgaacatcaaacttgtcaaaagtggcgacatatcgccatcttaatattcacattctgatcggcgaagatgaatattgagccattatcattttataagaatagttttccgctcaaatccagccagtgtattgtcatatgtgccactgttaaacaaatcagttgtgcacttgctaccaggttatttgttgatgcccgttgtcaacctttttactctaagttcccctttttttcttttatttccccctttcttcgtctattattctctttctttgtggtgtattgttctaaggcgtatccaacacaagcctatgtttttaggatatataccgtctccctttcattaaaattatttgtcgtcttaagaatggttatgttaccatgcatgtagaaatgtattaggctacttgagtattactagttgatatgaaaaacagaaatggaagaaaataaatgttactttgaattgaatggaattgaattgatggttcagtggtagagcagtggtctcgtaaccggaaggtctctggttcgaaactaataagtcgatgcgctatagtgccctttggttaggcattaatcctcattaccaagtcccttggagaggactcaaggccgtcaatcccctggccacttacttacaagcatacacactgttttagcagtcaggtaaaacacacaatactaataaacactgttcgaccataattatgtaacttgcagccttttcacacacagctaaaattcaataaacatgattagtataaacgtgtttgaaacgtgtttaaactaatcatgagcctttcacacacagaaatttcgttgcgatcgttaatcgtttcgtgattaactactgctcgtaaaatgcgcagtagtgccattgcgcattgaaggtcaggtcatatcaaacagagcggtcgcttcatccagtttaaacacgtttaaacacgaaaaacctttcacacacaaaatgtcaagctctttagatacgaacttcgtatcggcagcctgcttttaggggcgtatgcatcgcgacttcgtatctatcccaacatcgtataaacgatgttcacactgggaaaatttttctataaacatgtctaaaactgttgagtgattctaatcatctctggaaacgatgaattttagctgtgtgtgaaaaggctcactgtctcacccaactatgcctcgccgtcaaattaaacaaacagctaggacttttagaattgcacaacgacatcgtggattgctacggtcgacgtccttttaatgcattgccttgaattggacgtcacacgtttcagtccacgcaaatctaaaagtccctaatatcccaatcacaccgacgggaacaagcacccgaccgactatagcccgaaccaccccgaataacaaagaatcattcgggttggagtcgggttgtagtcggtttggagtcggttttggaggtttgtggctgggttctaattaataactctcacctgcagaggagcagaggattcccaagatggcggctacgatgatcgccaagaacttcatgtcaccaatcagcggatctccttctcagctaaacaaactccagctgtacaatacacgaaatcaacaaatgaaatttagaacgaaatcaatcgcatacaaatctggcaatgaaaacggggatgatgcactagttcgggtgggtgaacatggagtgggcaagttggcttccaaagccgggctgaaagatcaaatttgaaagctggtaaaagcttcttccgagaaattaaggtcaggaagtttaattgatgttcaaagaaagaccttttatatccatgatgaaatatgacggtgggaaattagaaaaacatttggtatattttgtccttgagttgcgaatacgaatgcgatcgttgcagtacgtgacgatatcgcttagtttaatggctatagtcattccggtgatagatttggataaaattattctcaaatcatagactgatgggtaaacaaaaagaaggaagaagaccaaaaaagagaaatgagataaatgtatcccgtttgttagccaaatccctcaaatgcaacgcatgtttagatataattgaatagatattatacaacatgtacaaagtcactttttctccagattttatattctcagtttatcatcaccaggttcatgagtggttataccaatcattatggacactaccatgtcgtttgtaaaagtaataatagtctaataataataagttggtttcatttacccagagtagccacatcagtattgatgccgctttttcctggatgtcctgtggcccatgccattagtattacccccacattaaagggtaaaaaataacataaaatatatgatataatgtacatcaaaaagtctaaagatatgtgatgtatacagtattacagatcaacaaaattcaacatgaatttgtaatttagtgaccctttaattgtcaggtgcccatttacacctgtatggagtagccaagaacgtgggccaaaacaccttgtctaggatgtaagcaccgaacaaggatcgaacgacggacctctcgtgtgagagtaaagagccttcaccgatatgacgtagaacttgaaacctcccctatacccccccccccagggcaatgttattccgtatcctcaaataatagctacaatctgttaaaagctataatacctataacagaatttaaacggaaagcggggtcaagccaagagcagagatcaataacatcctgagtatcctggtttctttcctgttaaactcgtaaacgtgcagattgatcttttaaactttcacgaatgcacaaacaatataagggaatttcccgaatgttttggaaaagtttcatatgcggggtttcttccgttgacctctgcatgttcgtgatatgaagacaaaaacgaggcggttcaagggatttaaaatgggggatggtaacattccgaataacaccttatgatcttctcatttcagcttctgataacgaatgtatggccctccctcatcctgaatgttctgatccagctgaaacttgacctagaccgagcaattttcatgagtttttaaagaagtagttgagatctgttactgcaatttctaagagaacgaaaccgtctcggagcaatggcgaaaggttgattatgtgtactgttaagttttggaatcatgacaagaaattgactccgccgcctcgctgaaaaacacgtgcgccaagaactgaaatgagtgtatgggactactcaaagatatggcaaaatagtttggtgtaaacatttaaatcagcagtttctcgtcatgttttgagcacaatccctctaattgttcccctcccccttttctcctttttcccgacagcaacgcaattgtaccgacaatatcctgacaggtaagggggggggggggggtggtcgcattcccactacccaactttcagcgacgccccttgttgttatcccattattcttttaacagaaatgcaattcctcatgctctcgcacctctcttctatcgttgtttaattctctttaattttttcctttctctctttcccccattttccatgtcctttttgttgttgttgttgtttttgtttttgttttgttttgtttgtttgtttgttttgttttgttttgttttgttttgtttttttttttttggggggggggggggggctatacgcctggcaagaaggaccctctattatgcacactgcaaaagtgcgtggctcccgcccccttctcggtaaaaaaacaccttcttataatatcattcccctttctttttcccccttctcattattctcctcttcccccttttctgttctccgtctcttcccctttcttcctattccgcttgtctcccctctctccctcttcccctttcttcctttacccctcccttttcacctcttcccttttctctcctccctcttttcttcttttttctctcttcccttttctttctttttcccctccttttttctatccccctcctttttctccttttctccctttttcttttttcccttccccttccccctttttaccgggggggggggggca

SEQ ID NO: 49193 - DNA, 15055 bp, Oryza sativa
  unsure (1)..(15055): unsure at all n locations
ggggggggggggcacgtgcccccccttgaatccgccactggtatagttgtgttatgtaaagttgtatgatagtggcatgcctggcccgccatatttaccttgaccaccttttgcccccccccccccccccccaactcagtgttaaaggggaagtccaccctgaaattaagttagttttaataggagtagaaaaatgagagaaacaagtcagtgaaaatttgagcaaattccgattaaaaataaggaagttaggattttttaagttgtgatcaatcaaacacaaattggcaactctatgacgtatcatgcgagcaacttccatttgctcagtactaaaaaaatctaaaattttcattttccctcaagaaaaatttcaaccatacatgcaccctaaatataataattgcaaatatgtttctatactccccctgcaaggaacaaatatatattccgtcatcaataacgaagaaaacatgattttatggaatattatgcacaaagcaaatgaaggagagctcgtataataagtcacagagttgccaatttgtatttgattgatcacaacttcaataattcataactttcttattttcattcagaatttgctcaaactttcactcacctgattttcatattattctgcctctatcgaaacaaacttattttgggggtggactttccctttaattagggtacgcatatgcgtgttcccagcaccccaccccgcccttttcagcataagtccggtgtgtaaagtcaatatacgaggagacctttttcttttgttatacgagcctttcagcaccccccttctgcataagtccggtgtttaaagtcaatacgggtaaacctttacgaaccggagattttgagaacacacatgcggtccctccgtttccggggtgagggggggggggtgggcgggaaccatctctttaagataaagacaactcctggtcatacgattgcattgtgaaagaaacgttgtggaatcggtcagaaaaggttgatcatctagcttataaatattgatgtgtactgcaaggttctggaatcatcaaaatgataagaaatttggcccagtcttggtaaagttacaagcactatacacaaaaagatgtatatgggactacgcgacacgtgcgcgatatctatccggtccagatagatataataatttaccaaatatagcaattagtataggcggtttcccggcaaaatgtgtatcatcacatattagtcaaaacatattctttcacatgattgagattccattatcatattttgagaggggggcgtttccaaaactggtctttactttaacgcgacctttaccctagggtaacttttctctgtctgaacaagactagtattgaactgtaggacctctcgtataatagtcaagtgccctcaccataatataccacggtactgaatactgtctgagttaagtttttcattacagtgttctctggatcgctctaagtatgtaacaattaaacgagtgtacaattaagacatttcaagtggcttattttttcctgaattaatagcggaaacatctggaattttcacgcggaaatccgtgtaactaacacccactgaggaaaatgttgagaaaaaaaatagaaatcactttccagtgtaattgtggttgaaatgaaatatccttagacgggctttgttttgaactaagaagtaataagtttaaaatggagttaattggttgcaatgaatgataacctgagcgcctgtgtgattcctccgagttcaaaatcctgcaacaaacatccggctctttgaaagtgaaaaatccctacttttcacctgaaatcgtttgaagatatcggagatcacctgaacagcaatgtggctgctaaaagagtgtaatgattcaccccgtcctcatttggtgaagggtcatgacacatcggcattgcaaacaattgcaaaaaggttggtcgactggactttgtttctgatctcatccgatttccataaaatcatgaactaaaaataaacgtttattgatcttcggttaaaagtccattaatcaacaatttttcaagaccattattaggtgcggctattggagatgagttctggtcattcgattacattgtgatagagaaggtgtggaaaggaacagacacaatgaatatgacggacaaagaaagaggacaaaatgtacagttcctcaggtagacaaaggaacatcccttcactggtattatgtaaaaatgtgtagaacaggtgtcacatgcagatcacctgttctacacattgtattggtttgtactgcaaagttatggagtcatcaaatcataataaatttggcccagtcttggtaaagtaataaatactgtagacagaaagatgtttatgggactacacaaatggtgtcggggctactaaccttgatttcctaatctttcaatgctattactcagccagtatacattttctacaaaaattgttcggcaaattacatttatttgtaatcttaaaaattcagtgtaagtttcgtttgattctgtgagaattcattttctcctttttgaccagaactcacctttatctttaaaactgaagatttcactatagttgagtaggaagatgtttctatatacccccactatagttacgacatgaatcgcccactctctaccaaagtttaaaaaaacaaagaaccaatctctacttcttggaattgttccaagtaaaggagaaaaatacgaaaaggagaaaatgttgttctttcacatttgttgagaatacctcgctgcacctcaagctacaggagggtaggggcacgtacccacacaaaaagagagaaagaattaaagaaaagtatgtgaaacttgtaaagaaaattatatgatccactcccagaccccaaattaactcttatgtcacgttctcttgtattttacacacatagttagaccaatgtccccccacatcattgggcacgtgcctcatatatgaatggcaaagccccccccccccaattgcattgtaaaagaaaaggtgtggaaaggaacggaactttttgatcatgtagcatgtaagtattggtgtgtactgcaaagttatagagtcaacaaaatcataataaatttggcccagtcttggtaaagtaacaaatactgtacacagaaagatgtatatgggactacacaaatggtgttggggctacttaccttgatttcctaatctttcaatgctattactcagccagtatacattttctacaaaaattgttcggcaaatgacatttatttataatcttaaacattcagtgtaagtttcgtttaattctgtgagaattcattttctcctttttttaccagaactcacctttatctttaaaactaaagatttcactatagttgagtagggagatgtttctatataccccccgttatagttacgacatgaatcgcccactctctaccaaggtttaaaaaaacaaagaaccaatctctacttcttggaattgttccaagtaaaggagaaaaatacgaaaaggaggaaatgttgttatttcacatttgttgagataacctcgctgcacctcaagctacaagtgggtaggggcacgtacccaccaaaaaaagagagaaagaattaaagaaaagtatgtgaaacttgtaaagatatgatccactcccagaccccacatttactctaatgtcacgttctcttgtattttacacacatacttagaccaatgtcccccccaccccccccccaaaaaaaaaagataggcagagagagcgaaaataactcccactcccaaacctttcttttgcatgttttcttgcatttcatacacacgattggtgccccctttaatgactaaacccaggctgcaccactgccgcgacggcctaaagaatagatttagcgatttattgttcactttcacctcacgggctgctgaagcaagacgtgtttttgttccgctgtctggtctaccattcgcttcctggagtaagaaattatttctcttctagtttgattgttggtgccttttttcttcatacttttattattttggtatttgtttgtttggggtgttttttttttcttggacagttattatgcatttgtttttgtcgcttgaaccgaataacactagtacaaaaaaaaaactgtatattaatagcgctcctccagttaaaactagctgataaaagcgcttcatagtgttatatcgaattttttgttttaacattccagaattaaattcaagcttctctaaagtcatgggcgccccaaaaaattgatagcagaatttcacttaaattgcatcacaatgtgaaagaggatgtcatttaagacacatttctgcaatgtgtttgaagtagaatattgagaaaagcatacaaaatgttagttttctgcgtacaacagaaaacccaaagtacgtattctgttatcaatattatttttttttggtgggggaaagaggaaatctttgcagaatcctgtcttatatgccattccctttcacattatgatacaatttaagtgaaattttacaatcaaatttttggagaatttgggtctcccagctttagaggagctttaaacggtctatttatgatacatgtatgaaagtagcatacacatgcacatgtacccgtctgacattcagaatgttgaaacttctatttgattcttagttttaatggtatttactactgaaaccaattctgtgttcaaattgtatctaaaacttgattttcagacagaaataggtcaacattttccctaccctgggaggggcgggggggggggcacttgagcaggcgctccttcaccacctctgattattgccgtctttactttgactcttgctcctttcttttttgagcgtccctttctcttttgataagtgcccctttttcctctatcaatatgtgcccctaatttaaagcgactaagagcaactttttcttgttatgctatgctcgctcgcatttataattgatataatcatgctcttaaccatttgacttttcgtctttataagatttaattttccgcactgcgacatcaaaaatcttatatatattcaaaccatcacaccaaactattgaatcatcatccgtgataatgtgatcaccaatgtctcaaaagtgtaattttcgcgtcgaggcttcccttccaaggtgtatttttctctctctccagaaagtgccctttttgatgatgccccctccactttgaaagacgctccgccaaccctggaggagaccccctccgaaactctctccttacatggctcaaaacaccctcgacagagtcctctttaaataatatctttctttcaaaatgtatccatttaaaaaaaatcaaattcgtcagttttgttagcaagtatactaacctgcctctcatttatgttactattcctgatatattgctttattgtctggaaggacggtatgaatgtttggattcgagaaaaatgtaattgttgtttaatcaaaattattatacggtttaaagcatcgttacgtttctcaaggaaaccaaataaaacatgtatttattttattctacagtgtgttacgatgtttaaccagtcagtcaaacgactccaaatcaatttggtcacgtaacagaagtaaaagagtgcaccatatcttcttcttatcttccacgaagggaacagtttctatttagaattattttaattttcacaagatccttattcaaataaattatcctatttaaaagtctgtactgaaagtaccgaaccgttgtatgcattgtacagcgaaacatcaccctgaaataatattgcatatatttattatcaaataatataccatctgcatgccatctattacataatatattcaaattatcgtccctttcttttaacaggatttggtatacagtgcgtccaagaaaaaacgtaaccaagaattatcgatgttttatcatagcttaatcacaattataattaataaatgacacatatatgttaagcttagatcctcctctttcatttgatgcaactcatacgatgcatattgcacgcctgagtgattaaaatcaatttaaagagagggaactaaaaagtcatttggcggaatgtatctgaatttcaaagacaaaaatcacatttctagaaagttcagtttctgcccttccataagacacctcaatcagaaaaagatctctttgtttaaagttatgcttgcatttccaaagatagtagagttataattttcaaattttgaaaatgtgaacattttccacaaacatatgctgcgttcaaactcttcattaaatatatgatatcaataggaaccttgtcagaattacgaagagatatagaaattaataaccgaaaagagctcgttgcccaagctcgtgaccacttgatggttctgtggtggaacgcagggttagtaactatcacatacatgcatttctgagtttcattggttgttctcatgtatctctgcagcttgctcggctagaatcacttcagtttgtctgagaaggcgatccacgaagtgttgaaatgaagttttcggcgatcatcgttgccgccattataggattcatctgttcctgtgcaggtaacaaaaagtacaatttatttgtagttatcgtccggattaaacaaaaattataacgaagaggggattttcttctcttttttttttaaatatgataattccaattatgcaaaactctttctaaggatactagttgttttcgaccatggtgtttacggaaatggcatatcagaacaaaacagactatggattgacgcagttttgcgtcaggcaaatgactcctcgtgttcaatacgcatttgagaatactgtttttcactatttttccatgggcctcggtcccctggacccacctaacgtaaaatatgtgttttcaagcatgtttcttttccaattatttcacatttttcagagggtactagctgtcgtcgaccaaggagtttgcggaaaggacgttacgaatatcagaacagtgcagactatggattgacgcatctccctgtgaattacatcgtgcgcgcagtgtgtgagcctgacgcaacgcttgtaggagatgaattcattatctgccaggacaatggacaatggagcgattacccatattgccatggtaagtgaaaggtggttctaccttttttttctttttcaaaagcttgactaagtgttttttttttaataagtgacttcacgacagcgtttgtccattgttaagtcagttagttgcaattaagacactgttctggtggtaaacatcttatgccaatccattacagacagaccgtaaatgatgtattacattttttcaaaactgaaacacatgaagcacatgaaataaaggtgttgtggtataatggatgagtcaccggactgcagatcacaaggttcgaggcttgatttcttgccgcgccattaacttggcaatacatgaatctacgtttaccacactcgaattaactcgacccgtgtgtagttagtgagtgcatataggattaatcccatgattgcaatgagcgctgtactattgccggagctcgagccgtggtaataatatccaaggtcctctagaagcgggtagaaacattataatgatatcatatgcgctacacaagaagtaaatattacaattatcgcaagatttgcatgctcacatgttaataccaatgaattgcactttcataatttgattcactttctatctcttcatattatattttgtaatcttttcttaacaaatgttttgctaatactatcgtctttttgtcttccagctccgctagtatgttttcgtcttcctgagagccctgccaacgggtatgtgcgcatgcgtggtaaatctgcaagaagcattgctgtgtatcgctgtaaccctggtttcgagctccatggacaaagaacggtggtctgcaatgaggctacgggtagttggcagggagatgtacctcgatgtttcagtaagttactaatagacgtaactaaaaagtttaaatgttatctgtttttcgatagtcaatattatctcggattagaaattgcttaaatttgcatatttgaggatgactcaaatctattaattcttctgttactaccatgcgctgtcctaactcataatctctagagaataagcatgtaacaaaatgagctgtaatatccgttagcataattggtctcagtgcatgtcaaattttctcctttacatttttctcgtgcttgagtcttcttctaatctctttaattcgttactttgacttatacaagacatattcatataacaaagtttttttaatggaagcctcacttaaattcttcatggcgtttccaataaatattgagctctccttttggggatttgcttcctgaaattctgcaatatttgctgtactcaatactgtattaaacatttaaaatattgggcagttggtaagaagagttaaagcatcttgctattttgtcccatcgctatttcgctcatcattttcagttataaatatcgtccaaattttgtccttgacatttccaggacctccatcatgccctgacccaaacgaaccatccgggatgctagccttggttcttgatgaaaactctggaatcaaacacgatgatctctacaccgaacgcacagtgttcaactatacctgccaaacaggataccacccaaccggggacgtcacaatcacgtgtcagaatggctcatgggaagcggatgcggatgttccggaatgcaacagtaaggttcaaggttcattttcttgtacataataatgttataagttaaacacaatagatcatttttattttgggggtatttttttgtaggggggaggctttgtattttgcagaatacaggagaagatggacagatgaaggagcgtcggaaactttggggaattcatatacagatgcacttctgcatccctaccctttgaaaaattgaaatgagattggaatcgtttaattggacttttgttttggctcccttggtaaattttaactttattgaggattcattcgattatgttgctttcatcttgtcaatttttacaaattgtatggcgtttgaacccccccccccctcacctttaaagtcagtggcgatcgttaatctcctatcgcacctccgatgaattattttgaaagttgtttaaagcattttaggagagcttttaaatgtttaatcttatttttacaaatagtaatgtcaaaacgcaattcatcacgcaaaaccgtaaaacatacaagtgtaacagtgtaaatcattaaataagttcacatataatgtaaatagtttttcattacttactacaataatatcttaaatgtttaatattttaggcgttatgttcattttgatctagtttttaatttgttttagtttttaatttgttttttcttcatttgatataaatttctcaatctcttatggtatgttgtttatataatgtctttgttttctattctatttttttgtaaatctttgtatgtacatggctcttttgtaaagcaggcctttggcgctgaaaaaaattaccatgtttttaaataaaactgaataaataaataaataactgggtgtggattaggacctttagacctttaggttcttaaaattacctcaaagatgaaggctctatctttatacgttagtccatttggggaaaattgggaggggtcgcaacctctcccatggaaacggtgcgtgtataatcctgtaattgcacggtcattcgatgagctgcatgttggtacatctttattcttacaatgcagagatcatctgtgccccacccaccctggaacccatagagaatggtacacacaacattgagaacaggacatacaatgttggagaagtaagtcctaaagttgtttttcattatttgggtaacaaaaacaaaaacaaaaacttatcaataaaaatccaagatcattagctaatggatagtggattcgttactcccacaatcatttattatctaacatgttgacgcataatgatgatgatgatactaaacaaagtaaataatagaattaatagtagtaacaacagagggaatagtatgattttagggccccagggataacagtattaatactcatgaggcttccctgagttatcattgttatcattactagtatttataatatcactagtattatcattataatttcacggacttgctatttagtttactgattgcaattacactctgactgtcaatttattattgctgattaatgattcattatttaatattatttttcaataacgtaatcataatgtattacatcagaagagataatatcttaagaattcactgattgattaagacagtagttttttcgacaatctgctcgccattgatctgtttagatagttatttactaattgattgtttgactaatttgctaataagttgactgactggttaaacttagattatcgagtagctaatcaagttagtggttaatgagtccatagatttgttaatcagttaagtaatttcttgataagttaattgattaatgagtcggttgttttattgcagtttattgattggtaaatcagatgtgcaacatcactcgcaaatgttttcttccttacatacgcgcattagtacccctatttttgatttcatttgcttcgatgttttttacttcaagaagttcatatttcaatgggtattctccatcttcgtccacagatggtgcaatatgaatgtaacgaagggtatctcgtcgatggaataagctggcaagtatgtcagagtcacggtggacccaatggaatatggtccgataacgtaccaagctgcaaaggtttgtggaactctcattgatgaaaagaattaagtccgagaaggatataagtcatttacatgtattcataaataaggctgtgttctttttgcctttttctgcctattcgaaaattctccatattcctttttgtaaaaacttttgttcagtaccgagtagtcctttgttttcgtttttcattgctttcgtgtactgaacatgaagtgaatattatctaaattgttttaaatatacatgattgagcagcgtccgagtaaaaagcctctgcgttgtagcatgtgggacccaactgaagactgcaccacacgaatgtctggtagaacagcttatcttaatgcagatgggttggtgattttgacaacgggtccaggttttaacaaatgcttaggtttgtgtatccattgtgtaaattcatccatggtcgaaatagaatatccctgttgtcactatgctatattaaactattcgatctacaaaagaagaaataatcgagtatcagctgtaataataaaatataaaacgtccgatgcttttttcgtatctttagtcgcaaggtgtccccatccgggttcccgtcaccttgacaacggcgagatttctttctcgccgagaaacggacaaggcgccacgaattcttggcccgtaggagcggtgatgaccctcaggtgtcggtcacatctagagctgcttgggtcaagtgagagggtgtgtcaacccgatggtcactggaatggtactctgacgtcatgccacaatgaaggttattataccgatgttgttgtgggtgtaaaaaacacggacggtttgctgatgtgttgttgttgaggatctagcttttttttaaaatccactcctcgtaaaatttacacaattttctcattttatgcacgccatagacatctacattcattcaaagagacttgtggagaacctctcaaatcaattcattgctttatatgggatcaaatattccagtttagggggcaacgaggggtcttagaaaataattgaaccattggtaagtgtgctggcgagcgacaagaagtcagcggcaatgttacacaatcgtgcaaaaggtagaaatatctaatttgtggtgtaaaaaatgtgaatgaagtgaaaactatttcgtttacatgttagctgggctaaacattattctcatttctaggtttgggctgattaagtggtaatagatcttaggtgttctcataaannnnnnnnnnnnnnnaaanngnnnnnnnnnnnnnnnnngtcgcatcttcaggacagtgaagtcacaggacgggccaagacgaaaaaagttctcatcgactaattgtcattagtaaacgtttgaatgcgcacacacgcacacgcacacgcacacacatacacgcatactcgcacacatccactagcacaccggcgcatccgtcaacatggctgtaaatatacatgtataaatgacgcggcattctctatcagagacgatatttgttaggtttataaaataactgattccttgtacaacatattcttctattgtcccgtatgttttgaaggggacgtgtgtgtgcgcgtgtgtgcgtgcgtgtgtgtatgtgtgcgcgcgtgtgcgttggtgtgtgtgtgtgtgcgcgtgggtgagtgcgtgtgtgtatgtgtgcgcgcgtgtgcgttggtgtgtgtgcgtgcgcgtgtgtgtgcgtgtgtttgtacatagtcgcggagttacatgtggtgtacctgtattgtgaaccacgccgttttccggtacaccactttcatgttgttattttcaccatagagtacgactgtccagccttggggaaccccatacacggctctaaagtcggctctccgcagtacagagtaaacaccaaggtcaattttcgatgcaaccatggttatgagatggtgggttccgaagagaggatgtgtacgttttctgaagagtggactggggagatgccaagatgcatgggtaagattaacattttactttttttcccgtgaaggtaggtgtacccacgtagattatgtcgaaatgcgcaagtgttcacgcatcgtaaaataaatattattaacataccagggggggggggtgtttcataaagagttagtaaagttacgcatgactttacgaacgacttgtatatgaagtgccagataggatgcccaaagttttttctgatatttccaataacctcaattaaattatggcaaaaatatactttgcattaaaaatgtttgttataataagaatgttaatctacatctgcacagttcaacttaatgaataataatcaagaatgattgagcatcacatttagcttttcatatacaagtcgttcgtaaagtcatgcgtaactttacgaacagctttatgaaacacccccctggtacactattttacacatcccccacaccccccccccccgtaagaaaaagaaacaaaaaattgggaaaatgaaatttgtattattatgattcatattaccgactaaaagtgtttccattttattatgacattaaattcactgttaaaatctcacgactatactctgtacaatctctcggaaggaaaatgtaggtttctaatttcaaatttctctgtctgtcatttgacacatcatacttcaacttgaaatttctgctgatcttaggggcgcactgggtgggttcttagatgatgtacaatcattattacccatattcggatgatcttgtagcagaaatctcctctgttcaaatttaaggtcgtgatgagttcgacgaactttctcgagtgatgaatgggctagggaagaccttcgacgaaatcgtcatcgacggcggctcttgggtgggtcgaaatgacaccagctcgaactcaggtttgcgaaggaaacgtacaattaaactctctgatggtatggatatctactttgcgtttgatgcgtcgaatagtgttggacttgaaaacttcgagataggcaagacatttgccaagcaactagtgggaaaggtaagagaagtataaagcagaaataagaaagtaaatgtccatgttcaagaggaaaagagttgatagagttttacaaatctttattgatgatgtctttctaataataactattagaatatagatattacctatagaatttagttaaaaattatcgaggataaacaagtcacacactattaaggggcagtggcggatccaggatttgccaatagggggggggggggctgaagtttgaaatcgcaacgaccaatatttcgctcagtggggggggggggtagtgtgagcactaactacaacaaattaccgtcagaaaaacatttttctttttttcccctttttttttcctttgataaaaaaaaagtcgtcggcacccttccccccccccccgtggatccgcgcctgctgaagggaaaaaatgttatttgctaattttacatatttctatgccagtgttatgtattctaaatcaattggtgaatttttattgttccgagtaaacgaaggcatagtaggggcaaaattcccaatattccttttttcaaaagtaattattctggatttatagcacttaaacctaattacccgttcatttttactattactatatgcatatgcctaggattcgatcataattatatggcgatgtattccgccacataattgtttaaagtttaaataaacgatgactgcgtgcaacaaagttcgtgcacgtattcacttagctctgtatgtgttataagaaaacggacatgaagcgtaatacactttacgtcatctctaaaattataaaaaaacgcaacgattttgcagtgtcatatctgaacggccctttagaaacctacgtttatatagacacacaaacattaaaaccattcaactattccaagcagtggcgtacgcaggattttttcaaggggggggggggggtttaaaatcgagtccaaaatttcgcaacgactcaggaaaatttgaaaatcgcgccggccaaaaagtcgctcagtggggggtacgaggacactttttttttttttttttggtctcgaaatttgaaaatttgacattttgctctgttggggggggggggggtaaggtcagattttttaggtcaaccatgggaaatattattattatatatttttttttttaaatgcacaaaaaaaaaggaaaaaaaaaatccaaggggggggggggggggggggggggg

SEQ ID NO: 49194 - DNA, 2365 bp, Oryza sativa
tttaacccccaaaacgcccccccccccctgtgtacgcgcctgattccaaggcttctgaagacaagtgggtttaaacagagctttgaagatatcgacaggttagttcatgccaattgaggccgtttttttaaagtttttaaatgttaatgtttttaagatatgggttgataaaataatctgattgtgtatctgaatatacatatattttgttgcagcttcaagtgaatacctcgcctggtggaacgcgtgtcggggcagtctcctactcgtctgaagcacgcagattgttcaacgtcaacgattttacgtctacagttgatgtagttaaggccatcgaggcgaatgtcaattacacaagtaaatctaagcgacgttcagacaagaggcgacaaactgcctcaaaaacccgctaccgggcaagaatggcaagagcgggcgcgattctagcagaatattggggctggggtggggaagctgaatggggggtgggggggggggggagggggacttttgacttcttgcattaaggttttgaattcaagggcgatgtgagctggtctagcagcactttcacttgttcagctatatgtcttcgcctacaaactggctcaggcgcgatcccggttcgaaactgagtcaagttattcggacggtgacgttaaaggtcggtccccttacgtaaaagatcacatctgattgataatacacacatacacaattctatatgtgcatcgcttaaattcattaatatggtttgtttttgttaggagagtagggggggttcagcctacaatgcagggtgaaaatgacacgtagctgtgtctaataatcctcctatactataaccttcctctattatctctgtgttatactatgaacaagtattaaattgatatatcatgtcataaaccgccaatctggaaactgtacatctaatttgtcaaaactgcgggctaatattcgcaattgaccactatacgtcaccaataacgcttaatagcggaaatatcgctagggcaattattgttctaaaacataaggattgcctggaacaggatatgtgctataaaacaaacacacaagaaattctttgatcatcaatattcttgcattaaatagataccatttaaaataggggatgcggtttacttttactcaaattctgtgtcagggcttaatatggacactgtatactatacaagctaaactccgggcaaagattttacccatgcccccaaagcagtgactatttgtgcattatttcatttattcattttcattttttgctgtggcagttctttgaagcggttgactgcctcttgtctgaatgcatctaaagacaataatagtggttgtattgtataaccaaggaccatttagacagctacttccaatatccgtggaagtccaataaccatttcagattaaccgtaaagaagataccggaaaacacttaaactcagaaggatgggggggggggtcggttcgttaaacaattatcctttttgatgttcgccattaaaaaatatattggcgattattgtgcattgttgattagtcaagtaaatattgtcgctttaaaaaatacctcgattggattggattgtataatcaaatgtgtctcgaaacattttaaacaccatcctcgcaaagatatgtaatagaatagaatactggatgtctaaagaagttaaatataatttttcttagggatatttaatgcattcctttataaacttcagaggcatgctgcaaaggactgatcggagaagaggttttttcgatatttatatcagaagtatctttgcgagacttttgagagttggaaatcgtcagtagacctgcgctaaaatgtatactcgatacccgatcctactttcaatatgcctctcgaatataatttacaaataaacatgaccacaaaatatcaattatttctttttgcttacaaatagagacaaaaacaatctattaatgacttcaaaatcaaactgattcaatattgacataaaaaatgaattattaattgaaaaaagaaaaaaagaaagaataaaatatgaattaatgaatctttggctttcttgtgacagataaaggaacaaatttgcccgctgctctcgagacaatcggggtaatgattaccgaaacagcggatgaatctgggtacagcagcaggaaacgcattctatttatcataacagacggtaagctcagcttattagtgtttgttaaggtaaaaattattcattacttttcatacattcgttgtttgtgtaaaaacaccatagtgggcataggcttaggaaccggaggcttgggtgaagagggggagcccccttgtattttctggtgggagggggggggg

SEQ ID NO: 49195 - DNA, 3903 bp, Oryza sativa
caataattaataaatagaagagaagagaagatttggcttcaatcggcctgcgaccgagacccccccctaatcctcaacaaatattcgttagcctataatattacattcaagatattgctcttgaaatacatcatctaaattggacgagagatagttaaaaactttgaactaaatttcggcgccccatgactgctgtacgtgtgtagtcccgtgtacccgaatatgtgtgcattatgtattcactgttttgactctcagcaagataagttgaattacattcattttaattctaaagttacaatgcacatctttttaaccattccttatccttccctatcatcttgttattaatatcgccattgtcatttgccctccatttaatctagaacttttccgaaggttaggtgtttaaggaatacaattaagttcgtaattataaaagccgaaaatgaaataggttcaacatagtatttttcagtacagaaaaattgtaatttgaaaataatgtagtttctatttccttttcgctatcatgaatcttctgaaaaaatgggagggggcaagaatttcttgtaataatgttattatgtattgtaatgtttatacttatcaagataacaaatgaatatgtacatacattttgttatactacctgtaataatatatataaaacattgtttatcttacttttggaaatgaaataaatacgaattgaatcggattgaataattattaattctaattcaccaaattcacggctgttgttatctttcaggtttcagtaacgtcggtggtgccccatcgaaaagcgctcaaccactaaaggaagatgcggccctcaagatacactgcataggaattagcaggaacacggacaagacagcacttgccgaaatcgcctctccgcctgtcagcgaacatgtattttatctctcggattataatgagctggaacgcgccgtggaagccattacctctacaaacagatgtgagtaatgcaaaaaaaaacatttggtccttcaatttccatgaagaaaaaaaaaggtactaacaacacacaaagaatttatttaaaaaaaaaaaaaaaatttggtcaataattgaagtagccttgatataaccttttgaaatcatcactataatgtactatgttagccaaacgtggtttctaaaattgccctgtgttgatttcttggaagtctttatgatcttttctgcgtgaagattaatgggtatgcctatgtaaaacaagaagcagaagaaggtcttgtgttttcaaagtgccttccaagtttttaaaaataagctgacttatattttaagtgtcatattgccttttaatttacctattctattcacagttctacctctcacttaacttgatgagtagcattgacaaaactttgttatgcttttattatcaggtatacacgtcgttgttgtcgttgttgttttactatgtttctgtttttatttgtaatttgttctctttaactgagtaggcctatagattcggattcggattctatcacctcgcgactccatgggcatgcttttctagacagaaactttagaggcccctttaaaaaaaaatcgggtccattgaccccctccccttcccagccccaggacttacatctgcccaaaactctcaacaaaataaacatttaaatttcgcatgtggtgaattcctggaaaataaaaaaaagggaaaataaacaaaccttaaatctatttttattgttttcttcaggtattttcttattcaattattcattcgtttatttattcatttgtttattcatgtcatttgtttacttattcgtttattatatgtttatttattctttcatacggtcattcattcattaatttatttatttattcagtcattcatttatccgcccattcatttattcattcattcatttcttataacttttaattttttcgattgtttttgtttggggaggggggttaaaatcaaggacatgtgcgattaaaacctgtacgcgtacctgtggtcatgtggatgttttgcattaactgtaaagtaacctattattgaaagtaaaaaccggtagttttggttataagaggactttcatgtacttggcggtcaaaattataataggaataacattaggaaagatagaagaaaagaataggttaaagaatattaaaaagaaagaataacacaagggaagcgacagaaaggatacaagaatcaaaataaagaaatacatagggaattatccaagaaaacatgaacggagggagaaaaagagctgtaggcccactgaaacagtcacagaagaaagaaaaaggataacaacacaatatgagctttgagtgtgttgcatcgcttttagtgatgggcctaggtgtaagctatagtaacacctaaaaatctcaaattttcaacaaaataaattaatagatacagtatataagtagcaccaaactgtgccaaagtaggggaaaattaacacacatgttaatggaagtaggaatttattccttgaaatgctagagcgccgtatggcagccgtgctaaagccagggtaataatcgggagcgccaggagggtcaaatctgactgacatgagcgctatacaagaacccactattattattattattattaagtgatttaaatcaccgattaaaacaaaaaatcgggtaatttaaatctcgccaatcacgattcattcatttctcgaattattcataaagtggtttccttatttcttagcttacgaggaatgtggaaagtcaaaacatccgtcggggacgtctcgcattgttggtggtagtgaatcccattcgggggattggccgtggcaggcagccctttacgatgaagactcaaatcaagtaagaatgcctatgtctcatatgagaccatttgacaaacatttccaacgatagcactaaatattaataacaataacaatatttataaagcgtaacataaatgcttaaggggcatacaaataattaaagtttatatcaagaattcgacatacgatgaaagaaatattaactgttaacatcattacatgtaagttcatcatggcatcttaataatacaattataattatttgttattttaatattaaaggtaaaatattcaaattgaccagaattcggtctaggactatggtctagggtggatcttaggttataaacaaaacgtatactccgcatgtgaggttttttctgtatgaatcaggacggaaggagaggggtgggggaggggggataggctcgagactataattattcttgaaaagtgtgcagtccctcctccaccgtgtaaaatcaagatcgatgtttgtactataccgagtgataatagagatgacataaataattgattgattgattgatttttattcgacaagcttttgtgcgggggctctctcattcacaagaactggattttgaccgcagcacactgtttcattaaagaccgtactcccgtactgagccagaatggaacaactgtttatcttggtaggtctattgttttgcaatgtactgtattgtatttacttaccacctataggggtggttgactgggggtggttaaccgggggtggatgtccagggagtaggtgtccagatacgcagtgatacacaccaaggaattctgttcattaacacatatgatagttaatacacaatattataccgggaatggatagagacaaatatttttaatgtataacagatctaaagttaaacaagatgttagatgaatgcaactgtgtctccaatatgcccccgcctatgatttctctaattaacgattctgtaaactttaacatctcacctcatacaccaaaactctttctatgctcatacataattgagcccaagttggttgaatttaattc

SEQ ID NO: 49196 - DNA, 1753 bp, Oryza sativa
ccccccccccccccactgagcaaaatatcggccggcacgattttcaattttccgggggcaaaaaaggaaaaaaaatagtactcactaccccccccccccccttaatgagcgaattatcggcctgcacgattttcaaatttcagcacactaaatttcaaattgatttcaaatttgggcctaccccctaagaaatcctggatccgcgcttgcataggcctacttgaaccaagtttggttacaatttgcctcaatgtcttttacgttatcgccgtaaacaaaacgttgaattttgacctcgttacattttaacctttaacatttcaattcgtttttgtttcttcttattacacttaagccaggttattccttcaatggttttcaagttagtgcagaaattaaattcattctggtatttctaaacactttcatggccctgtaaccttatgacctgtagccacgaaatacatgaaacctgatgaattcattctaatatgcgcatgtatatagttcatccaagtttggtttgaattgcttttaatgtttcttaaagtaaacgcggtaacgagatattttctgatgtttttaacacttttattgaacctgtaatctttgacctcttacaccaaagtatattcagttcttcgttccaatggataattctttatcatttagccattatttgtttgttggcatgtacattatgggagaaatgtaatcttaatgttaatatctacaaaatgtattaacgatttcatgtaaataaaacccaaatatcttaacttcctagcttggtatgaacatctcttaattggaaccgatatattatattttgatcgcccaatccgtctgtccgtttgtccggacgtccatcccgccttttggtatcgcggaccggctccggacagacacggccgcgttcggcaccaccctcggtggcggatgcattatgaaaagttgtaatacgttgaacgtttaatggtattaagagatgttgcaatacgaattatatgatatatttatgaccaaaaaaaacagtaatttatctatctaaagaaatgtagtatgtacatacaaagctaggaagtcaagatatttgggttttatttaccggtacatgacatcttaaatacatgatatggatattaacaagagatgtagattacatgccaacaaacaagtaatggccgaattataaagaattaacaaaatatattcgatgtcacaatttaaaagggaggtaaaacgatagcaatggtaaatcattgcatttattcatattagatggttcttacagatacacagttgcgattgggtcaatcctcgtaacgtgagcttcctggctctcaaaatttcgtctcgtttggttgattgccgttttctttcgattcaacttccgctcggcccctcccccaccccctccccctccccccccctctctctctctcttcctttctcttcctctctttctctcccttaattttcatcttttaatgccattttttctttcaccagtacattcctaagaatacaaaacattgcctgaaaacaaaaaatgttgcatgatcgaagacataacagtttctcatatacattttcttatatcgtcatccgatccacttacgatgttaattctcgtcttttgatttatatatttaggactgacacacagagtgaatgataagaatagggcccaggtgttcgatgtgaaggaagtgattacgcacccggactacttcaaggaccccgtcgacgg

SEQ ID NO: 49197 - DNA, 3621 bp, Oryza sativa
tgatagtaatatgtttttgtatggatgcactaatatagagttttttttccagttaaatcatgacaaatttgaattttgataaactatttatatacaaatcaataattataaatatataatattcagaaatagtatcgattcttcaaagttcataaaacattttgtgaaatgtcatgcacgcaatatgattcaaatcatataacctgggcaaaggcatggggaaataaagtttggggggggggggggtaaaaagggaaattaatgagattaaactatataaagcaattgataaatagtgaggacatgacgtcacaaacttataactaaattggcaatttttgtagtgattttcattgttccatagttttacatacttttttaaaaattcataacttttttattattaatccgattttgctcaaacttttttttgattggtttgtctgatttttctgcttctattgaaagtaagttattttcggagtggacttgtactttaaccccactcccctttcctcactctctctcacccctctctctgtccctctctctctcccaccatccctgtctgtctctccatctctatctatctttagctaggttcacccaagtctgtaaaataagttaagcttgaagttttaaatttcgaggttatcttggtttcacaaactatttattcgaagttttaaagcacgaacgatcttatagtttaagcagagatgccaaccagtacgtttttatagtatttagtacaataaaataagtgaaacacgataatatgataatgcctcttgaaaatacggttttataattttgaacaacaaaattagattaaaacaaaataaaaccagtaaaacatttttctgtgattttactggcccggggccaacaggccagtggcagtgtcgatttttcgtgaaaatgagattttttaggatattcagtctgtttgttgtgtcaagaggttggcatctctgtttaagtgaaaactatgagcgataggcctacgcaattaacgtcgatgtttcgccaacctgttgtcacaaactactgcccactggacctgtagtttaaaacttcgaacactcgttgcttcggtcctgtgtgaacccgcgttgttgttagtggtcgttgtttaaaacttgaagagtcgcaaactgtagtttaaaacttacatctttctctgtgcatgatcattttgtaggtctatcattaatgatgtcttcttgttttcttcacccctcccccttatgtactttaaattctcatatctagttaattggtacttgaatcataagaggacggctttcgtcacaggttggggtcatatcagcttcaacggagaggactcgcctgctctcagggaaatcatgataccactggttaaagatggaacatgtacaagtgcgatgagcggacggaaaggtgagactgtacgtgtagacacgactactgaattttgtgcgggatcagagaacgggatcatacgtgatgcatgccaaggcgattcaggtggccccttggtcgtgcaacggaatgagaaatacaggcagatcgggatcgtgagctacggcatcaaatgtggtgtaacctttggtgtttacaccagagtcccacactatgttgactggattgagggaatcattaatgagtagaaaatacaaacatttatcgtgatctaacaaacaaaaatgcagacttttgtgagacattcatagtaggaactgtattggaagttttacgtacatgtaatacacatgatgtgtaatgaattgttttaaacattctgatattttaaaaatgagtataatgcattttgtttcgtttagataattatatactcttaaatttctgcataataataatcttaaaagtcgggagaaaatgtaatatcaggtgtgactgatataattttgcactgcagtataaattgtttacccaacaatatcatgataattataaccgattttagtatccaaggtattacttggatcataccaaatataacttccagtagtgttgtatattgtagaaagttgataatagatttaaaaaaaaaaaatttaatactttttcctaaaatgtaaaaacataggggcacaaaaagaatgaataagtgttttaatccactgttttaccaaatgaacattctttcatttccttttttccaatgcatttaatcaattatttttaggaatttaactattgacaatcttgtaatggagtactcttaacctttaatcattattgtaacattccatatcatgaatatatgagcaacttcagtcttgattatagtgaagttacttcactataatcaagaccataatcattgtcaaactgagaaaatacctttgataggcaggaattatttaggtctttgaagacttctgtcaactggcaaccgcttatccacagcaagtaatttttacctgttaagtacacggatggtctcaaaaatcattagaatactgcccttttccccacttgctattcacttatttattaccctccgaaagaaaaagtaatctctacatgacaaaccaattctgttggcattaagccatttaaacaaacaattccattttcatctaatattgtcactaatattgcataatcctctgtcaaacaaagcatggttgaaaacatgatttattatttttaaaatatttcatttttattcaaaattatcgggtttctgaaaggatgctcttcagagtgtttcgtttctaaagaataccaggtagtcaaattatcaatgtaccatagaggcattgttggctgaagagcgtcaacatcatatttacaaatgcattttttttcttctcaaaagaacctttcaaatacaaacattacaactcttttcccgtctttggacatggaagcaaagaaattgaattatacaaatctgaaaaataggaaaatatctcttgttatttagcataaatatatataaataaatatatctagaatattattctgtttcctatatgttgtatataactcttggtcaccaagtgtcgtaattatgttttctagatttcctttactataatcacaatatttacgtatagtagctctttgtggaattaaagttggttaattgcgattgatatataatacatgaataaatacacagaatgatcttaacaaacggcttgtttagtatggctcattgtaaatcattgtgaaaagagagagagagagagagagagagagagagaggttgtctgtttgcgtataaatgtggtcgggtacgtatgcctgtgtgcacatgggtgagtgggggtgtgtgagagagaagaaagagaagaagatgacaccaggggagaatctagcttttttctttttaaggggggttgatgatgcggagcatcgtccacgagccgcgtagcgacgaggcgatttttttcttgctattttgaactcccgtaagcgatgttttcctggcatttactattagtactaacacaatggagaccataaaacgcagtgcatgataacgtcgttttaacagtttaatacacagttatatccagaattatcatgtgtttggttaagttaccagatgagttgaatatctgatttcacttggcagtccaagggggggggggggggggg

SEQ ID NO: 49198 - DNA, 14411 bp, Oryza sativa
aggaggaggaggaggaggcttagggttgcagccccccccccaaaaaaaaaacaaaaacaaaacaaaacaaaacaaaacaaaacaaaaacgttgttcttggactaaaataagggtttagagggaaaaaataagaagggggaggaagatgagaaaatgaaagagagagagagaaacttatttcgaatcttatcggctggaatcttttcgctctgtcgttacggttcctccactgatgtaagcctacttcaagagtattgtagaagagtttgtaaaacaaagttaattacccctgggtaattaattaccaaggaagaaagccaattttgtctttacaagagccatacagtgcgtatcaaaaaaaagtgccgaagctgtgacatcatacaaatctattttttggaatttctcacttttttcttcattttccgaaagagcatcataaataatgtccaaattttgaaagccaattgaatatgttcagtattggctgagatatgaccatccgaataaaaaaaatcctataggagctcagtgttattttgctctggttcataacattacgaaccagagcaaaataacaaattaaaaaaaaaagaagagaaattctcaaaatagatttttaatgacatcacacttcaccactcttatctttaaacagtgacgtcgagtcatgtttcatggtaaagagtaacattacaaataccctgtctgatcatacagtgcactatacaggggcggatctagctttttgccaggggggggggggtgaccaaactgttttccaaaaatcgcggcgttttactgtttgttttttcaattggctgcccaaggaggggggagttaaaccgccaaaacaaggcacccccccccccctagatccgcccctgccatattcatagttgtgctgccgcggatgactgagctgcaggcttttcaaaagtatcgttaaaatctataccaagttggggctgaagcaatgaatttgggtcaaaagcaattatattgtgtacataatatacagtatacataagcaaaatcacatggcattaaattggaaacaacaacattaagaacgaaataatgtacagcgaaatattaaacaaaaacacggaaaacagacggctggaatagctttggatgttgacaagtctcttttcttcatggcttgaaaaatgttttcatttatccatgccggtgatggattgcttcaaaatctttgttttttgtgtaatcttttttgaaaaagtatgttaaagagaaatagaaagaaacaaaccaaggccacggcaaaagaagaaaaaaatctgctaaatgcgagaccatatattttacctaaaagcacaatttagtgaaactaattcagcaactaattcagattaactttttaatttaactgcccctttgcatttctgataagtgccccttttattttgacacgtaggcctaccccttatcctatttaattagttccattttcctcctgataattgccctgttttctttgtaataagtgccccttttccgttgtcataagtgattttttcatctctggtgagtgccctttattaagtgcaaggtgtgccccatttacacctctggtaattttccttgttactttgacacgtgctttttttctttctaataaattccttttccttttgtaaatgagcccccttttcctttccccataaaatgtgctcctaatttatagcgattaagagcaactttttctttaatttcacccaaagctggcttgctacgctcgctcgcatttaaagttgatataatcatgtttcttattaaagattatttcagtctttcatgactccattgtgcttaaaaccccatcaggattgtttttcctctttataaggtgtaatttttgcactgtgacgtacctcacaaatctcaaatcttttgctcgcttatataggctgatcaaaataattaaagtttatatcctatggattgaaactaagttctataaaatcctctatacattgcatcattgaaacacgaggcataattttacgtttaaaaggatttaagaccaaagaagcaccgatgcataattattattatggcctgaccaacatcgttccatcagcccaaatttggtacaaggcgattttgacaatactttttaaactgaccctccggtgctcagtcacccgtggcagaaatattatgaatagggcatcagtagactacggagcccgggaagggacatggtaaaaatatttttatctcgttaaaacgagatagttatctcgttttaatgagatagtatctcgttaaaacgacatagtatctcgttttaatgagatagttatctcgttttaatgagatactatctcgtataagtccattgcatactggaaccgggtggtccctgtgcctattgcttaccgtaccaaaatgatgttttttgatgcccaaatgatgtcttactttactagtgatgcccaaatgataattaatttttctggccaggcatttcactcttcttaatgatttagaaaagcactggttaccatgcatctttgtgacagaacttggaatctagtcattgaaaaaattgtgtttcttattacatttacaatatattttattttatgagggttgggggcattcaccccacatgctggtacatgtacatgtaggtatatgtgccacaagtacagcagaggcaaaattagggggctcaccaaaaatgggggttcactggaactaaagatccaaggagttcagacctcaaaatgtgctttggaactacatctaaatctgacttaactatgtaaaggcatgttgaataatgtaatgctttggaacagtttacttgccacaaaagctggatatgcaaagaactcttatccatgtgaattacattcctcacatggcagccgctcctctgaggcagcccggtgtcacatttgaaggtttgggataaaagactaagcatgattcaatggaattgaaaaggtgaagtattgtcacttattgtcaacatttgtgggctctggaacaaaaatatgaaaatttgccatgtaattaatctgaaagttacatgcatcagaatttttagggcataaaattggggcatttcagtagcatatgtgtaccgtacaatatattgtgagtgcacaatacaattaactgcagaggacttagaccaagaatatggccataatatatcaggttcttaatcaagtagttctatattgccgtaattggattactaataacttaaagttgtatttatcagattcgtaatttcaccatggtagtattgtttcacaaattattttacagacagagctagacaagatggctgatatatggaacaatcaccgtatccgaccctctgtgaatctccatgtaccaaagtggccatccaatgatgatgtatcatactccacaaatctggggtactgaagatcagctttgcaccaatgttgatgatgacgatctggctgcatgcataagtgatgctgtattccgatctaccgtaccatgcgacaaagatgtatatgacttgtgtgtgtatattatgaaaagagacaaccttgatcaaccaatggaagtccaggatgccttagaattgtacatccatctgaagcaggagattactgtgttgctttaaatatatgcattcaggaaattaagctgaaacccctgaagcaaaatatatcttaaccctcaatagcccgaaatttgatattccataaagtagtaaactttctgtacatctgatctccaggtattagtaacttccttgcgtagtaatataatagtaagtctactggaggtaacttgttttaacgtataggtaatttgtactcggcgaggggatgcgacgcttagcgttgctcttgtttttactgcattactactttctgaaccaattcacccgtttgaatttgtgtgttttgaacttgaacctttcttttattcatgcttcctcgaggagccgatgtatttgcattctaatgtgaacctgtgtcatcattacaaattttcaaaatactgcatcttctttttgctcaagaattgtgcactttgtattctttgtcaaggagatcagtacatgtacaaccagacactaaagctttaaaatcgtctggaagtccccttcaagtacaatatatataccttaaagttaggaagctaagatacaatggttgcaagtcgacttgttacatcttcatcatcgtaataaccaccatcacaatattgacaactaaaattacaataaacatcaatccacaatttagggaattacctgaattgccttgtggtggcagagactcaaaatgttattttcaggggggggggggggattctattatcaaattgccaagaacaagttaatatgaaggtacataaaaagtgatgcattacattaagaataaaaaaacaaacacattcttgatcaatgcattgtcaatttgtgctggaaaagatttttcactcagttattgctaatgtaaggatttaccaattgtatgctttgaaatttctgttgaaaagaaattttattgaatttgaacaattacatgtctgaaattgtgattttttttttttttttttttacttgtcttcgaatttctataaatttccatctaataatgttacataacagttatttctctgctccacagtggtacttcatcttcaatagatatagatgtaaaggtgaaaataggcacccacacacatgaaaagcaacgttacaagaagaagaaaaaattgacacagaaggcaaaaacatggacatccaacactattgttgtcacataagacatttgggaaacgagcaagatgaatgacaggtataactttaattgcaagtaaacaaaaataacacttcgacaacagactgatttatacaaacacagtcctttgatttcaggaatcagaacatggaatcagtgaggaatccctcaacatcttattgaaatatgtagaggttaatatcttttgtatgctttctgaatgagataggtcaagttttgttttgattaccaagaaaaatgaccttttgtgattttttttcccctaaattttgtatattattgctgttcgcctatgacatcacaaattcttatcaagagagggcgacgtggaatttatcaaatttcaagaaatcataactcttgaatggatcatctaattttgctcaaactttcactaatctgcttaaaagttaaatatttattttaatgatgtatgggtataattgtccttaaagtgacagctggaatattaaaatacttacatgacctttgattttggctaaatatgggggtccccatgcatgaacaatatacacaccaaatttttttttattttttaaattattcacatttttgtaagcactatggacagatgacattttgatctcttagttttactccacctgggtggctctacaaagatggctagccatagggaacataatagtatacctattatgtaatgggagcttgctcatctgtcgggaccaattaaaaaaaagtcttcattgaataattgattgaatttatttaaccacggtaaaaaacttaaacataaatcatacagaaattacattgaatagaactacacagagaaacaacctagtaataataagcataattaattaagcatgataatgaaatgaatacgataacaatgagagaaacataataaaaacaagaaaacctaacaatacatgtaagatgtctgtgtcatttgtatagtaactgaagggaaaaggagaacaaagatgagggaagaagaggacgcgagagcatatagggggaagtctgaggagaaagaggaagagaaggggagaacataagacagagagagagaggaagagaaagagggaggtggaggttggggggagactgacactttaatggtacaatgcatctacctctgcttcaaagagcttacgatttgagaaaagatactctttcaggcaacacgttgtataattggacacccgtatagataaatcccattgtttgttttgagttttcctaaagatagtttatggccggaatttctgagcccgtaagaacatccttttaaagaaatgtgttcgcataatgacgtaggaagcaatttgtaaacaagtttgaagatctatcctagggctttccttttccaacgtatttggacacggtcaattttactaagagaatagagcagatactatctcattaaaacgagataactatctcattaaaacgagataactatctcgttttaacgagatactatgtcgttttaacgagatactatctcattaaaacgagataactatctcgttttaacgagataaaaatatttttaccatgtcccttcccgggctccgtagttatgactctagtaataaggagctaggcctacttaagttgggtacaattttttgtgacaagcaccgtaaaaaggactgatttgaatgaaatcagacgttgtaaaatgttggaggttgtaatgctgtgccacagaggtcagtggctgcatgccccgtttggtgtgtgtctctgtaggtctgtgtcagagccatgagtcggaaagggaaacaattttgataacgggatttcaaagacatgtaggcctgcatataggggaatcgaagtttcattctaaaaatcactgtgtcaatcaaaagcatattgatatatttctaaagaattatgacaaacccgagtcttttactagtctttttttatgattattatagtcctataatagactagattctctgccaaatgatggaatttgaggatattgactgtaaacaaaggacacatcgcatatatatgaatactagtagtacatgcgcgctgttttgtcaaagagattctagagggataattataattgttttataaattataattttttcgaaggtcaaacgcaccgataatatagtcttgcaaagttatgcgtagtctcctcaatctcctcagctcagctagctgcgctgcatgcagaaatcagatgcgctatgcctaacagctagcaaaacagctgtatttcacgcctacacatggcggacatgatggacgagaagtatgggaaaatcggtggaacttccattgaaacaccgcttaattgcaaacaactcattagtttgaactaccctggtgtcgtcaagaatccttcgatgatgatagaaacacttggtggagaaagcaagttgacaaaggttagtttttatgagctgataaacatgtcaagttgtggcttatttgcctttcctcgtcggtctgcctatcggggccctggcccctaggtctaggctggagtcgcgctcactcggacccggtactataacccggcatgatgcatgattgaattttggcgctagttcagaagtctatccatactttgacccgtactccggcgtggagataccctactaaaaacatacccaaaatgaagtgaaatattcatcaaatgtccaaataaaggtcatgatttaaaagtatagggtagcgccgctagcgtgcccaggcccagtagtattcggtccattcccagtattcggtcagacagccgtttcaacagctgtaacaatttaaaaaataatttatgagccacaaaacttgcacaaatcgggcagctgaacaacttttcttaactctcaaaattaaatcagattaaaaaagatctccaacttagcttgaaatttgtcagtgttgcacaacttactgcacattcgtgtcctgttagcacatgcgcgaacatgcatagccatagggtagcgcgcccagtattcggtcaattcccagtattcggtcagacagccgtttcaacagctgtaacaatttaaaaaattatttattagccacgaaacttgcacaaatcaggcagctggacaatttttcttaactctcaaaattaaatcagatttagggccccggaatgatctccaacttagctcgaaattggtcagtgtcgcacaactttccgcacttccgcgttctcttagcacatgcgctaacatgcatagccatatgtagaagtctattgcgaaacaactacgtgtgctgtcacaatgaatttagtatgtgtgtgaagagaatcacttccgtgttcgctccatcgcagcgaatttgcaaatgacgcacttgccgatgtgcaagaggtatttatacgatacccttgccatgcggtatcgctcggccagtattcggtcaacgcattgacattcagtgctttatcgcgcaattgtgtgaaaatagtgcgcaaatacgctacgctccttcgcaacggagataccacgctcaaatcgcgtgaccgaattctaatcggtgcgaccggattctgggcagaaaaatgctccgtcctctttcggaagtattttgcttatcattattctatattttaagtgactataaaatcctgtcagaggaataaatttcttttcttttgatgggtagattgccaaataaaagaggtaagaattcaaaatattagtgatttcccctaaagtgaccgaatactgggcactctaccctacatgtatgtagaagtctattgcgaaacaactacgtgtgctgtcacaatgaatttagtatgtgtgtgaagagaatcacttccgagttcactccatcgcagcgaatttacaaatgacgcacttgccgatgtgcaagaggtatttatacgatacccttgccatgcggcattgcttgtccagtattcggtcaacgcattgacattcagtgctttatcgcgcaattgtgtgaaaatagtgcgctaatacgcttcgctccttggtgcgaacgaattctgggcagaaaaatgctccgtcttcttccagaagtattttgcttatcattttatattttaagtgactataaaatcctgttgaggaataaatttcttttcttttgatgggcagattgccagataaaagaggtaagaattcaaaatattagcgatttccccttaaagttgatactctaagacaatcccaaatactgagataattacataaatagaaagcttttaacccccataataacaccaaatggtgtccacccgacaaaacaagtttagaataatgaatttattcgagtaaactctaccaaaatatctaagtctgaaacccggaagtgcacgtagagtcgggcctctatccgtgacgtcacgaacgggagtcatgggctcagtgagagtgaatggcagtgatattcctacgtaaatgctatcctgtcagagcttagatttgttgttgttaaggagtatatttgatggattttctgttttcatttgaatgaagaataacgaagcaacattttccagtcgctgatttctttttatatcctcatattcacctatttggtagagatttaagacgagtttactgcttaggaattaaagttaaatcgtgcacttatgaataggcggatgcattatattgtcatcagatgtacatgagcagttttgtaaaacgaataggtctagaactatgatagtacttgtcatagatgtgtgtgactgcctcaaaaaaggatacagtaccagttaaacattttatgttgtaaaatatcaaacttgaacaagatcatgcaagcgcgcttcctctgtaatattttggcgagtgatgcggctcttgcatgaacgttcgtgaagcgagcagaatcgggaggtaagaccaagccgctgctctaggcgctgcttgcttgtgatggaacgtacatgtacgtgcgctagttatatgtttatcggcaattgcaagagaatgaaagcgacgttgccagctaagaaaaacaactaacaaagacttgctcctgactaccggtgtcagaattagtagatgaaggatgttcagggccaaggaaggcgaaagacatgggaaaaaggaagaagaaaccatcgggagatcgctgtagtgtatggtaatgaaatgtgcatgggtagacagctactgttcactccgtgcctgggccgatttcaacaccaaaacaaaaattacatggtgaaaatatcgactaatagcacatcgttggcatgtatatgtcataatttttaaaaggggaattgatattaatactatgaagtactaggggaaggtaaagaattgtacatagaattatgatttattagacttttcagcctttgaaacaaaaatatgcagaaaatcgtatcactctgcacatgtttgcaatggaacatccgggtacgtgaatatactctctcccggacgtgaggtcataaatagtagaccagcgccgtgactgattttctatgcaaagagaggcggatattttagacatttcaattgaggatttcgagtagacagaatttttttgtgatatactaagtaattgaaaaacttaaaaataacatatacttgccgtaggtaacaaattaagggacatttatttgcttagagtatcaactttaagtgaccgaatactgggcactctaccctaggtctatatacatgtagactctatgtttgtttgttacctgtttcgtgtcaattttcttatctttttcacagtaggaatagatactcgattctatgtatttcctaaaaacaaagacttataatatgcactttctcacaggattcacggcaaactgcagcacaatacaattgcataccgtactgacggtgggatgcaggcgtgtgttcagttacatgtacatatacgttagcgaccgtaaactaagattacagtcactaacttaacacacgcgcgcacccccacccgaccgtcgggtctacatggattgctaaataagtaaatacatgtaaatgaataaataaataaatattactgctgggaaatgaaaatggaaaaaatatcctgctgtttatgctttgctcgttgttgttgttgttgttgggttttaaggctgaccaacctaaaaagattatttctgtctggctgtgctttttttttttttagttgttcatcactgatgattagatggtgctgtttcttttcctcttcagtgggtatcatgtactatgcagcttccgtttattcgatggtgcgggcaataattttaggtgttgaccatgaacagggtgcgagtattttattaataataggggttaactgtgcagtgctaaactatactttcatttcccttcctctccaagagagttagttataactcatgtataatgattggtatctacctgtagcttttatgaaagccaacagagtgtgcagatgatcttcattccccagtaaattctttaaactcctatctttaattttcaaccgagaaaacattcttttcctctctcgtacatatttcttacactccaataaataataattgattgtttcagtttcatgacaaaaatcacaaaggccatcttttcctttcaggctttcaatgatgaccatgcacccctctcactcaacttccagcctggtaacccttactgtaagccagctcgaggcgtggcctgcaggtctacatccctactcatgaaggtcaaacgtcgatacagaaggaggagagagagtgaagatggaggtctgaagactggttcccagggggagagggatgggaattcagcaaacgggcaatattctgcagaggttcttggtgtgattggacaaaaatatgaatttccatgtaagtggatatatatatatataaattttgatctctcattgtgttacaagattatggccaaaatgttttttgtatatcttggctttcctaatagaaaaccagaaaatttcagctattaaaagtaatacaatacaaagttttggtatggggtcatgaatttggttcaaatgaacatattggaagcatatgccatcctgcaatattcagtgatcgttgtcgcggttgaaatcaagtcttaagttatgaaattgtaaataataaactctttatgttgtgtacagctatagttttaaccacgacccgaaaaatatgcagtccatatttattttatatacctctgcatcgattctcaaaacgaaatatttgaacaaaatttgcttgagtttttttaaatgcggtatagtatcttaaattttggcttgttaacgcttgaagaatgatggataatgcatgtatgacgaaaaagttatagacttaactcgatgttaaactaggggaatacccggaataccaagcctgagatcactccggctgggctggggtctgttgtgtccattaaaccgaagccaaatcgtttcctatcattataaattaggcctttatagcacatcagacctgcatgttactgtataccaaaacaggggaaaaaaataatatttatttttggggggctacttttgtaccttaccggcatgaaaataacattctaatatttgttttgcattaaactctatgcaaatttaagagggctcttttctgatttttgggggctatttcgccctgagccccgtgtatttttttcactgtaccaaaataagaccagatttataccagcctttgagataacgttcttgtcatatttccccatatgctcttatatcttgaatacagacctgtgtgactttcaatacctgccgtgcgaacaccaatccagcgggggagaagcggagagcctcattggaaagattctcccttcggccggtgaggatattagttatgtggacaaagacactccatctttcatgctacctgagatgttctccaagtttgacaaacccatcccttacaattacaaggcaggccaccagctcccgaactctaagcaacagcacgagatggactttcgtgccaagctaatccagcacgggaggcataagcggaccaactatgcccatgttgtgtcaaccatgggtgattttgagattcccaagaaaccccatccgattgctgtagaacagcttgaagctcagaaaccaggagctactacggatgagattacaaaggtgagaagatttctttcccatagatcatttccaagcctggaattaacttttctttcacaggggctcttaaaaaaaagggccctgagagccttctcacagaggctcttttagtaatgatagaggctctttttttatacaaattttcattgaattggtatccatgatactcctaaattctttgctatttcatcatttgtgtgaatggtgcgattttgatctatttgggatagacttgccaattccatctgacttccgatatttgtgaaatttacgatttatttatttatttgctcatcagtatttttagttacattgaaatactgtttaaatgtgctagttgatgttcttaatcataataatgacaatcttacctgttgatcttgttaagattaagaagttattaaaattgatcggattcacattttgagattaacattgttgtatgtttgagcttatttcacttgtgtaattggttgtcatctgttttcggaaaattgcccctggttctggctaaatcccgtgaaccaagggcaacttttgaaaataaattgcccctggttcctggcagcttatttcagagttgcgtgcaaaactgtggcggttcattatgtagcgtaaagtgtaatatgcttcacatgtcttatctgtatccggacacctacccccttggacatccacaccccggattaccacccccagtcatctaccccctaggacaactacatgtaccccctagggcaaccgccctctaggacgattaccccccaggacaactacacccggacaactaccccccagacaaataccccccaggtcaactaccccccggacaactactccctaggacaactacccccaggacaacttacccccaaataactaccccccaaacaactaccccctaggatagttgtccggggggtagtcgtcctagatgatggttgtcgtatagggggtagttgtccggggggatagttgtctggtaggtagttgtctggggggtggttgtcccaggggtagttgtcccgggggtagtcgtcctaggggatagttgtcggtagttgactgggggtggttatccagggggtagttgtctgggggtagttgtcccaggggtagttgtccctggggtagttgtcctagggggtagttgtcctagggggtagttgtcttagttgtcggtagttgactgggggtggttatccaggggtttgttatccaggggtaggtgtcctagagagctcagtaaatatgggcaggatctgtcttttgtgcagttgccatgtatttacatgttaacgaataagacagcaatgtatcgtgtcatatctgaacgagcctcaagtacatgtaactgttcaattgatgcgtgtatgattagtacatgtacctagttctaatacctagtaatatttaaagaaacagaaccttgtccaaaatatgtctttgccagtacaagaaatcaaaccgacatttctgtagttatacagtacggtaggcttgcggttgcaccatgtaaga

SEQ ID NO: 49199 - DNA, 11616 bp, Oryza sativa
  unsure (1)..(11616): unsure at all n locations
agtgtagtgttgtgtcttaaagtctcagataaacttgcatgcaagggctacatgtacataaacagtgtatgtatcttttattgtctcaaaatcagagggtgatttatatttttctggaaatggacactcatcacttccattttttttcaatatattgtttacccgtaaatacacgaagacacacaccatatcagctctgttctgaaatatcatttattttatttattagaattagcgcctccagttcttttacaaccactgcccaagttgatgctatatgtacagtacattatgatagcagattaatttttgtcaatggacatacatcaacctgtacctttatcagtaaataaacaataagctacagtaatactgtaattcttttaataattaatattgctattaatcccatttgaaattgacctatatagatgataagtttacaagcatagactgttattttccacttcaaataaatatctgtaccaagtttatcttagtatctttagtaaagcctagcccatgccaatatgagtacagcacatggcgtattttgtgccatctacactgtacagtctagcaattaaagttaaacttgagttctggtaaatatagaaaataaattcacacagaattccaacgaaacttacactgaattttcaagattacatatataaatgacataatgccaaatgattttggtagaaaatgtatagtggccgagtaatgagcatagaaagatattaaaggaaatccggatagacccgacaccatgtgcttaacacagatctctatgtacgaatgggagtagtgtttttttatctatctttaagatgatgcccagtatttaaagtcattgtgtggttgtttttatttcactggttcaaacaaccaatctactgcaatccagaatcatagcaattttctctcaaaatgctattcccaaactagagctcaagattagctttaaaccctgtgtcatgttcaatttcgcgcttacgattcattcagacccgtttcatttaactattaaaatgaaatgatgaatttacagaagagtttgcttctaatgtattcaagaccttttaaaccaagtccttgttcaatcctttcatgatgatgatacgattcaccgacgccccccccccccccaaaaaaaaaaaaacctttagataccacctcgtttctctatggtgcatgcatggtactgccccttcaatggggcttatattggccctagctaaaggggtatacatgtagctcagaaatgcagtccaaacagtaatgatgaaatcccctatccttgtagtggtgcctgaattaagtccatggcaccctgaataatgacggtacccccttagtcctctttggtagggggtaccgctggtgttggcctgttgaaggcgcctgctatggccctagcgagagggacggtcgccagcggtgcagcccagtagaccaagaggtgctccaagaggctttggttaccacagttcaaggtgattcctgcggccagggcagggttaaacatcatcccagtccactccaaaccttgacaatcaagagggaaagtaaaactattgaaagatcgtgggcaaattactcttcttatgatattaaagccccactgtactacttgtagctactttgctccctctatatagaaatttgaaaacgatgcctaaggccaaattaaaaaaaaacatgtttagcgtcctgcttttgtgaaaaataggaaggaggcccttttttcttttttttcaaaatggctgctcagtacaatttccctgacagtcaggctatttttcaagatgaccgccaagatttttttttaaatttttaaaatcagaaatagatccattatagcagtgtttcccatgtttttttttgtttaaaaaaaataatcaaaatttaaaaaaaaattatttttaaacaatttcaacaacaaaaacaaagtcaaaaaataaaggaggatatagggcggggacggttaacatgtaaattttgtttaaaaattatttttaaacaatttcaccaacaaaaacaaaataaaaaaatataggaggatatagggcggggacggttaacatgtaaattttttgtaatggcctaatcagtgaccattggtcccccatgatcctctttttcttatgtaaaattgagagctgagttgatgagatagccacctgtcagtgaccaccctgggtggtctaatcccccccccctagccaactagtacagatggcttttaaagagtccattctcaaaaaacttctgacttgggaaagtaaaactattcttcttatgatacatgtacatgtattaaagctacggtcacaaacgttcgtacaaatctctgtttttccattgtctgaaaatcgtttgtactgcgtttgtagcagtttgtaatggcatttgtgaccgaggctaaacagtcaattctcaaaacacttctggacttgattacaacttctaaatgtcaaatatcattattgtgatttgcgaactgtacatgaaagatgtatcattgtttctttcgaaattcatttacctgtgacgatgatcaaaacctggattgcggcatcagcaaacattccactgtactttccttttggctgaaagttgagggtcatgaaataggtcagggtggccaaagcttctgcaaagccaccttccaggatagagacgttcaatgcagaagcacagtagacctgtagcaggtgcgagaccttcctctgatgacgattggtcggtaccaccttccacatgaagcgcacgtagggatatgctagttgccctccgaccacctgaaggcatatcttggatagtgccgccccagggctaaagtcacctttgagcatggactgccagatcatacaggtgttggctgtggagtcgccgtcgaacgtaaggctctcagacacgaagagaatccagagatagagagcgtaccagtagaggccgtactcctccaatatgatgtcgccctctatgacgcctgcgaccagttggaacgtggagatgagttccgcagcatagctgtaccagaccggatcgttgcgcaggattctcttggtcagagaccgaatcagattgcagccgaccgtcgtgaagaagacgaggaggaatgtcgccaagactgctgggtactcctgcgtcatgttagtcgcctattatttcacaaactgaagacagacagactttagctatcaaaccacctcaaatagtaatgccggatgatatgatgcattcgatattatataacactagtggtcctttcagttcttgttattcaacacagcctgagacagctttgtccggtgccctgcacattctcaaaagagcagcataatattccaaccgtcttctagaccaccagttaatatattaaaagtagtttcgtatgactgaaggcctcctgagtgctgcaaaccaatgaaagttctccttttcttttgtgttttgctgatgctacattaatgtacaatgcaacaaaggctgccctttattctccagtgagcaggatctattcttcacatctaggtcttagtttgactagacatttctggtattccaggaatgcccctggctcttacagaccgctgggacggacggacggacggacgattgacatcacttccataactatgacaaaccagtggttcacatccagaacatgctcaatagatgcatgtactgcgtggtgtatagtattcatggcatctaagttattcaaggttgcagctagaactttatgcaaatatgcacatgctacagtgtaattaaatgtgtttacatttatcgagagcattataatctgatgacctttgaatcataagtgaagtattaactttagatcagccaaatactctacatttaaaccccctaaattagaaggaaagccaattctatacattgacattataggggagattatttacatgcagatgatcagaataatttgtctgaagtacaaaattatgtttaaatgagtttgacattaacttgttaagactattttattactttgataacattctgagagatcatcgaaaaaggaagttaggcagcaatatcctgtctcaaagtgtaatacgtgtttcctaagacatattgagttttcttggtgagatttatggatcattcaatatgtgtctcattagagattataggaaaggcaaatgatttcctgccatcatccctggggggtgtttcacaaagatcctaagttgaacttttaatctctaagtttgacttaacaattattcaaagccgaggcataaaatgttgattcaaatcattcatattttctattatcaagaagatttcatgttcttgatgtggtattaataacagtctaaaatacttgaattttcgcattcgaatatgttttttttaaggctgcaaacggctctccataattttatagtccaacttagagttaagttgaacttattcaaggatatttgtgacacaccccccagatttgttgaaggctgatcaagttttaaatcattagcctgttcaaactggaagaagtttaaaatacatgtacatgtacatgtaaaatcgtttgaagaaacgtcatataataaaggatcgtcggatagcaaaaggtgcgtacagaatgcataacaacataattgaaacgttgattagatttgaaaaggtcaggtgacataacagcctaccaatcatcaaagtgcactcacgataaaccctgcccagtttttcagtttcatccaataacattaagactaaatcaggaccctgctcctttatttgaaaagatgcttcaacatttgtttttgccatgtacattatttgactatgcacttctttattcaacgttcagactactttatacagtaaaattgtaatgacataacttatagctatacaattcttgtatagtgttccactgacctctggttgtctggactggggattactctttctttgaagaatggaaggaaatactgaacacaacaaggagttaaaggaaatttgtgaaaagaatactataataataataacaataacattaaagggactttgtaacattgttcagataagagatagtggtgctaaggtagtgacttcaatgctagatgtacaattaaagataatctgaaaatttgagtgaaaacggatcattattcatggtactaattgggaaaaactgatctgatcgattccttaattctcccaactatattattctacttctattctgctacttgtcaaagcctgttcagcatcaagacaaggacaatttaattacattttaggtgaatgtaaatcgtcacaaagcaataaaatggctctacattccattccagacagttaagtgttgacagatttttatagcctgttttatgtatttttctcatggaaaaacggttgggaaaattcaaaaatggttgggagaatttactgttaatccctgttagagggtgcctcacatcgacgccttcaaagaaaaccatagatatctttgtggtttgagaatttgttcaggattttttgcatgtcagagggttagtatagtagaaggaataaagtaagtaacattttatacaaaaattaagcaatttttttcatcaaccttcaacaatgttactgagtcactttaaagggattgggtatctttgtatcagattctgaaacaaaaatcctggatttagctcatgctgcaatgataattaataaacctttaggtcactcaggaaccccatgacttttactagccgatcgcttgtctgattatgaagatatttatgattggaaatcgaaattttaaaacactacagtctattggggaaaatgagtacctggttattaaaccagttacccaaagatttttactcttttgaagcgcaatttttagggcttcaatatgacaccatatcagagacactgtagggccatatgcatctcagatttaacattgttaaacgatgcctttaaaagtgggttcttgtattaatttttatagcatgtatgtcatacttatagtaagaaacaataatgtagaccaaaggtaaattcattttcttgttcttttagtaggtggtgtgaaaatagtgccattttaatgacctaatttacctttgaaattgtaataatttttaaattttttatttgttttacttgtatgtgtatttttgagttgcagttctatagattattttcttactcattattttcctactcaatattttcctttttttcattttgagggtagagaatgagtctcttcaaatcatgtatttgactcaagactattaataataatgaacatttgtatagcgccttttctacaagtagatacaacgcgcttaattaacatatacaatgaacaattaacaaaatagaaagatgcttaacaacagacatgtatgtaacaatataggaatgaacaaaataaagggtaagacaggtaatagaagagcaagaacaagtgctggtaagcgggcattagttaaacaagtgtgttttgaggtgttttttgaaagtcattagagaatcagcagtttgtacaaaattggggagattgttccatgattttggagcagtggctatgaatgcccgcttaccagcattggttcgacaccttggggtatctaaaactgtacgagtgttggatcttaggttgtaactggagtgcctaacatgaacgagatcagtaagatatgagggagagagatagtgtaacgacttaaagacaagggtggaggtcttgaagagcactcgctgttgaataggaagccaatgcagagagttcaacaagggcgtggtgtgtgtgctctttggttgtttgaagatgaggcgtgcagactggttgtggagaagctgaagacggtgaatgttctttgctgttgtgccactcaacaaactgttacagtaatcaagacgagataaaactaaggcacggactgcagcatgagtggtactttcgtcaagatattttctaatcctgcataagttccggatatgatatttgacagtcctgactacatttgagacgtgaacatctggcagcatgaggttgtcaaagacgacgccaagaatacgcagcttctttgacggtttaatcacagtcccatcatgaagagttagagtgaagttctggagcaatcgttgatggactttcgaagcaaagactactaactcagttttgtcttgattaagtttcaatttgttggatgtcatccacctgtagacatctctcattgcatcccgtagtctgcatgcagcatgatcaacagagtcctggctagaagggtcgcattgtatatacacctgtatatcgtcggcgtatacatgatagcctatgccatgactgtaaaggatatcagatacaggtttcgagtagagcgtaaagagcagcgggcccatcaccgatccttgcgggacaccgaactccaacctggtgtctagtgatttcactcctctgattcgcacatgtgatagtcggttgctcaggtatgatctaaaccagtgcagtgctgtgccagagacaccatattcatcccgaagccttgtcagcaagatcgtgtggtcaagagtgtcaaatgcagatgacatatctagcgacagtagaatgacgcatttccgatcatccagagcacataagatatcattctgaagactcaccaatgcagtctcagtactgtgatttttcctatatgcagactgtttaggatcaccaaggctgttgtcttccaagtagttggctaactgtgatgagacgactctttccataagcttggctacaaaccttatgttcgaaatgggtctgtagtttttcattctttctttgtcaagtcctggcttcttcaagactggtgtcacagatgcaacacctagagatgatggaaaatcgcctgatgccaacgatgcgttgatgatatgcgtcagctttggcagcaaaacaggaaggtgacgcttcaggagccacgttggaagaggatccaaaggacatgtcttgttgggtgagcgtttgatcagcctctgaacctcctcagatgtgaccaactggaactccacgaatgaaggggctgagattgccataccatttggattgtccaattcgtcaacgtttaagtcatctatacatctccgcaagtctctgatcttctcactgaagaatgtgcagaatgtagaggcaagctcaactgatgaatcagcatctgggagaaatcgtttactcttattcagaagatgcttcagttctctatacatgtcctttggagtactttcagaaaacaggtcattgtagtagaaccgtttagcccttgacagagcttcagctgcagcagctttagcttcacagctagctacatacactgtacatgtacccctaccaagttttgcaatagtttaagtatgtgataaattgatttggcctgattcatgtttgttgagaatgtgacatacatgtattaaagattacactacatttaaagtattcaacaaaggccctcattcaaccagtacatatttcaattttgagttacaaaaaaaataaattacaaattttttttttttacaaggggtatgaatagtgtagttgttaactgtatttaatttaacggcaaaagcaagcgaggtgtaaagactaaagaccaagatcaagagtgagaaataaagagagagggagagagagagagagagaaagatcaagagagagagagagagagagagagagaaagttcaagagagagagagaaggggaggggggaggagaaagatagagaaaaaaagagagagagagtacaagtgaaggcaatacaactactgtcctgaatgcatttcaatgcaacacttatacaggtatatctacaattttcaatgagcacatcgtaaaggaaaagcacattaccttttcatctctcttctctttagctctttgaacagcgccccctatggtctcggaatgcattgcgatgtaacacggagatctcaaccatcctgatcaagggtatcctttgtgtggtggcgtactacttccaacagggtccctggagagggctgtggtgccgcatggggtacgaccccagagaacatccagagtcgaagaaataccagcttcttgatttcaggataaggaaaggtaaagtgcacccatagacactataggatgttaaatgctttttttaatctttcattttatcttgaagataaacttgagttccagttatgcaattgcattgtgaaagaaactgcttggaagcaattattattaataataatgataataataacaacaacaacaataatgatagtgataacgataataataatattaataacgataataatgataattgtcaaaagtgaattcttcacttgtattggaggatggatcgtgttttgaaggaataacaatgtactttgcaacattttacttttgacttggcccatttatatacatgtacaggtgcactgtacagatcatgattacataatcattactaattgggcatattgtaaatggaaatagaccggctcatcaatgatactattgtcatctatgataatttagtaacacaagagatgatatcaaggctcaaacttgaaatgcagaactttttttttgatggatttcaggcctgataattacctgattaaaatcgtttcccgttttttttgtttttttgtaactgattattttttctgctatttctttttctttccgattttacacctattcacctgattttccctgattttcccaattttcccccaattttccccaaactaacccccttaaaagaggggtaatgttgttagatgcaattgttttctccctgaatccttttttttttttttttttttttttgttactcaaggggagggaggttttttttagtactcacaatcacccctggatcattcatgtttctctactgtgttgaactactgcagagctgactgacaagagattgaagttgctgctgaagaagaagcgaatgattctctaccctcaccaatccctgaagcacaagaagggtgttcctacacccctactaggcagcaatcctggtcaacaggtggatcataaggaaactattgtaagttacaagattgttcatttcccttcctatcatgtgcttttcacactggtaaaattttgctttaatagccccggacnatagatggagctaaaggggggggggggggggggtgtcttagccccacctatagtcctgggctaagcttcatccactttctgttcagacgcgaatttgccaaagtgggctagccccacctaaagtacagggttagttggcccagggctaactatgcaattctggtgctaagcaaatgaatgagaacagaaacgaaaaaagtccggtactacgtaatgtagcttatcagagctggccagaggcgaagcaagaaacccaaagcaaaagccagagtaaatttataatagaaatctgacactggtaatttttatgaaatggggcccaatttttctttctatcatcctagagctctggtcagtggtatttttctctttctttgtctctatatgttttgtttcatctttgcctggaaatttaatgaatgaatgaacatttagccgctggctgaaggacattagcatgtgtgcatgccacaaagcaaattgttggtatcttgcttccgaggttttgactgctctaaccatttaaacagaacagagattttctcttcgtcaaatgaatttttaaagagaaagatccattgtagtaacttaatttgattattggtatcaaataagcagatacctatgaaattacaggcatttttatgcgaaggactttctgcttaacgcaagttcatacctgcatttagcagaactgtgcaacatgcctacccgtaatctctttgtataagacgcacccctattttgggggccgagaattaacaaacaaacctttattttactgcgaggtgcagttgaagtcgccgaatttgtgcttgagaacttgtcacaaataatagtaacaatgttgtttttaaaactaaagaggacagaaaatttgtcctcaaagtccaaacagaaatccagacatacaggtagtgttgttctagtttctgagtggtgagtcaacacaccatgtatgactgagctgggagacattgccaggcataaatcgacactaaaaaaatatataaaaaatcttgtacctgtttataagacgcacttccgaaaaaaggtgcatcttatacacagagatttatgatacgcctttctgccggcaattcaacatgaaatgaataaaattgaataaaatagattaattaatatctgttacacctgtaggattcgtactacatcatgagacgagggatcctaccggcataccaccagatgttctaccagctgtgtgatctggaggacccagagctccaggccatcgtcaccaaccctctctggcacaagaagaggcccaacatgaagacgggttactttgaggtggagatgttccgtcagctccgggacgccctcactcagatgatcaaggataccgtgctggaagtcaatgcaaaaaaattgcagcaaggtaaacctatccaaaataatatcgctagtgatatttgtttgtctcgcaatgtatg

SEQ ID NO: 49200 - DNA, 1977 bp, Oryza sativa
cccccccctcaccagtacgccagtgtgtattagtcaaaacatattctttcacataattggtaattaagtgcttccatttcattttttgaaattggggcgtttccaaacactggtctttacctttaaagaatgttgtactgtaaaacgtcatcagaagagaaagaggtggagaggaggagggagagacagaaagtgagagagagaaacggagagggggaaggagagacgaagggagaaggaggaagaggcagaaagagacatattctgagagagagaggggagggagtgaaatagaaatagagaggaaagactgaagaagagaaaaggaaatttgaaaagtagccagttcaaatagagaaaagggatgagagagtgagaggaaggataaaagtacatgcaatataaaaatacgaatgaatggcagaacctgctgtgccaatcatcatgacagttaatataggttttcccgcccaacttcgtcaacttagcatccgaattaacgttacgttcattcaacttcgtgcgaaattgaatgataatgtagatcaacattcaaaaagctaattgcgtcattcaatttgatttagtaccatgggattgcatactcttgtcacggagacgtgcaaaacgagcatttaatttagaaaagcgtgcaaagagcattcaaattcgcgccggacagacagtggtatgtcttcgtgcattcaattccgtgattaggcatacatatgtgacatttgtgcattgcttttcatttgatgttaatttgtcacttaatatacttctgtttgaataattttattcaaaatttacttggaggaatggcatgcgtattcgttacattacacaggtaactgtccccagagaaggtgcacaatttgtgacttctcttctaagcacatgctatatataaacagatcttggacagaggtatagttcaggtttaatagacatgatggaaacaaaataaaatgattgtgactgtctgtgaggcgaaacgctgaataattacaacgactcaggtttttacgggaatgtcagtttattttagagtcataaccatccagggaaatgcaactctgtctttgacgaacgaatctttatctttactcctttcactgctttattccgttcttcttcccttcattccgtgaaaactgtacatgataaagcataacaggaatgcataattagtatgtgttcatgaatataagttccacaatattaaagcagatatagcattctactaaatcaaagacattgtctgaattataactccttttcatgtttgcttgtaaatcttatataagtcagacactgtcttgacaaatctatctgaactttatgtagaatgtcacagctaacacacaattaaacttatatcatctctatcatgtctaaaccagatttaacacggtttcaactaaaaatgtgaccatatttaacgagcttgaatgactttatcatagtcaaggaatacaataacaaagtcatgaccttgacctgtcattcacacaagtatgctcacattcctcatcccttttcatcatagaatgtcttattctgcatcatacattttacttgactacccataggaaagaaatgagcctgccgcatactcctgcggcagacctgccgcagacagtcatctttttcacatgcaaattagttttgccgcagacttgccgcagacttgccgcatactctttcagtatgatgaagagtctgcggcagacctgccgcagacttgctgcagacctgccgcatactctttcagtatgatgaagagtctgcggcaggtctgccgcaggcttgccgcatactctttcagtatgatgaagagtctgcggcagacctgccgcagacttgctgcagacctgccgcagacttgctgcagacctgccgcatactctttcagtatgatgaacagtctgcggcaggtctgccgcagacttgccgcatactctttcagtatga

SEQ ID NO: 49201 - DNA, 724 bp, Oryza sativa
gaaaatataggtatgatcaggcaaatttctccaacagaaatacttcagcaaaaatattacattggaataaggatctcagtgaagtctaaaaacaacatatggtgaatggtcacaaacaaagaattgctgattaatttctatttccatgaatatatatacttcaacaaaaattactttttatttttgtgatgcacaagctctaaataggttagttttgttctgaataatttaacagatcaaaatggtgctgaaatcaatttggataaaccacaatttattctgattaattaggccccgttcacatatcaggaagcctgctcacgaaaaatgagggagtagctaaacccaaacattgaattgaacagatccttaacagttgaaaaggctaattctgttgtgagtataccttcatcactgccaagtttgtatccaggccatcaactttgactccatcaactgtggcttgggccaattcaaccttcttatagttgttcattgactcattaactaccttctgcaaggcactcatttccccaacaactatctcgccaacaaagagtctctcacctttattaattggtgataccactccaagattcgacagaacagtaaagggggacattgaatgccttccactgctagtgccaggttggttaactgagttgatcttctcgatgatatagaaccagctagtgtttcaagtattacatcagcctccgggaag

SEQ ID NO: 49202 - DNA, 2178 bp, Oryza sativa
tactaaataaaatgactttaactagcaaatacaaaattacaactttcacaatgatgaattaaaaaaaagatgttaaatgaaaagaaagaaagatcaccttctcaatcacgattgatcaaaacaaaccatttaaaaaataacccctgaggcatttataatgaaaaatatgaagatatgaatgggagtgggagagatgtttcaacaaaaataaagaacgtcgaaagaaagagaaaacataaaatgaaatatttaaatatatcagacaaataagaagaaacatgaccacattatctcttattcattctacctccaattttcagactgttttcaaaacaatatcatgtgtgtcgatcatagttctatgaagcttgatgtctcatggtaatttaagcaatctaagcaacaatttctgaatttttgcgacaatcgttcgcctttgctgctctttaatactattatgacgtacagtaacaaatttaacagttgattccacttggttgattctattgttcgggttatttctcatggcttacgactttgcgttagtagttgttcatcgtctctacaatgctattttaacaatatttggtgacaaaagacggaatttccatgtagcttcaaaagccatcaaataacaaaaacatggcagataaaaagatcctcagtactgggtctaataatttaaagaacacttaatttgaacccggccatattctctctctctcactcgtttgtcattgccttcattttccctcgcttacttcattcttaccacggaatatgtaatatgtatgtgtaggcctcattatgttaattagggtcaatggtcaaattgtctcaatatatcttccatacatccataatgatcaaggctaaacagtagaaacttgacatatggatagatcataatgggagaagcattttatataacaatatgacatcgtgaaaatgcattcttcattatgtaaatcatgagcgtacgtatcacttaattcgtcaaagtgacgaattaaagtctagttataattattatcatatcattattatcatctgtattgtcagcataatctacaatggcagtagtgtagtatagtacatgtagagttaggccttatagtagaggtatcattctgatcattattattctgattatcttttgcaaaacgtctagacgataaactcatgacaattgacaattgtcatgaatcattgtctttaagtttaccattaaatgcatctggttcgagttttgctcaggtatttggtactggatgatttaaaaggtagaaattaacttgtgacctattcattctagtcttattcatttgcgttatgttttattcattcaagttctaatgtttctgactgttttcaagacatcatacggtagttctatgtagcttgatatctcacggtaattttgagagaaaagcaatgcaagcaatgatttctgaattgtagcgacaattgcgttcgcctttgctgttcttcaataatatttgacaagcagtattaattaatttttcaatgactcatgataaattcgtttaacaattgattaccctctgttgattcttttgttcggatttttttgcggggaaaatagaagtgaatgtattattattcttatttgttcatcgtctctacgatgctctttgaatcaaaaacagcttttagtgttaggcttcctgaaagaaatttcaattgttgttaagaattttttggttgcactctgtagattatgatgatgtgtttgatctttttttcaatacaagatcaaacacatgatgaaaatctactggctgcatgccaataagttcttgacaacaataacaaaacgtgagctagtgctattcggtgtgacgtacacatggcaatcacatggtagatacaattatgatcatcagtactgggtcaaataaattaaagagaactgaatttgaacccgggccataggctatcccctctcgctctctctctctctctctctctatctctgtctaccctactctcatttccccgtccataatgctttctcaattctaatgtgttctttttttcttgtatcttttccatgtcgtatacaacacggacttgtggaccgctacaggctttgcgtcgacacacccaacgtcatggttgttcctccctcggcttcagtgacaaagaaacctacaa

SEQ ID NO: 49203 - DNA, 14241 bp, Oryza sativa
catgcgtccagcttgatcgcgcataaaaaagaaagagcaggccagacattccacaggcaggcctgcgccatgccgtgttctttttcagagtaagataaggtttgcggcaggtttgccgcagacttgccgcatactctttcagtatgatgaagagtatgcggcagacctgccgcagacttgctgcagacctgccgcagacttgctgcagacctgccgcatactctttcagtatgatgaagagtctgcggcaggtctgccgcagacttgccgcatactctttcagtatgatgaagagtctgcggcaagtctgccgcagacttgctgcagacttgccgcatactctttcagtatgatgaagagtctgcggcaggtctgccgcagacttgctgcagacttgccgcatactctttcagtatgatgaagagacctgctgcagacctgccgcatactctttcatatccagtacgtggcaataaagtatgcatgtagaagaaccagtgataaactgattgatacttcataatcaatattggcaatatcgatattaccaattaggtaataccaatatatatcgatattaccaattaggtatattctattctcaattgtattaacttcatcacattgatcatttgaagtgtattcaagagtaacatttaaagtgacacaggctcgtacacatatatatactaaatatgtatattgtttcttggttagtaatcatagtttcttggttagtaatcaatatatctattgcttaaacgtgaatgtaattgtaacatgatcagacaaaataatctattggttaataatggcaaaaggaaaatagaaatcacaaaaatgatgtgcattgtcttaatttgcttaacaaatcatgataaatgtatttttctgtcacacgtgtaaagtaataatgaatatgcatgagatgattggtttcaattggccctattagactttaatgggatttcctgtggcagacctgccgcagactgttcgtgtggcgtactggtatgcggcaagtctggagcaaagtttcatcctgccgcagatctgccgcagactgttcctgtggcatactagtatgcggcaagtctgcagcaaaatttcatcctgccgcagatctgccgcagactgttcctgtggcatactagtatgcggcaagtctggagcaaagtttcatcctaccgcagatctgccgcagactgttcctgtggcatactagtatgcggcaagtctgcagcaaaatttcatcctgccgcagatctgccgcagactgttcctgtggcatactagtatgcggcaagtctggagcaaagtttcatcctgccgcagatctgccgcagactgttcctgtggcatactagtatgcggcaagtctgcagcaaaatttcatcctgccgcagatctgccgcagactgttcctgtggcatactggtatgcggcaagtctgcagcaaaatttctttctgccgcatacttcggcatactctttgccgcagactaaaagtctgcggcaggtctgcggcagatctgcggcaggtctgcggcaggtctgcggcatacttttcactttcctatgggtatacttctttcaactttaagtaaaactaaacatcaattatagatgtaatgacatattaaatgtgcaatagatatctctagtctatcctatgtgtgggtacacagtatacacatgttatacatttgccatacaaattactgtgctactgtgtaagtttcatacaatgtaaacatcttaaaaactacctttttgatattgattttcataatgctcaaatatgtggtttaactaacctctgtgcctccataatattgtagaaacagctctcaggaacaaaggatgctccagaaaaccacagattttcctcacataacagaaatcatgttgcaaacatgatcatttcaaatcagccaacaacaggtggcgccaaacaagtttctgaccttcaaactagaaaaactttaaataagaactgtcaaagtaatctttgaccaaacgccctctgttgttctattattgcaatgtcaagctaaatcaataaatactaaataaaatgactttaactagcaaatacaaaattacaactttcacaatgatgaattaaaaaaaagatgttaaatgaaaagaaagaaagatcaccttctcaatcacgattgatcaaaacaaaccatttaaaaaataacccctgaggcatttataatgaaaaatatgaagatatgaatgggagtgggagagatgtttcaacaaaaataaagaacgtcgaaagaaagagaaaacataaaatgaaatatttaaatatatcagacaaataagaagaaacatgaccacattatctcttattcattctacctccaattttcagactgttttcaaaacaatatcatgtgtgtcgatcatagttctatgaagcttgatgtctcatggtaatttaagcaatctaagcaacaatttttgaatttttgcgacaatcgttcgcctttgctgctctttaatactattatgacgtgcagtaacaaatttaacagttgattccacttggttgattctattgttcgggttatttagcagaacgagatagaaattgacattctcatggcttacgactttgcgttagtagttgttcatcgtctctacaatgctatttgaacaatatttggtgacaaaagacggaatttccatgtagcttcaaaagccatcaaataacaaaaacatggcagataaaaagatcctcagtactgggtctaataatttaaagaacacttaatttgaacccggccatattctctctctctcactcgtttgtcattgccttcattttccctcgcttacttcattcttaccacggaatatgtaatatgtatgtgtaggcctcattatgttaattagggtcaatggtcaaattgtctcaatatatcttccatacatccataatgatcaaggctaaacagtagaaacttgacatatggatagatcataatgggagaagcatttatataacaatatgacatcgtgaaaatgcattcttcattatgtaaatcatgagcatacgtatcacttaattcgtcaaagtgacgaattaaagtctagttataattattattatatcattgttatcatctgtattatcagcataatctacaatggcagtagtgtagtatagtacatgtagagttaggccttatagtagaggtatcattctgatcattattattctgattatcttttgcaaaacgtctagacgataaactcatgacaattgacaattgtcatgaatcattgtctttaagtttaccattaaatgcatctggttcgagttttgctcaggtatttggtactggatgatttaaaaggtagaaattaacttgtgtcctattcattctagtcttattcatttgcgttatgttttattcattcaagttctaatgtttctgactgttttcaagacaatatcttttgtgtcgatcatagttctatgtagcttgatatctcacggtaattttgagagaaaagcaatgcaagcaatgatttctgaattgtagcgacaattgcgttcgcctttgctgttcttcaataatatttgacaagcagtattaattaatttttcaatgactcatgataaattcgtttaacaattgattaccctctgttgattcttttgttcggatttttttgcggggaaaatagaagtgaatgtattattattcttatttgttcatcgtctctacgatgctctttgaatcaaaaacagcttttagtgttaggcttcctgaaagaaatttcaattgttgttaagaattttttgcttgcactctgtagattatgatgatgtgtttgatctttttttcaatacaagatcaaacacatgatgaaaatctactggctgcatgccaataagttcttgacaacaataacaaaacgtgagctagtgctattcggtttgacgtacacatggcaatcacatggtagatacaattatgatcatcagtactgggtcaaataaattaaagagaactgaatttgaacccgagccataggatatcccctctcgttctctctccctctctctctccctcttcgtcgccttacttttccctcttttaactccctgtgcatttgtatgcctcgataatacagaaaataaacaataagattctccctcttcctagtacatgtagtaggagtagtattagaagcagtatcacaataataatgacaacaattattattatggttagtggtgttactaatgttatttttgtaattatcaggtgggctgtatatcgtaaagaccaccttataatttcgttattgcctttgtttatttatttatttattatcaggtgggctgtagatcgtacagaccaccttataatttagttagatttgcctttattatcaggtgggctgtatcttatacagaccaccttataattttgttaaaatcgcctttattattctttattgttaggtgggctgtatatcgcacagaccaccttataatttcgttagaattgcctttattatttatttattcatcaggtgggatgtatatcgtacagaccatcatataatttcgttagaattacctttatttatttatcaggtgggctgtatatcgtacagaccaccttataattttgttagaattgcctttatttatttatcaggtgggctgtatctaatacagacctccttataattttgttaaaattgcctttattattaggtgggctgtatctaatacagaccaccttataattttgttaaaattgcctttattatcaggtgggctgtatatcgtacagaccacttataatttcgttagaattgcctttattatttattttacttatttcaaaccacttttttgtaagcacgattacttgaaaatggctcaatcaaatgccttcaaatttggcacacatttatgtataggcatatgtacaaaacacaataacgttttcaactatgacctttactgatgacgtcaactaggcgccattttgtaaatttttctgaaaatcaacttatgatcatatcttcataaccaaagccattttttattcatatttttcatgattgaggtcaatattcgtccggtcaatttcaggtcaaaaaacgcgcgcgtgcgcgtacgtccacgcgtcagtgcgcgcgcaaaatattaaaatgctcaaaatagtctcaaaataattgtacatacgttttaggccattttaagcattttataaaaaaaatctcgcacacgcgcgttctggcattttgcaacaaagaatcgccaatttttctttgtcatcatattttgcacattttcccaagcattttgataccttgttcacatatttctgaccattaataacggagtgagcgtccgtttaagatacacgtccgtgcgagctcttgtaatacatagcatatatgggaaaaaacatgcctatacaaaatctattgtaactctttaggatgcaaggtgaccccaattttgttttcatattttgatagattatgaattggagatatgatttcatgtctcatgtgaccctcaattaacgcatgacgtcttcataatggcctccgaactcaaaattccaatttgcatattatgacgtcagcatatttatggaaaattgattgtatctctgtaagtattgatcgattttcttccaaattttcatatgttctagctgagacaattttctacaaatgcggttcctattatttttcattttgacaaaggcattatggcggatttttgcgattaaaagaggcatatcaatttttcaaattttacgtgtattctcaataggacatgagtttttctcaaaactggattctacattcccgtctttcgcgagcaatatctctgtcgttttagcttcgtttacgctgaacttcgagtatgttgtagctgagacaatgagctatctcaaatgtgccctttattttgtctcaaattttagttcgaccagtccacctatacttgttccaaacaagtattacaaatttagttattctttcttatttctaaccacttttttgtaagcacgatggcttgaaaatggctcaatcaaatgccttcaaattctgcacacatatgtataggcatatgtacaaagcacaataacgttttcaacattgaccttgactaatgacgtcatctaggcgccattttgtaatttttttggaaaatcaactcatgatcatatcttcataaccaaaagttttttctcattcatatttatcatgattaaaggtattacaaagttttggtatgggatcatgaatttggttcaaattaacatattggaagcatatgcgttcctacaatattcattgatcgttgtcgcgattgaaatcgagtcttaagttatgaaattataaataataaactctttatgttgtatagctccctctcaaggtcaagattttaatttagctatgaaacaatgtttcttgactaaaatcgaccgattagctaatcccatttggaaattatatatcacaattacatattctgatattttcatggtcgcagctcccattgcacggccataggcgctattttaactttgtcaaaatttaccgggagcaccggtaaacttttatattcaatttttctcgaaaacagaagtgttttaggggctaatttttttagtgcttataatacatccacaggggcatccaaatatatcaaaattgtaaagattcactatcgacccaattttcaaaatttcccaaaactttgtattacctttaaggtcaatatccgtccggtcaatttaaggtaaaaaaatgcgcgcgtacgcgtacgtccgcgcgtcagcgcgcgcgcaaaatttaaaaaatgctcaaaaaaactcaaaatcatttagcatacgttttaggccatttacagcattttataaaaaatctcgcaaacgcgcatgcgcgcgcgttttcgcgcgtcctgacattttgcaaaacagaatcgccaaattttcttcgtcatcatatttagcacatttttttcaagcattttgataccttgttcaccttttcctgaccattaataacggagtgagggtccgtttaagatacatgtcagtgcgtgcgagctcttgtaatacatagcatataagggaaaaaatcatgcccatacaaaatccatgatatgttctagctgggacaatcttctacgaatgcagcgttcacaatttttcattttgacaaaagcatcatggcgtatttttttcgattaaaggaggaatatcaatttttcactttttgcgtgtattctctatgggacatgactttttttcaaaactggactctacattcccgtcttttgcgagcaatatctccgtcgttttagcttcgtttacgctgaacttcgagtatgttgtagctgagacaataagctatcttaaatttgccctttattttgtctcaaattttagttagaccagcccacctattcttgttcaaaacaagtattacaaatctagttattattattatcatcaacaatgtcaccggagcaagtgtcgcttcaggcggagcaaatgtcggcggagcaattgtcggcggagcaattgtcaacggagcaaatgtcggcggagcaattgtcggcggagcaaatgtcggcggagcaactgtcgttcgaggagcatttgtcaccggagcaattgtcgcgttttgcggagcaattgtcggcggagcaattgtcggcggagcaaatgtcggcggagcaattgtcggcggagcaattgtcggcggagcaaatgtcggcggagtaaatgtcggcggagcatatgtcggtggagcaaatgtcggcggagcaattgtcgcgttttgcggagtaaatgtcggcggagcaatcgtcggcggagcatgtgtcgggttaccatataaagccaatgtactcttgacgaccgccccccccccttcccaattcgatttgtgtaaagtaaatttgataatagagagaaaagtgatgataacgataatgataacaatgatgataacgatttttttttttttaaatctgtttctgtcaggacaatacaaattatacatttattcccatggccaatggagagacttttcgcccagacctgtctctttaggtggccataattatataacccttgtcaatgtttagatcaaacagaggttcaactcacccgattttgttctcgacagagtattcatatatatttttaccctaaaaatacaatttcacacttgactgatttgatataaatgacagagattattgccacgtacaagaatctgtagactcatttcacaaaaacttgcactgtattcgttcaggcatatagaagcgctataaactgtaagtcaacagcaaggcagcgacgtgtacaaacctcaattagcaattgaatattgggcaaaaggcgttaaaagtagcaaggataaacgaaaagagagttatatttatacgttttggaagttgaatgtgatcatttatcagtgaattgggtaagtacactatcgtgccactatttgtgcacacttctgttccaaacacttaaacgtgtagacaagtttcatataggttgatcaaaataatgttaaatatacttgattacgtggtgttctactttggaggttgatatagcatgccttctctttgagcatttgacgtatacatgctgttaaagtgactcggtaacattgttgaaggttgatgaaaaacattgcttaatttttgtataaaatgttacttattatattccttctactatactaaccctctgacatgcaaaaaaaattcctgaacaaattctcaaaccacaaagatatctatagttttctttgaaggcgtcgatgtgaggcaccctctaacagtgaataacagtaaattctcccaaccatttttgaattttcccaaccgtttttccgtgagaaaaatacataaaacaggctataaaaatctgtcaacacttaactgtcctggaatgaaatgtagagcaattttattgctttgtgacgatttacattcacctaaaatgtaattaaattgtccttgtcttgatgctgaagaggctttgacaagtagcagaatagaagtagaataatatagttgggagaattaaggaatcgatcagatcagtttttcccaatttgtaccatgaataatgatccgttttcactcaaactttcagattatctttaattgtacatctagcattgacgtcactaccttagtaccgctatctttcatctgaacaatgttacaaagtccctttaatctattgacaaagctgaaacaaaaagtgttcatggtccattgaaatgtcaatttgtgcagtttaatataggttatgttgatgatcaactgtaatttattatgtagggtttatttatttttgggaagtaaaataaccatttcaggtttttatttttcataatgatataaacatattcacattttcagcatttgcctccatttctggagggatatacatggttttataatattttcttctatctgtaaacgataatttaataggtaaatcaaaatatgaagaagtctctcttttggtcttttctttttaagttcttttccaacaaagcttttgtatatagtaaaaagtgcataattcaaaataatatcaacacttttttccttctttgaattaaaatcaataccaaacaatacatgacatggtttcaaattaaaattagacatgaaatatttctttatatccctttaaacttcactccaaaacttaatgacttcgttacaaataaaggaacatgtgcataaaatcacctgtttgattacaatataataaaattgctcagtggcatttaccttccatttaaacaaattatatggtactgcattttcagtttaacttaataaaatttggatttgactttaaaagattattattattattattattattatgaatttgaaatttaaattaattagtaaactgtcttttataccttttaacttaaataaccaattcaggtacatattcaatttccaaagtattacggcaaaattcctcccctctagattcttcgatttttgtattaatcaactcatgatatattcttttaactgtcaactgtctaactgaaatcatatcctcaaccaattttatatcattatatacaaacgctgtggatctaaatgttatatactctctatgttctacattcatatctgcaagtacgaacacatatgttgaataattgtctcgcactgcctcacggttatattgggagcatgtgattgtattcgatgaaggcttgcagagcaattcttggactataattatcttttctacgcccagctttaaaccttaattctcttcgggtgcttaatcaattgtgcgttatgtttaatgttggttaaacttcatgcgtcatgttgtggtgtgcacagtacaagcttcttatatacgtatcttacataattaagttttgtttagtagtattttagtgtattttgtatacttttttaaaaacttttgttttttgttttcgtttttttgttttgttgaaatggtacaacaatttccatgcgttcgctgtagtaaatgtgttaaagcaaatcagaaagcacttctctgtacttcttgccgaaactgggtacacatatcatgttcagaaatctctgtaaagagttacgatgaccctaacgagcattttgtaaatttggagtgttcaagaagtcttttaaaccatcttccaaattatattgtgaataattcagagtccgacgtcgacgattctaataacatagatccctcatgtaaatctggtgagaacatatctttaaaatatgatcaactttctagtaaagggattaaacttgtccacctgaatattgtaagtcttttgaaatatcatgaagaaatcaagcaaatcatgtttgaaaatgaaatacaagttcttgctctgaatgagactagattagacagctctattgcagacagtgaaatgtacatcccccattactcattacttcgtaaagatagggatagaaatgggggtggagtggccatttatgtccatgagtctattcatatcaacttagtcatgattctcttgaacgtttagaagcattgtgcataaaagtttgtttgaagaacacgaagccaattatttttgtaaactggtatagaccaccaaattcaaaagtcgaggtctttaatcactatgaggactttttggtttttgcaaatggtctcaatgggcaactcattattatgggtgacattaactgtgatatcacgaaaaaaccttttgaaggatatacgtaagtctataatcaaataaattatatatattgtttgaaacaggtaaatgatacattgtatacaagagtaaccgatagatcctgcatacttgttgaccatatgttaacggattatcccgataaggtggaatcgtttggtgttattaaaaatggtatgagtgaccattatatcagttacttggtgtggaaatgtaaacatacttcccaaagtgaaacatttgtatcgttcagaaagtcgagaaatgtagatttagaagctttcaggtctgatttgcgtaatcaaaactggaagaaagtaaaagagtttagtgatataaatgatgcagttagtgaatgggaaaagttgctgttggaagtagttaacaagcatatgccattaaagacaagacgagtgagaaaaaaacccctccccatggatgaatagtgaaatacttactttaatgaaacagagagataaagcaaaactgaaagccaaaaagagaaacagtgatgacatatggaaactgtataaacgcatgaaaaataaagttaccaccgagataagaaaatccaaacgtaaacacatatgtgataaactgtctgaagtcaccaatagaaatgaatcttggacaacactcaaaagtttaatgggtagttgtaattcttctaacagcacttttccaaagaaaattcaagtgtaatagcgaatgagtttaataaccactttgcagatatagcgacaaatgtatgcacaaataacacaagggctaataaccggctttattcccatggtgaaaaggtttctgacagaaaatttaaatttgttaatgtatctcaatcttatgtcttgaaacaagtaatgtcaatgaaaacataaaagtccgtcgggttagacgaaatttctatgtatattcttaaaaagtcaatatctgaaatgattgaatcttttaactttttaatcaacaaatctttatcggaaggggttgtgcctgacaaatggaaagtcgcaaaagtaataccaatacacaaaaaaggagataaacttgatttcaataattataggccgatctcactgttgccttgcgcctttaaagttatggaaagagtcgttcagcgacaattgcttgattatttaaagtgtcaacactccaccgtgacagcactagccgcagtcacagatgattggttttactctatcgataaaggtaattacattggaacaatttttgtagacttgcaaaaagcatttgatatggttaatcacctaatccttgtatctaaacttgaatctatgggtgtaattggtgtagaattacagtggttcaaacactatttatcaaacagaagaataagaacttcggtaactacgaaaggtgtgccgcagactataatcaccttgttgttgtacctctttatgtatgtttatatgatgtttgttttgtttgtttgtttgtttttgtttttgtttttgtttttgtttgtttttgtttttgtttttgtttttgtttttttgttttgttttttttcttttaagtatttgtattaagttttcgactgatactatgtatattttgtatattgtaaactggccccatggaagaccagcagcaacaattatagttgcagctgaatatgggcaaccagccgtatatttgtatttgtatctgattttttttattatacggaaataaaaacaacaacaacaacattcccaagtaagaagaagaggacgaagaagaagaagaatggaaacattaatagcacccacaccacggttacagcatgcctacccttcctaccagttcccatttttatttaacacatgggtttgaagagagccaaatgaaatacaatgtcttactacagatctagagtacatagatgtactttaggccacttaagaacaataataagtttcatgtgcccccctctatctctctttctttctgtctctccatttctagttgacatttcggtacaatgggagtaagtagggagtatctgatcttcagtgtagcgacgattgcttccgctacctttgtgattcttaccatatattcgggaatggaaaaacatgaaaaaggtagatattatgtttatttttctcttttaatcataattttgattttatttaaaggagagggggcttgggtaatacctcagtcatatctccagaccgactcaacactgatctatgttggcctttagggataatgtaatgctttttttttcgggctgttaccggtctgatgtcggtctcagtggtatgactagggtagatcaggccccctcttaaatttttaaaaatgcgatttattctaattaatcgcaagtccgccaatcaatcgcaagttggcagtctctcatctcgtatgtgcatagttgctattgatatcaatcgcaaatacgattaatcgcaactgttcataagacagggcctaaatagaagcccctactacatagtcaacacgtccctatgtccacgaagtgacggatgagcgcgcaattaaaagaaagttagtttcgaataaatcgctttttcaaaccataatctcaacctctttattgtatcaagggcaaataaaataatgttatatcctgggatacaacatatctcaatatttagttctatgtttaattatttccatattttcttatacagtgcgtcccagaaaaaacgaaaccgagaagtatcgatgttttatcataacttaatcacaaccataattaatgaatgatacatatttggaaagcttagagtctcctctttcagttgatgctactccgatgatgcatatttcaggcatgagtgattaaaagcaatttgaaggaaggaaaccaaaaagacatttggcgggcggtatctgaatttcgaagtaaaattcacatttctagaaagttgagtttctgccctttcgtatgacacctcaatcaggaaaaatgagcgaggaata

SEQ ID NO: 49204 - DNA, 22765 bp, Oryza sativa
tcaacgaaacggagttaagtctattgttaatttcgtttattgatacggcaggcagccagtgaaaacgaattcgtttaataaaattatggaaatgcaagcactactttaaacaaacagaactttgtcattcctcgctcattttttttcaattatagttgtgattaagttatgatagaacatcgatagaagacgacttacattaccattctcgacttcttaatccttgtctgaattcagtcccccccccccctcccccttcctcctcctgggcgaagcgcggaagctttgacgtattattagacaaagacgattcgctgtacctcagttcccgactctttttccctctttcttcgtacgtcctcttactttttttcttctctttctctctctctttttttttggccggcgttttttggggggcgaccgcccccaccgcccccctggctacgcgcctgttaggaagataacgttaccactattagactacggcaatgtattataagaatgaagggccaccaccaaccctagcagggttgttatgactttcttctgtccttcaatcagagcgataatccttccgtctgtggaccacgctgttgaggttttttcataggcgatgttggctgttttattggcattttcgtgttggttatattatacgcacaaccagccggcccatgtattgtcatttttaattaaataattaattaacggtcaccgtatttttttgaaagtggagctgaattggtatgattattttggggtctaaagttaccttcatagcaattttaggttctaaaagggcactagaaatgtcatagataagaataagagcgttaaccatgcactttgaaggcatttgcggtctgaaaacagaactcaactatccctttaagtgatgcacagataaaataacccggaactgcgagatagagtacactttcctctttctgtagctgctttattattcccctgtttgaacttttacatagcttggctacatcgtttagattagttttattttgtttcctatttcatcatatatatatatatatatatatatatatatatatatatatatatatatatatatatatatatatatatatatctatatataataataacattcaatttggataatccttcgtcaccctcattttacaaataataattaaaacgagggggatttttcattagtgatcaaaatactttaaacagctgaatgaaggattaaactttctgccaaagtaatgggattatttagaaaattagtaataacaaatgtggatatgttgccttgcattcctccgccattctacacgcgaaattaacattagagttttggtgtagctcatagaccaaaattataattagagtgtctaaatcatttagggattatgcgagatttctcatattggctagatgtaaaaagtgattttaaaaaaacacgtatttattttctttaaccatgtacagatcgagttttacaaccaagaatcacaatgtcacaacggtccaacgatcactttctgcagaactgtccggcaacccaggtataagaatgctcaggagcaggcgcgtacgcaggggtggggtgttttgggagttgaacccccccccctcaatttttgtaagggaggtgtttttaagaaccccccccccttcaaaaaaaaaatgaatacatttttttgtgggtgctaaagggtgacaaaaaaaatgagtttaccccccccccccccccctacaaaacgaaatatcggtaggcataattttccaattccccctcccttattcagcggctggctgagtccttcgaaattttcggcgcgattttcaaattttaaaagcccctcctcgaaaaattccggcgtacgctactgcttagaattatgacaaggccacccaaacataggtcgggtcggggcaaatgggtgagggggatagggtgctgcagtccacgagaattataacaacatttaatcatcacactgtgggcaccaagatgacgttttttcctttctattttcattagtggtggaatttaagatgcgtgaagtatttatcataaggtcatcactttctagtctttaatttcttcccgtaataaacatctcggctcttatatgttctttcacgtgaatctagatcgaattgaagctagatctacattattaagactgatcgcgccaacaatctgaaagtaagaatgaaggattataaagaagcaatgtacctagtcgtgtgtattctctcaaagttgggaattctttccttctcattctttatttccctctctttctctttctcccacaaacatgtatactgcacacacgcacgcattctctctttccctcccatcaccgctccctgtcttactcttttgcccctctttttctctctctatataaatattttaattcctccaccccccccccccccacctccctcccccattccccttctctctcttgtttgtctctcgctctctctctctctctatctctctttctctctatcacactaacgcacacacacacatacacacactcgtacacacataatctctccctctctctctctcgctctctctctctctctctctctatctctgtctaccctactctcatttccccgtccataatgctttctcaattctaatgtgttctttttttcttgtatcttttccatgtcgtatacaacacggacttgtggaccgctacaggctttgcgtcgacacacccaacgtcatggttgttcctccctcggcttcagtgacaaagaaacctacaagctgaacaaaataattacaaatccgagctaccttcggaatatctacgtctccgaaagataccgaaccatcatctgtctcattccgaaagcaaccagcatgaactgggtgagaactctaatgatactagagggcgcgatcaactcgacgaatggcttggcgccgcaagaaatagtacatgcagccaagaagcatctccgcgtgctaggccagtataaacctgacaagaggcttggtatattacggaattactcgtcggcgatcttcgtgcgcaatccgtattcccgtcttctgtccgctttccgtgacagactggagaagtaccccaatcggaatctgtcacatcgtaaatggtttaacaaaaatatctatttgaagttcgggaaccattctcccgcagagatgccggatcggtcgatgccaagcgagaaatacaacgtcactttcaaagaattcgtggacttttacctgagtgtaaaaaaaactcaggacgtgcactggcgagaacaatacaaagtctgcccaccatgtttcgattacgattatatcggcaacgtcgaaacgtacgcagacgattttaagcaaaccgttcagatatttgatgccacttcgaaagtgccacttgtgaaagcgccacatgcgaccaatagttctgaggatggcgtcttgcggaggtattatgaaacactgtcggatcttcaaatgaagaagcttgaaaagctgttgagttcggatatgaaattgttcggttattcgattcctcgagcaattcaaagaaattcattttaagcctcgttcacatgcacaaaacgcggcaaaaccgcggcagaattttaaccacgttaatgatgacgtagagtaatgcacttcacgttgctgtatcttatgacacagctagagctcggtcaatatgcgcaggatcttcgtggcacacagtttaattaatttaaatttaaatttaatcgtatttcgtttccagtggttcaccgcggcatatctgaacaagccttcaatgtcagtgttgataccttccaattaaagtatcattacacatgttaagcatgatgtattactccatatccttaaaaaaaatattttaaacaaatcatagatatataataatggtataagggacattatagatgctatgttattggacctaattatgttcatgaccaatgattagataagaaagtctagatcaaacggaaatatatatgtttgccaaaaacaaaacaaaacaacaaaaaatcgaaattgtattgtcgaaaaatacatgtcaatataacgagtacaaaaaaagcaattgtatttccccttttcttcattattatggctatcgctgtcacacatgtttttcctttcaaaaagtatatacaacattatgctattaaagctccggagtcttatctcaaaggagaatgacagcccacgagaccgccacagccggtctcgttttaaggaaggttaaggtttgggatcaggtatagtaatgggtctacggttgaagctagaaattcgagctcactttgatccatcagatctccgcgtcggatttggtcgttaggtttactttcgttaaaacatacctctatattcacgaaaggtctggtaaattgagagcaaataatcaaaacgattccaaagatgactctttagatgtcactctaaatgtacatttgtgaaaacatgccgatacacccagaaaatgacgaagtaccgatcgctcgccttttttaacgaaatcctatgatcatttatcgcgtctcgcggtgaacgaaatattgtgacgagaataaacgaagacagcagtatggtcagctttcaaacgtgtgcgctatcagccatcaaatcggaaatatcgtcaatcaaatttactgctatgtttaaacatatcaatgataacaatatgtcgtcaatttgtcacgaattatcatctaattaaatgaccaagatgaaaaggttcgcagtttgtgattcaagagtaacccactgtcgctcagaagatgtgtcaaatattctgatacgatagtggtactactccacatccccgagatttaaatgaactgagaagagaaataaatataacttgcattgtgatctttaatattcatttgagtttaattgaattgaattgaattcattattcttctgcaaaattaaattaacaattcagcaatataacatatttactacacacatttatctactgctttgtcctttttatttatgtggtaatgtagaaatttccttatttgtttgttaaccaaagtatttagagataccatacgtgtgaaagttttaaacatgtagtcagggaccgcatcactaaaatggtcttgttgggactaggatacattcactgagttcatgtagttttctccaattttaatacttgtttactttttatatcatgaatcagacgccgaatatgttttaattgtatgttggaaaaaatttattttcaggtaaattctatgtacattatagtttgtaagacgagaagtggatgaatatgtaagaccttggtcaagagagagggtggataatgagagatgataatgctgaaggtgtcagtaagaggaaggtcaggaggttccgagtttaggagagaattgtagtgaatctactgtagtttcgaggaatgtacaattaaaatcacatgtgattaaagataaactttagtactggtattaatgcgatttttttttacaaaccaggtttgtaaaaaacgcgtcaaaacgcgtcatatgacgtacataaacctcggtttgtcgacaaacctcctttgtgaattcgggcctgagtggctaacggtgataatgtatagttcgactagcgcacacttgctgcacacagacaatgggttttgctccgtgagtgtgagtttgctcacgcatgtataaaaagttttactctttaaatagacaattgagttatgtttaatgagatgtatatagcagtagaataattaaaggaattatagtacatgtaattgagtgtgagatgttataaagtgatttagtaatagcctacagggtgcacagtgaagcacattgttgaatgttgctcggcatggttttttttcgttgtttatttagtggatggtgactagtctaggtgtcagaccttacttggtcagaaccagttcatgagtatacatcaaattatatggttttgatatttacaactatgtaatacaataatatcatcaatagagatatgttttgggttgggttatatagtagaggatgcattagtgcaggtagcattggccaaatgaccatactaaatgattgatatgtatgtcttaaatctctagggggtctgcagtattagagacctgtgttcactagcagttagcagcaccttaattattgagtagttgagctggatcacagccgaggatactccaggtatgagttagtcttttatgtgaatatgttgttaaaagacaaaggttatattggtagttttgttttatgtaaacaaaagcttaagtagctaattatcattatgtatatgaatgtcaatagacccatgtagtctttaattattttgtatggttactcacgatactaggagtatgagtcatcgctagtagtcacattattattctttccattgttgattcattatttacccttgttgaagatgcaaattgtcgttctgtgattaaattataggggaagatgtattctatagtagtcgtagttataagagaagtatatccggaatatcgattatgtcacttactaactatacactgtatgatggttcttcataataatcacattatcagttattcaagttcaggatacattgtaataattgagtattttatctgaaacgactttaaagacttgtgtttctgtggaaacacacaatacattttagttgttgttcattgtagttacagttatattgccgaaattagtacctgcaaacaataaggataattgtattttgtttcaaagagttcacatagttccagaagagtgactgtatagaatggcaaggggtgagactgtgtctaacagtggttgttgttcagtttaaaccttagttgggtgagtcagtcagaatggccaagttatgttgattgtttgttttaaggaataaacagttggattcatttaattggattgatgttaacgaatagtgataaaagagtcatatgttcatatggatagatagatgatagataaatggtttattcaaatcaaatcaaacatgtaaacaataaatgttcattaattccatgcttcgtagctaaaaactaaattgcgcaatggattacagaattaattattacaaggtaaaattgcacttactaataataaactactatagataataatgcaactcttggcaccggcgtcgaaccgctgccatgtgtttctataataagataacagatgatgatgtacatgtatattataatcagtgatctaatattgatgcatcatcttgaagtgcttgaagatgaccgtggcctctgccgagtttacaaaataaaagaacaaccatgcaactgcattgtattcaatgttaaataagatataagtgaagtgattaaaagtgagcatggctgaattaattttgattgaaaataacaaaacatatttagtgaaatatttcgtgctgagaagtgcatttgtgcaaggtgcaaaaatttagcttggtggaacaaaaagagacttaataccgtgatattaattgtgtgttggttttagttacgggtgttaataataaatatatgcagggtccattcctgttgacaaactaagacagaacaattcaagacataacacatttaaatttctatgtaaggtctagtaaacttgaaactgaaagaacagattattaaacaagtctcctcatttaactacctcggcagcatgatcaccgaggatgccagatgtgagacagagatcaagagaaggatagctctcgctaaatttgcattttcaaagctaggcaaaattctgacaaatcgaacaatgagtatgaggaccagaataagattattgaattgttacatctacccagtacttatgtatggtagtgatacatggacttcagcctctgatactaataaaagcgtttggaaagttgcaaaatttggtttttaagaagaatgatgaaaatcccctggactgacaaagttagtaatgaggaagttcttgcacgagctggagtgcaaaagaaactgatacgtgagatgttgattaggcagttgaagttcatgggtcacattacacgtaaaaaaggcctagagaatcttgctttgacagggaaaattgtggaaagaaggagcaggggaaaaaggaggatactttggatggacagtctgcagaaattgttggaagagagaggattgaaagaactgggagtggtactaatacagaaggctaggaaccgagggttgtggaacagcatgatcgccaaagtcaatcgttatggcacttagagagagagagactaaactataaactgagttaacaaaaattaatgtgtgatgtgatgtatcatattttttttacacaactgtttagccatttttgcgaaaaaattccaagaagttctctggtgaaagagtctaggtcgtcagcgcactgtgtgcaagcacgtacatccagggaagggaagatgatagaaaggggaaaacaaggatagaggagaggatttggagaaggaaaaacaaggaaatacataaggaaagagaagaggataagtcaaaggaagaacatagaaatacaaaattgaagagctaagaggatcatagatctagactaaggaaaaacaggcaaatacataaagaaggagaaagggaatctatcagattaaaacaaagaaatagatgcatgacgaaggagaaaaggatagattgaaggagaaacaaagaaatacataaaacaaaagagaagagattagaataaaagagaacaaaataattacagaacgaatgagaactgggggatagattgaaggaaaaacaaagaaaattaacgaaggagaaaagggatagattgaagatttaaaaaagaaatacatgacaaaagagaagaggatagattgaagaagaacacaaaaatacataatgaaagagaagagagcaaggatagatataacccgaaacaaataacgagtatgtattatgtacaactccagcaatccaacaaaactgctgagggtaatgctagactctgtctctagtcgtttgcacagtatatttgactgaagtggctaaacagttgtgtaaaaaaaaatatgctcggccggtttgacctttatttatattccctacacttgactcaagccgccgaagatggcgttatcaacgaactcattatgctcaccagcccagcctaagccttcgcaagcattataatcgaatctcttttatcataattataggcctacataccatcgagatatattttaaaaagcaaatatctctctgtgtatctctatgccttatacaaaagtcatagacaccatcatgaactatgttggtttgtaatattaacagtcatagtgcaccgtgcataaaaaggattttcaccagcctggcgccaaatttgtcaacatgaagcgctttgaacatttaattagaatggataatggcgctatataaatctcatgtattttcatttttatcatgttttttgtgagcaaatattggaacaagaagagcaaaatcttggatgacatctagacccggtggggtcactcaatgtgacttccggaccgcaatgaccgttaccaaaatcgcggaaaaaggggtaaatttcaagcaatgtccgcggacaaaatattcctcgaaatatagaaaataggggtgcaaaggtgtcctcgaaattgataaataggggtcaggaaaagggaaaagagaaaaccgggaagaaaaattcttggagcagagttttgtccttgaaatatggtaaaataggggttaatttgcgaaagagtccttacaatcttataaaaaggggtattccaaagtacgattttgtccttgttttgacgtaaaaaagggggttaaatatcacaaaatgtccttgaaattgaccgcaataggggggtatttgcatttgtggtaacggtcatatgcgtcaccttctgcgaaagagtgaccccaccgggcatctagagcgttattaggatatctctaaaagagaacaagaagttcacaaacaccaatctctaaagcaatatatttgttataacaatagtgtagttttaattgtgtactgattgatattcgtagtatataaatctctacagcatccaatttgatatatacataaatgaacaatctagtttatgtacgtttttgagaagctatgctgtactgctataattaaaacatatgataagcaaacaaaacatttccaacttatacaccagactttctggaatagctgcttctgtttgaccatcattcctgtgatacttccactgacaaggggaggctttctaggtcttcatttagaagatcgtcatcttcagcagttacttccactgtataggaaagacttcctaggtcttgagtttgtagatcatctccagcagttactttagctgtgtagggaagacttcctaggtcttgagttagtagatcgtcttcttcagcagttacctcaactgtccttggaagatcatcatctccattagagacttctactgtatattggaaactgtccgcctctcgaattgatgtatcatcaccatttgcatgttcaaccgatatttcttctgcatatgggagattttcttgttagccattttcagtagaaacttgtaccgtacattgaaggatttcttcagtttgtgttttttagtattatcatgatgatgatcaccatatatgccgtttgttggaaccgccatcatgattttattccacttttcaatttcttttacagagttcaggaaacagtttttctctcttctgagccaaatttgcagaaaaattatccacttcttttcgtcattaaaggtacagtagcaacactgacgaatactacgtgaaaagatgagaaaataatgacaaaaggtggtgcatttaacaaccgcaaaatggttttaagaaacctgataggggcttgactctatataaaaaaataatattttgttcaagtcaaaattaatcattagcaagaaaacatttaagaaatgcaatgtgttcgaagtttgaaacgatgtaatttctttagaatgattcagtaataaaaagaacttaagaaatttggaattctctttaatatttatatttatataaatttgaaaatctaaaagctaaataaagaagaagttgacaataataaacgacattgtaaatacgtgtttttattctctaataatatcgtttttcattaagatttatgtaattcatgaaatcatcaaatattgatatgtatcattgatttctaataacaaaacaaaaacaaatatttgaaacatgcaatgcaatttgtatgtacattactgactcctatccgaattagcttcttttcttcctaaatgaaaggctcttcttgaaaatcagttgtcattgctattaaatgttaaatataatataattttgggtataatgtggaagaaaaggaagggggaaaaaagcatgctattttcatgcttttagattaatatcaagtatatgtatcatattcagtgctatacatatgtaatttgatcacgttacgtagtatagagttatgtggtacaggtcgccattttgaaaatgtttgaaaatcgacaatcaacaaactctgaaattgcgttcacttttcaattatgttttaaggtaattttcctttataatttacagatttatttaaaaattgatgatgtttagtaatactcttattcatatcactaaaagcataatgcgtgctttatttggatgctgccttaccgtaatatggtgattgaccactcactcatagcgtgaaaacgaattctgaaaatttgttacatattcctgaacttttagccatttatatgatagactggatgttcatattggttggtcattaacataagataggaaaagagtaaattttgcagacgtattcaaaacggaaatcatgagtcctatatacacacgggtatttgcctacaaacatgtggcgaacgtatgctggtctgttggaggcgatgcgtgggtttcgtatacagggggaagcccctatatagtaatagcggacggatcgttatagtgttggagatggagcttggggtgatatcggattcgtgtataataaaccaacgaattctgacattccattcgctttttaatggtgtttttaagtaattattcttcataattcatcatagatacatctagaaatgtataatagtaatactcctattttcataaaattatcattacaagcataattcctcatgctttatttggatgccgtttacaatatcgtcatggaccattcactcatatataggaaaacgaattctgaaaatgtgctacacattcctgaacctttagccatttatatgatagactggatgctatagatcatattggtcggtcataaactaaatataagaatataatacagtttgcagacttacgattaagctcgacggaacatgtcctactcccttttctaatcacgaggcgggtatgctgtgcgagcgtctgacagtctaaaacccaacaacattgtaataaaaatagtgttttgtaattatgatgtagagtgtgaggaaaggataaatgatgtttaaatataggattgtaaaacaaatatattaaatattttcacaagaaattaccaacttttatcaggaggaaattggaagataaaaatacaaggcatgaacataattatggacccggcgtttaatatctatcacgtttctataacaaatttgtcaacactatacaaccaatcaaatgcaagcatttcagtacaacttatattaaagctatcatgatttattattaataacaacttaaattgaaaaacagagccctgatttagcagaaaggaagaagaatactattgacttttaatcaattcaatattgaaattgcccttatattgactcctcgaaagtcttcatgatcgtgcctgcctggctaccatgactgccttcatcataagctggcgattggcgaccatatctgcactccttctgatcacttccctccactgctgtctattctgtgttgatctctatttgaggccatgacagtccattccttgatgttgtacaaccacagctttctctgcctgcctctagtctcctctttccttccactttcaataatttcatgtgctgctataggggccttccactaccccttaggatgttaccaagcaggtttcccagtttcaggctgactacctttccaaggagctctctcttggtgttaagttcttttaaaatacttatgtaagtttgcttgtcctttctgctgatcttcagcagtttcctccatgaccacatctctgctgccagtatgcagttgaagagcatctcatgtaacaaagtaagaaaatatgaattctgtgttgaactaaaggtcttagataatggggtacttcatttttattgcacatgtactatgtgtaggatttttaagtgaaagatagttttaataatatttgatcgaatgctgatcgctaaacaaaaattgtattgtattagaatagtttataatttcgttcttttatgagtgattccaaataaagttaccatgacatggatttggaggaagaaaagttgagtacgaaaggtttgaaatgatgaataaactaagcagaatcatcagagggtcttaccaaattcattcctactacacaataaaaagcagtcgtttattcttgtgactatagatatagggatgtcggcaatagagctcgctgaacagtcattgtaaatgtggtcttctagttttcaaaaataaagtgcttttacatagtaagtcagtcctctctttgttttgatttccctgacgaaccggtcactgatatttttgaaagatattatgctccatgaattatacatagtcacagttctattatcattattattattatcattattagaggtagaagtagtagtaatagtagtaattcaattcaatttattatttcataaaaaatcacaaacaatatattgtaatcgacgggggttacgattgggggtacatatcaaatacacagtgctttaatcatgttaattaggagactacccctcgatgttatgccagcttcagcattgtgccgaggctagctagagctcctcaaaacacatcagacctggtgtcatatactgacctttggaagaaattagaatagggttatgtttgaagattttggacaaatcaatatttcttcattgggattcccaaatgtttaaaaaaaaatagactgtcgtcatagaattataaaaaattatattttcgatgagccttaatgacagagaaaaggtcaaatagaatacgaggcgtattataacgtcacatccgtggttcgttgtttgacggatttaaatgaaagttgatatgaaggtacatggtatcaaaacacagcctaagttcaatttccgagtacgtaggtcaaaggtgaaaggtcatagctcattaaatatgcaaaaacacctaattatatgtgaaaacgtggttgacttccttaactagtaatataatagtttagtccaatggaggtaacttgttctgacgtacactgttggtcataatggtggaataattattttaccccaatttattgaataattttgacaatgattattcctaatagatgtagaaaatagtatacattctcagattttattgaatgataattggggagtgtttgttttgcgtgactgccaaagcatatgtgtgctactatgctaatcaactaggggacctacgtccttaagtcataactgacagtaatggggatcaatcatgaaagggcactaatatagcacatcgacacggtttttgattttagaaccacattagacgccttttcaggcacttcctggagtaatatgacataaaattgccttttcctaccccctccaagagtaggaatcttttgcaatttgagaaccacattttgcgcaataatgtccatcggcgcttcctggaagttagacgttgtacttgcttcgttgccgcacaatgcacaaagacggtggtccggtacttcaccagttgtactaaaaattatatcgagtgtataaactgtgttgttatgaggggcgttgctagatctttttcagtgggggaggggggagaggccaacgatcaccttcaaaacgagccaccaattaccgacaaatatattaatgccaatgtcaatgcacaaagacggtggtccggtacttcaccagttgtactaaaaattatatcgagtgtataaactgtgttgttatgaggggcgttgctagatctttttcagtgggggaggggggagaggccaacgatcaccttcaaaacgagccaccaattaccgacaaatatattaatgccaatgtcccaatgtctacaaatttaaccctgtaaacccggggccaggaactaagttatttttcagttttcctcctcccgcgcgcggaagctttgatacttcattaaattattagagaaagattacgatccgttgcaccgttctagactttttattcttgtttcgcccctcccgcgcgaagcgcgaaagctatgacgtttcatatatttattagagaaagaagacgattcattgtaccgttctcgactcttaatccttgcctgaattcattttcgcccatcccgcgcttagcgcggaagcttttacgtttcattaaattattagagaaagaggtcgattcgttgtactgttttcgacttacaatccttgtccgaattcagtttcctccctcccgcgcaaagcgcgagagctttgacgtttaattaaattattagagaatgaagactatttgttgtactgatttctactcttaatccttgctttcacatttcattaaattatttggaaaagaagacgatgcgtttccttaaatgtttactcttaatccttgtctgaatagagttcccccccccctcccgcgcatagcgcggaagctttgaagtgtcattaaattattagggaaagaagacgattcgttgtactgttttcgacacttaatccttgtctgaattcagttttcgccctcccgcgccaagcgcgagagctttgacgtttaattaaattattagagaaagaagacgattcgttgtactgatttctactcgctttgtctgaattcagtttccctccgtcccgcgcgatgcgcggaagttttgacgtttcattaaataatcagagaaattttctgaattatttttttcttttctttgtccgataaaaaagtcacagttcgtagggagaaaaaaaattgccggccgaccgacaataaacatctcaccgacttcaaacttttttttttttttttttttttttttaaagttttaactttaattaaattcagatcttttttactttaacggtctgaatattgagaccacgttgacaaggtagtctacctgactactggcacttcgccaggtaaactaaacgaagaattaaaacttttttttttattttttttttttatgtgttttattggttttcaagatacaaatcaacacatgaatcaaagaaatcaatttgaaaaaaaaaaaaaaaaaaaaaaaagcagcaatacaaaaatgttaacatagaattgtcgccagaagaataagacaaaatgattttcattcataaaaaaagacatgttaggtgttttccgcgttacttatataacaaacatggtacatagtacattgtacagggtatttttttttttaaagcatgttaaaagcaaaaatacaatttgcaaaggagctcaaaggtaacatattcaaatgttaaatctccatttccgaaaatgaatagggagtttgttattttttttggcaatacaatactcgagttctttattggccgtaatatagcatttataaccttcgaagtttggtggtttgctttggaatttgcatatataaatataatatttaagtaaaagaaacaaatatgtaaggaacctatcagattcgcaaccgaacattttttcaaatgttgagacatttagaggtttattagttttctgaataatagctttaacagtttcatcccaaataggcttaacattaggacattcaacaaaaatgtgactatatgtctcagggtcagtattacaaaatgaacaattgggggagaccttccttttaattttatacaaaaactcattcaaacctatagctctatgaaataacttaaagtagaaagagcgaatacgagtacttatagtgcatttaaagttattcacatgagtcttttcccaatcaacttcgtcaggttcttggaggtcattccaaaataagatttgacgttctggagaacatgactctagcattgtactgtatgcatattttggaatttttagagttttcaagagcttagttttaacgtcatcaaatattttgtcaggggttaagtcagaagtgactagcaagtcatttggtatatttctcaataaaaaattgtatttccgcctgtcttttttaccaatatcataatccagaataagctcttcaaaaagtttattacctgggtggggagggttgagtaaatcactgatatagacaattcctttgtccaaccaatcttcatataaaaaataatgttttgattttgaacagatatttctgttaaaccaaatacactgacaagagccaattgcggaaaagactgtaccgaactcagttttagcaaaattttctctaaatatataccatgtttgaagggattcagctaattgacatgaacctaatttgtttaatatgctttgaggagcatatgctttccatagtatatcctctctgctactgaaattatttaaaatagacatttcaatggacttccacacgctttgatatttatcatcaagaagcattttgacccatgacattttttgagcaatagagaatgtgtatggatctatcatttttaaaccacccaaagagtaatcattacacatgagccttcttttgaccctatcactgccaccattccatataaatttatacagtattgtatttaactgtctaaaaaatttcttaggtattttaatacacaacacagaaaaaaaataaagaacttgtggcagcaatagggtctttacgacacagatcttcccgaccagagataatttcttgcgcgccaacaatttagggtgttttcaatggatttgagttttatcttatggttaaggtcatataaatgatctgtggtcaaagaaaagtgaatgcctaaagtcttaaaagtaaatttattccacttcagacctttctcacaaaatggatacctttgacaacccttcaaagaaccaatccatattgcctctgattttgaaatattaagtttacagccagagctctcagaaaaaaacccaatagtgtcgaataatgatttaaaagagttatctgagccatcaataaagcacgtagaatcatctgctaacaaagaaattttcagttcattttctgcaactgggataccttgaatattaggattttgtcgaatagcaagagccatagattcaataactagcaaaaataaatatggggatatgggacacccttggaaaatacctctttccatattaagtggtctggtcaaattaccatagttagatacataacttttcctaccggagtaaaatacttttatccaatcaatgaattcattactgaaattgaattttcttagtacacaacataggaaatcatgggaaacactatcaaaagctttttgaatatcaaggagaaggattgcaccaggaatttgttctgattctgtatattcaattatatcaataattaatctcacattgtttccaatattccttccttttaaaagaccagattggtctggatgaatcaaatctgaaaggattttttttacacggtttgctaaagttttggctaaaattttgtaatctactgttaacagggatataggtctgaaattttttaagtaggaggcatccctgtctttttttggaatcaaggtaataactccgtttctttgtgagctagacattagtccattctgtaaggagaaattaaatgagtctataagcatatcagaaatatctttccaaaacacaatataaaattctacaggtaatccatccaaacctggtgacttgttatgtttcattgaagcaattgtatcaaataattcctttttagagatgggtttatcaagaagaaccttatcaacttcatttaattgagggaattcaatagagtctaaaaagtcctccatttcattatctgaattattgtcaccacagtgttttgtgtagagggtttgataaaatgaattaatttcctccagtatagcgtgttgattaacaataatatcatcatcttcattctttaatttgaaaatacttttcttctctccagttcttttttctaaattacaaaaatatttggagcttttttctccttcttcagcccatcgaagtcgtgagcgaataattaaacctttggtttccacatctaaaatatcatttaaagcctgggttaaaaaatccttttcattaataagctcattgttatttaaatcagcacttaattttttctctatatcttctatttccgccaaaaggtatttttttgcaaaatccttttccttctttttacgtgtacaatattctatacaaatgccagtaatggtgcactttaaagagtcccataaaatatttggattgcaatcgcttttggaatgaattaatttaaaatcttctattttgtcaatgataattctactaaagtctgcatcattatgtaaatatttgcaattcagtttccaaaatcctcggccccttagtggttgagcacctttaaaatttaatgtaacaagggaatggtcggattggattcctgggattattttagattgcaaacaattggtaacaaaattatcagaaacaagaatgaaatcaatcctggataacactctaggttttttttgatgtctcgtatattgcttcaggtttggatgaaaactgcgccaaatgtcacaaagattaaattcatccataagtgttattaacatttcctttgatttgaaatttgagtgggtgtccctacccccttgataatccatgggccccaaaacagcattaaaatccccagcgcatagaatggaggtgtaatcgagtttatccactttactgaaaacttcaagaaaaaaattggggtcatcattatttggaccatagagattaactaaaatcacaggtacctcattaatggtaacagataaaatcaggtatctcccatcggggtcaataaaagaagagttaaggaccaatgacacccgatttcgaatcaaaatggctacacctctactatttgaagcgtggctagaaaaccatgctttttcaccccattgttgtttccaaaattgttcatctgatttagaagagtgagtttcttgtaaaaatattatgtcactattaattgatcttaagtaatgaaaaatttttcttcttttgacatgatcttgtataccccgacaattaaaagtagctaacctaacattcatggtatatacacataaatacacaccaaatcactacacttgtagatgaagataacactgaaataagaattgtggtcataaaaaccagtcctatgtaacaaagctgcaaaatactgattgctgcatgatcatttgaaattaaaaaagtaattgacatacatgtagatgtaagcatcatcaaaacgacaagattaagacaataaaaaagagaaaaaggttgcacgagaacgaacggcaaaggcttcaaatcataaaacagcccaaaccaaaagtgcaaaggcatgcagaacagttctgagcagaaaaaagggtaaagtgacttttcgaactcccaatctaactaggaaaagagcattctgcaaacatataacaaaaaatgtcttgtgttgttggagtcagagggagaaacagtaagaattacagacaaaatgaaaatggcacagaacttttatactgttgtaaattgtaactgaccagggccacttaaactccacatcttgtaaaataaacttaaattacactcttatatgtttaaaagttcaccctcaccaaataaaggagagttagacatctgtcaataacatccaagttactgtcaactagcttgttaatgcaagttcttttgtacagatgacatgaacgtacggatgtatattctccaaacaaagtaagaaactttcaaataatgtgatgaataaaaaatgttgagtgctgtagactccacggtgaaatagccagaagcaattaattcacacctacgtgtatctccatagacctatataggaattcttcagcagaacgtcataaaacaaacataataatcagggatgaaactggaatgtcacatgaatgatattatcccataaaaggaggacagcagaaagttaagcgatgatcatctttccatctggattcctatgacataacttgtccggaaaaacgaaaaaaggccttttgccctcttccttgagacgcttgaatgaaccagccttagcttttctgagttggagaacacgttgcgagagatcctccgcaacgaaaaccttgtggtcttggtataatgatgtagtagccttaagcttcttaatgcaggcttttcgggccctctctttcgcagtgtaggcgccaaaacctaagtggatcctcctgggatattgttgagaattctcctttacctggggccgaaatgatggtgtacggtgacatcgttgaatatccttgataacatcctcaggcacctctgcaaaacgcatgaaatcttgaatcaccttcctgcagtcttccttgttatctgattcctggatcccaaagactacgagattatttcttctagaacgattttcaagatcgtctaacttgctttccagctttccattctctatttgcaaggcctgtacagcatctttcatattatcaacttcaaaagacagacatttgatcttctcttcatgatctgcgactttaaaagtaaggtcacccagttttttgtcgagaagtgactcaatacgagcctcttgtctattctcaaaatcagcaaagaattgtacgaaccattgtggtggcttgttcattgataggtcggctactgccgctggggtagagtgggaaactgatgagagaatgttccgtttcgctggggggtcgcacactgtaacgttcccggcggttgccggggaagcctggtgaggaactgctgagtccgcgtgctcattgttcaactttagtttcttactgagtggcgagttattctccatgattacgcataaatctgctcgtaatattgactataagtttaacacagtatcacagaagagttgaaattgatagaatttaccgtttataagtcacacatattcgtcaccggtgataaaattctgctcaaaactgctctcgacgcaaatcacgtccacatgcgaaacgcggccattttcgtccattctcaccgacttcaaacttcgaaattgatatagtacacgagctagatagagcaagaataccgacacagcggacccgacacagtacagcaacataatttatctatgcgtatctttcttgctccttcgacgtggcgactccacctaacattccctttgctctcttactcccacctctcttctcttaggctcttaataccatcctctctctctctctctcctctctttcgtttgtttttcttttgttttgtttgttttcttatgtttcctttttctccttttttttctttctccttttctttcttttcctttctttcctctccttcctcttttttttctccttctttcttttc

SEQ ID NO: 49205 - DNA, 1518 bp, Oryza sativa
tagccagttcaaatagagaaaagggatgagagagtgagagcccggccccccccccccccccactcagtgttatttagggtacgcatatgctcgttccctctttttgaaagcaccccctatctgaggactgccaacatttccgaacccccctttcgcgggcttttcgcgggcttttcctgccttggagacccccctaaatcatgaaaaatggtcaatgtaccccccttaattcggaataatttcttaggagtgcaaagagatgagagagaaaaagaaaaaaaacaccccctttttaaagaaatctccgggtgaaaagtcaaatacaccccttttttttttacaattctcgggccggactttgtcgcacgaaaagtacccctttaccggacattttggcaacacgcatgcggtcatttcgaaccctgagtggggggggggggggggggggggccgggagtgaaaggaaggataaaagtacatgcaatataaaaatacgaatgaatggcagaacctgctgtgccaatcatcatgacagttaatataggttttcccgcccaacttcgtaaacttagcatccgaattaacgttacgttcattcaacttcgtgcgaaattgaatgattatgtagatcaacattcaaaaagctaattgcgtcattcaatttgatttagtaccatgcgccggacagacagtggtatgtcttcgtgcattcaattccgtgattaggcatacatatgtaacatttgtgcattgcttttcatttgatgttaatttgtcacttaatatacttctgtttgaataattttattcaaaatttacttggaggaatggcatgcgtattcgttacattacacaggtaactgtccccagagaaggtgcacaatttgtgacttctcttctaagcacatgctatatataaacagatcttggacagaggtatagttcaggtttaatagacatgatggaaacaaaataaaatgatgaattaaaaaaaagatgttaaatgaaaagaaagaaagatcaccttctcaatcacgattgatcaaaacaaaccatttaaaaaataacccctgaggcatttataatgaaaaatatgaagatatgaatgggagtgggagagatgtttcaacaaaaataaagaacgtcgaaagaaagagaaaacataaaatgaaatatttaaatatatcagacaaataagaagaaacatgaccacattatctcttattcattctacctccaatttttcagactgttttcaaaacaatatcatgtgtgtcgatcatagttctatgaagcttgatgtctcatggtaatttaagcaatctaagcaacaatttttgaatttttgcgacaatcgttcgcctttgctgctctttaatactattatgacgtgcagtaacaaatttaacagttgattccacttggttgattctattgttcgggttatttagcagaacgagatagaaattgacattctcatggcttacgactttgcgttagtagttgttcatcgtctct

SEQ ID NO: 49206 - DNA, 2290 bp, Oryza sativa
  unsure (1)..(2290): unsure at all n locations
agattctccctcttcccagtacatgtagtaggagtagtattagaagcagtatcacaataataatgacaccaattattattatggttggtggtgttactaatgttatttttgtaattatcaggtgggctgtatatcgtaaagaccaccttataatttcgttattgcctttgtttatttatttatttattatcaggtgggctgtagatcgtacagaccaccttataatttagttagatttgcctttattatcaggtgggctgtatcttatacagaccaccttataattttgttaaaatcgcctttattattctttattgttaggtgggctgtatatcgcacagaccaccttataatttcgttagaattgcctttattatttatttattcatcaggtgggatgtatatcgtacagaccatcatataatttcgttagaattacctttatttatttatcaggtgggctgtatatcgtacagaccaccttataattttgttagaattgcctttatttatttatcaggtgggctgtatctaatacagacctccttataattttgttaaaattgcctttattatcaggtgggctgtatatcgtacagaccacttataatttcgttagaattgcctttattatttattttacttatttcaaaccacttttttgtaagcacgattacttgaaaatggctcaatcaaatgccttcaaatttggcacacatatatgtataggcatttatgtacaaaacacaataacgttttcaactatgaccttcactgatgacgtcatctaggcgccattttgtaaatttttccgaaaatcaactcatgaacatatcttcataaccaaagccatttttgattcatcatatgaaaaactttcgttcatctgctccgcacgcatcgcaccgtgagctacaacacgtgaaattccttaccatttcatgcattacctacgctaaatcacagcaacagcctaactaaacccacttttaataccatctcggcctgaattttaaagttcaatgttttctctttaagatgatataaatttgaaataatttcattcgtggggaaaggttgcactttttgctttaaaatgtttaaaaaaaacctttcacgacactttctctatggaggtcaacggattttcgcccaaaatccgtcaactctccatacttatcttggctgtataactgattcgatcggcgaattgcaccatttcgcatatcaaattgaagcagaggtttcaaagattccagtaatgtatcattcattttgattggataagaggaaaaggttgcacttttgcatccaatgatttgctgtctctcatgtatgctccttttcgcgcaagagcatgacatatgccacactacacgagttccatagacgtacacattagcgtgcgaacttttgcgttgcatgtgatttgaaacagcacgtctcctctcggaatgttcttcgaacttgtccattttgtgtagttatttctttcaatatgtgagttttaaccttaaatatagaaagaagaagacatgtagactgtagtaatgataattaaatggtgatacattatggatttgttgtgtaatttgccagtgaccatgaagaaacacaaaggattttgtaaaattgttcgtcgtaaacctcagaccctgagagaggaatgttccatttgattttggggttagatatataattagtgaactccttgatattgaattatcgatatgaattcaatcttcaacagttttaaagtcttgttattgtttttgtgtcgtcttagagtttcattaaaagacataaacatgcaaatgaaatcgtccttgttttatgttcatgttatgaacaagacccattctccctattttgtcataatggacgcacccagtgatctgtgttacgcgccagtgcacactgcgggacttggtgcgaagctctgtgcagagttgaccgagccggtgagcaatccattttatgaacgaattccgcggatcctctccctatagtgagtcgtattagcggccgcaaatttattagagcaatatagtcctacaatgtcaagctnnnnnnnnnnnnnnnnnnnnnnnnnnnnnnnnnnnnnnnnnnnnnnnnnnnnnnnnnnnnnnnnntggcgcgccggatcgatccttaattaagtctactagataacttcgtataatgtatactatacgaagttattatctatgtcgggtgcggagaaagaggtaatgaaatgtgccccgcttacgcagggcatccatttattactcaaccgtaaccgattttg

SEQ ID NO: 49207 - DNA, 99967 bp, Oryza sativa
  unsure (1)..(99967): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagctcttaaatagtgtgattttttttatatgaaaaatactatctactcgtacatatgaatattgtaaaatactatttttaatccgctttttaattttgtaatagttaattcatttgtttgtgtctcgaatcattcagctattaagtattccattatattccattggattcagcctgaagtatacaagtttgtataaatatttaacgaggatgtaagacatgaaagccagtagtttactccttccttctaactagattgagtgcttaattagttatttaaatagagacaaaaaatgtatattgtgatggagaatatacctctgcgtggattagcagtagagggccaaaccaagagtggagttgaaggaccatgaaagtatctgatggagctcactgccagagccgccggtggctgcggaaaacccaacggatacctcttgtggaagcaatgtgaccggatccggcaaaatcgcactgacctcggccggttgaaacgatggatgatcatcaaaatgcaggttggcaagcagcatccgggtgctgctgttaaaactgatggaggctgtcatcgtgccattcaggctgtagctcggcaaacttgtcgtgttagccgactcgatggcgctgatgtcgacgcccatgtggtcgtaggtcttattggggtcccagatgttgttgtatgtgtcgaactcgacggcgatgaaccggtctgtgccgtaggccttcgaatgattggtggcaaggaggccaaggttgcctccatctgaattcgatggaatcgttgatgggtaagcagcgaggaagaaggccagcccgtccccctttgtgtccgtcgggttgctgatgtcgcttctgatggcgatagcgaaggtgaatcgcgtgctgaagctggccacctcgcccgtggtggcgtcgtagaacttcacggcgtgggcgtacgacatccgccccttgcacttgtggatcgtctccgcgaactcgttgcaggtgaggtccaccagcttgttgctgggctcgcttgcgttgccctcgaacaggaggtcctccaggcggtagctggctgaattggagaagtcgaagctgaaggagagtggcgccggtgcccgcgattcagcctcgacaagaaacggtagcagaaaacacgctacgatgagggtgagcttcgcgctgctcacaccttctcttactggcaagcctatcgtcattgtgtcgagtgtcatatctacagggttgttgcctgggctggctgttcgtgggatcaatatgatgaccatgggtgcatgtatatatatagccttggcagctaggagtagtgtatatgtgcaggcgagattattttagaatacatgcatgatgcaactgatttacttggaaaatctactcaggcccttttgtttaggcttaaacttattggcctagacttttaagtcagcttattggcttatatgatttataagccggtggatttaatgtcctaagtttagtagttgaatcacacatctacctcacataagccaaaaacacttctccaacctagtttttggcttaatagtgttagagtggcttatggcttcaaaaaagccaaacagaaaagctacttgtttgtttaggcttagacttttcgacttataagttggcttataagcctaaacaaagagggcctcaatttatttgtataggaatttgtgatgtactggatggttgtttgtatagtaagttagagggtcattttatcatttggtgttatgtgagaagttagtactatctccatcccaaaatgtttgacgccgttgatttttttaaaaatgtttgaccgttcgtcttattcaaaaaatttaattaattgttaattctttttctatcatttgatttattgttaaatatacttttatgtatacatatagttttatacatatcacaaaagtttttgaataaaacgaacggtcaaatatgtttaaaaaagtcaacggtgttaaatatttagggaaggagggagtagctatgtacttggaatcttggactgtgaggatgcattgatcgatgcagtcaaaggtttgctggtgatttaaaaagaagaagcaggagatgcacagaaggatttcacgttgctgagagaggagaatttggatgcaaccggtctgtgcatgcgcgtgaagaccgcgtgaagcatggcgatttggtgtcggtttgcagctgattatttagcgcgtgcaatgcccgatcttattagttatagttttcttttcagttaagatttgcttattttgtgtgggaccagatatgattatgtcaaactattgtttacttttgccgatatactatatgccagtgccggccgattaggagagctgtgctaaacaaaatatcagtctattattttcttctatactcccaccgtttcataatgtaagactttctagtattatccacattcatatagatgttaataaatctagacacacatatatgtttagattcattagtatctatatgaatgtgggcaatgctagaatgacttacattatgaaacggaggtagtactgtttttatcgactgaaacacgatctgagccgttgattgggcgatgggtctattagggtgaggatccaagaccaagatttaccttatcgtttgggccagggttaccccttcccccccccccacacacacacacacccagtagcgcggtaaccgccgaaaatcgcatccaaaaattcgaattcaaaactcggtggtttcgcggcttcgctgtggttaccgcatggttaaccgcgatattcgcacagttatcacgggctgtgcagctgaaatcacgtaaatgaaaaataaataggcaaaaaaatcgaaaatacggttgaatatgtgtagaaaactagaaattgaggataattggaagaatacgtaggattcttaccgatattgtcttcctttttttctaatttgtaaactattttcggtttcgccctcaaatttgaatttagcttaccctatttcaaaaaaattcatcatcattggcattacatccatgatttttttcatttttttattttttccagaattttgaatttggtcaaaattcatccaaaccatatcaccggtttcctgtaccgtatccctacggtaagtgcgataaccgcggtaatcgcgcggttaccacacgataagtgaaaccctattcaagaccaccactaggctttttttaagtagtagagataaccggagggagtatttcattgcagcagacaagttcattcaacctgaactgtccatctctatctcaagtatagtaaaaataccaaaccggagatcgaacccctcaagttgctggttcaccagttcaccggtccaaccatcaggtcactggtcgaaccgctgcctttttatttattaatattatatttgttttgtattattttatatacagaaacaccagatattgatgaatatgtatgtaaaaataaaagttttggctttcctgctttagttttatccttggggacaagttcaacacaatggtcccaagcaggatcagcttccctctgaccttttactggaacggatttcttgtttagtttcagcagcagagcaatcctcttgagattgtggttaatctaaccggcacaactggtggtagtgattctggagtggataaagaattcactgctgcaaatggataaacatcaggtcacaactcccaaatctaatggattagaaaacaaatcggtagccaataaagttcatcgtatatgtaataccaattttagactagattgggtgatcaacagagcaaatcaaacacctgcacttccgcagctaggctaactagctagcaacagatctggtgcaataagctaatcaaccacacatgcacatatatttcttgaggctagaacacgaagcaactcgcaatgatgtgcccttcaaccttgccaccggcttgctctgctaccggcgtgacgccgcgacggccgtcggcacctcggcaacttcgtgctaccggcttgccgcgctactgttgtggcatgttgatgtgaggtcgccggacactgcgtcgagagagaaatcgcgaggtggcggcgacaaggcgcgacgcaccggggaaaacttgagcagcagtgagtaggggtaggtcttacactactgtagaaatcatctttggtcggtcggccaaattccacaataatctcggttgctaaaaaaaccaagactaaaaaatatttttagtcctggttaaaagcctagcgctattttttttatctttagtcccggttcaatagttggaaggcccccaacgaacttaagtcagtctcggttggtaacaccaaccgggctaaataatctctcccccacgatttacgcactctctctctctctcccttatctcctcacgcacaacgcccactccttcagtccttctcctcctcccccactcctctatccctctccctcctcctcctcctccctctccctctaagtcacagacgcggcgccctgcggggccgcgcccggccaggccgccgtgtccggtggaggccggtgcgagggccacgcccagcggcggcaggcggtggattttttttttcttttcttttttcgttgttatttgtgaatgattgtttgttgagaataatttgttcagtcgatctgtgatttgagaatgagtatgttgttgtgatttgagaatgattatgttgttgtggatgatttgagttgagaatgccggtgtggataatttggcgatgtcgggagatgatattttttcaatgattaggagatatcgagcgcgatatatgtaaatagggaaaaaaaagccttatgttaccaaccggggctaaaaatccatctttagtccgggttatttcaaccaggattaaagatgaaaatctttagtcccggttgcataatcgggactactggaggttacaaaccgagattaaaaaggtttcttcagcaattgagtttgagcttaaaaaaattgaaatgtgagaggttgagtggatctggatgacggccaaatttctacagtatgtcaaaaaccctaaggtggcttatcatttttcaatattacccctgagttcatagtaccaacgaccaaggcaagcaaaaggaaaggtattgtgtgtccaaacacaaaaccacccagttctacagaaccgcaccggttcagcggtccataaaaactacccggtttatccgatttttaccggtccgactgcggggacggtctttgtgctgaaccgagccgtcatggtcaccagttccagtttttccggttcaacagccggaccggtcccttttttttactatgatatacagcagtgtccccaccagtcagtagcagtggcgaaggaagcgtatctcccattccccggagcgctcgagggcagcgaatcgcgatttcgaggtacgtacagctccctcctcccttccatctcttcttgcatcgatcccctccctcctctagatgttcttcacggatcaatcactgctcgagcgttgtttcttgcgctgagatctcgaatcttgctcggagttgtgctgctgtggattcatggcttattgattcttgggtcttgtgcagtttccacgcgcgccacctgttcgacgaaacgcctgcctgagcgagcgatttcgaggtatggctcctttccttccttccttcctcccaactcttcttgcatcgatccttcttctctggatgttcttcacggaaaaactgctcgagcgttgtaaccgttgtttcttgtgttacggtgtcagatatttcttcgaagttaagctgcaggttgatgggttcctgattcttggtcttcctcttctgtgtgcagtttccacgcgcgccatctgttcgacgaaacgactctgcgcgcgtgctcggccaccatggaggggtcgcctggcaagatcaggctcagcaccctccccgacgacatcgtcttccgcatcatgtccttcctgaccatgcgccaggctgtgcggatgtgcgtgctgtcgcggcggtggcgcaacctctggcgcaccgtgccctgcatcaacgctgacatcagcgagttcaagcggagagataccgagcactatgatcaagagacggaattggcgttcaagatgttcatggaaaggctgaatgagctccgcgaccccgcccccttgatacacacgtttcggttcaggtgcatattggatttgaatgaggaaatcaaccatatcttggactcggaagttatcaacggatggattagccacgctgtgcagaagcagccactttctggatattgtcctgctgtgtgacaaattggagctcaatcactctgcattcaattgccgctacctcagaagaattgacttcaccaatgttattttgatgcaaggattcttcaagcaactcgagatgggctgtccagcaatgagaggtctcttcttagatgaatgcagcgttgaggatgttgagatctcctcccagacactgaaggttttgaccatcaagaatactcatgtctcctatggcaacaagactactatttcgacccccagtgttacttatctgaagttgtggagccctttgaatggcacatatgtgcttaatgacatgccattactagtgacttcattactggtactttatcatgtgcaagactctggtgattttttccaaaatctcaggagcctttctgctgctaaaagtttggagttcgattatgttgggagaagaaaacaggtaagcttattggtcttacacatctcactttccttattatatccaggaatcttaatgtagatattgatatgaaaaaggaaaaaactcaagctcggtgtttcttattgacacttcacaattcacaattacaccttcaaaactaagcgttgcataactaattcttatgtgtgaaatcatgatgattttaaggatcactgatgccatcaaccattcgatgcaatctatttcatgttgtcagtttatttgtataccaatcaacctgttggtcaagcaagaagttggctatttgatttcacaatgaaactggagcatttcccatttggtaactcaacatgctcttgtttgctgcaatattgggttcgcaactgaaaatttatcttttaagaaatccgggtgattgtctaacttcaattgacattaatgcacatgaatttgaaaattaagacatactcaaagtcaacatacaaatggaaatgcctcagcaaatgttgaaagtcttactcctgctgcaccgcacaatagttttttgcattgtgattagactagtgtaactacctaactttcaacgaaagtcttggtgaaagcaaactagtatagtatcatttattctggtttttggttggcataatgttagtgctttggattgtgttgtcatgtttagtgtgaaattttgtctataacatggcatgattttttctgttgccacataatcatttcaatattgtgcagctgacaattgaaaacaatttgcaattgtacccaaaattcaacaatcttgtcagcctgactctcggtcaatggtgtctggatgcaaacttctatggattgacggtcttccttcagacctcaccaaaaataagctaactctaaagcttgaaaaggtaaatcttttcctccaaatgcatatttatccttcttgaatcatttttcacatgtcaatcgagaattagctcatcttattttgttgctatattatcaccaggaaaaaccacaaagaatcattggcaaacttgaagatagatcatttacatgtgagcaccttacgcgtgttgaagtcgtatgctcggaggatgatcccctggtcgaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgttaatagtggactgacctctgctcaggttcatatcataacatttgttgctccagttgagtccgaaagcacatataaacatgtatactgctcttgtttggtgctatgatatgagtagaaacaatcatgtcttagtagtactatgtaagtgaaaggtctgtcaccttgttctgttgatgttctattgtcctataaccaagacgtactgcaagttgatgcttgagtactctattattttgcctttatattttcccgacgtgatgttatacaccatgactggaattgagatcacctttgcttgtatgactgtaactttagcagtcatataaccatctttggatcaaataacaaggactcagatcgcaccaatgctgacaaacagtattgctcctaaatccaggccgttgaaacctttgatctgatggtagtgaagatataagactgctaaactgaagatataagactgctaaacttgcagtccctattcaaactgcatgggatcccaatccatgactctggctctatccccttcagtacgactcattagattttttttcctttttgtgtaatgtacacatgaaataaaaaattacttccgctgtttcatattataagttgtttttgactttttttttactagtcatttttttaggtttaacaaagtttatagaaaaattgaataacatctagaaattagttttattaaatgtaacattgaacatatttatattttgcgttggaaatatttttatttttccaacaaacttggtcaagtttaaaaatgttttttaaaaaaagtcaaaacaacttattatatgaatatgaaacggaaggagtggattttactggaaataatgagcatggttatatatcaacaagctgcaacaattttctgtatcagtggaaaacaacaaaatcaaaaagctgttaattttttcatacaactatatatttgttatgaaacaccactgtcacacacatggttatggaatctgtgtcacacattgtattctttgatcgaaaatttcacaaacatggggcaccaacatcgtcgattcagagactcgtgtaatggcggtgcagttgcacctgaagaattcgatgcagtggcatcggcttatcagattttgggtgaagctgtcgtaccactgttgtaggagtaggtggtaaagggagacatatatataaccctatttgtttcacttatgtttgtatgcttataagctacattttaaattttcaaacttaattttagatttgatttgatgttgtttaaagggttaattcgatccatgccactgcaactttgccaaattaaaaaattatcactaatattcatcatatcagctacatgtcactcgaaatttctaaaattaaaaccatgccactcccgtcactttttctgtctcctctccggcgattgaactgggcgagtgggcggccccgcggcatggagatggaggccttggaggccggcgggttctcccttgcgcgggagaggccgccggcttcgatctgggtgagctggtcgaggagacgctcgaaggcggagcccatgaggaagtccgacatggtctccgggagcgggcggaggccggagcccacgccgtcgtcgtagaagagctcgaagctagtaaccgtggcgagggagtcatcgtcgccggcagctacggcagcgggggagcggcaaagcacgatgacggggttgaacggcgagcggtcatcggctgccgcccctgcgtcagcgcagcatgtccgtcgcaggcgcaggtctttggcgtggtgcgcgcacggtggcggaagtaagccgtgcacggtgggggtgcacccatctcctcgaggatgccgccggcgtaattcgggtaagcgacagcggagtctttgtgaggggcggcacgcacgaaggggtcgcaattgtagcaccagtaggaggaggacgccggcgcagcaccggcagcggaaggggaggaggagaaggaagaggaaggggaagaagccatcggaaaccactttttgttctctctcagatctgcttggaaaccactgcaagaagggatttttgtttggtttgttgtttaccggcggtggtcaaggacttaggttcctgagggcggcgcggttgcagcagcaggaggaggaggaggagcggtgttgtggtgggaggttggtcggaggagaggagaggataggagaggaaacatgaggggaaacgaataaactgggggaggggggacaaagacggcgtgagagaggagacagaaaatgtgacgggagtggcatggttctaattttagaaatttcgagtggcattgtagctgatatgacaaatagtagtggcgtttttttttaaatttagcaaagttgcagtggcatgatccaattaaccctaattattatgatcaaaattaacttaattactactcgctctgtttcagattacaagtcatttttgactttgatcaaagtccatctgtttcaagtttggtcaagtttgtataaaaaaatactaacatttttaacccaagataaatatattatgaatatattcgattatagattcagtgtaacttatttggtgttacaaatattactatatttatttataaacttgattaaatttggagtagtttgattttaaccaaagtaaaactgacttataacatgcaacacaaaatgacttataatatgaaatggacgaagtacgactagattctacaaccacattagtattattttaccggacagagtatttcattgcagcagacacatttatccaacctgaaccgtccatgtttccatcgagggagcagtaaaaaaaccattccccggagcgctcgaggcgaatcgcgaattcgacatttcgaggtacatacagctccctcctcccttccatctctccatgcatcgatcccctcccctagaatgttcttcacggatcaatctctcctcgagcgtgctttgctgtgttacgatctcaaatcttgcttggagttgtgctgtggattcatggcttattgattctttggtcttgtgcagtttccacgcgcgccacctgttcgacgaaacgcctgcctgcgcggtttcgaggtacggcttccaactcttcttgcatcgatccttcttctctatatgttcttccctgaccaatcaatgtcttctcgagcgtcgtttcttgtgcttggagttgagctgcgggttgttcggttcctgattcttggtcttcctctctcgtgcaggttccacgcgcgccacctgttcgacgaaacgcctctgcgcgcgtgctcggccgccatggagggttcacctagcaagagcaggggggtcacgggcccagcgcacactgacgacggggactggttcagcgacgtcccggacgacatcattctcaatatcatgtccttcctgaccacgcgccaggctgtgcagacgtgtgtgctgtcgcggcggtggcgcaacctctggcgctccgtgccctgcatcaactccgacatagacgagttcacgcgggactccgactcggaaggatactatgatgaaaagacggaattggcgttcattatgttcatggagagggtgatggagctccgtgaccctgctgccttgataagcacgtttcagttcaggtgcaaatttgaattggatgaaggattcgatgatatctcggaccctgaagatatcaacgcatggattagccacgctgtgcagaagcaggcacgggttctggatattgttgtgctgtgtgacaaattgtatctcgaccactccgagtttgcttcccgctatctcacaagaattgagttcaccagtgttgttttgatggaaggattcttcaagcaactcgagatgggctgtccagcatgggaaagtctcttcttagatgaatgcgccgttaatgatgttgagatctcctcccaaacactgaaggttttgaccatcaagaacactctgttctccagtgacaagactactatttcgaccccgagtgttacttatctgaagttgtggaggcctgtggatagctgtgtgtttaatgacatgccattactagtgacttcattactggtactttatcatgtgcaagactctggtgatttcttccaaaatctcaggagcctttctgctgctaaaagtttggagttcaattatattgggaaagaggtatgcttattggtcttacgcatcccactttccttattatatccatgcatcttaatgtacgtattgatacgaaaaaagaaaacaaactcaagcatgttgtttcttattgacacttcagaattgcactggcaaattaagacgaattcttatgtgggaaatcatgatgtgttgtaagaatgactgatgccatcaaccattcgatgtaatttatttcatgttgtcagttcatttgtgtataaatcaacctgttggtcaagcagacctgaactatcttagctggctattcgatttcacaatgaaactggagcatttcccatttggtaactcgacatgctcttgtttgctgcaatattgggttggcaactgaaaattcatcttttcagaaatctgagtgattgtctaacttcaattgacattgctgcacataaatttgaaaattaagacatactcaaagttaacatacaaatggaaatgcctcagcaaatgttgaaagtcttactcctgctaccacataatagttttttgcattttgttaagactagtgtagctacctaacttgcatcgagagacttggtgaaggcaaactagtatagtatcgtatattctggttttttgttgaaataatttctttctgttgtggcacaatgttagtcctttggattgcattgtcatgtttagggtccctttgagttttgcaatcctctggttttttgttgacatcatttctttctattgtcatagtgttagtgctctggattgtgttgtcatgtttagtgggaattttgtctataacatggcaaggttttctctgttgccacatgatcatttcaatactgtgcagctgacaatggaaaacaatttgcaattgtacccaaaattcaacaatcttgtcagactgactcttggtcaatggtgtctggatgcaaacttctatggattgatggtcttccttcagacttcaccaaaactggagaagctaactctaaagattgaaaaggtaaatcttttcctacaaatgtctactgatccttcttgaaagatttttcacaagaacacatgtcaatcgagaatatagcttattttattttgttgctatattattatcaggaaaaaacacaaagaatcattggcaagattgaagatagatcatttacatgtgagcaccttacgcgtgttgaaatcgtatgctcggaggatgatcccctggtcaaagatgtggtcaccttctttgttaatagtggactgacctctgctcaggttcatatcatacgccggatgtagatcaaggatgtgtaacctgcatggttaattggttatatatcaacaagctgcaacaattttttgtatcagtggaaaataagaaaatcacaaaactgttaattttttcatacaattatatatttgttatgaaacaccactgtcacacacatggttatggaatctgtgtcacacattgtattctttgatccaaaatttcagaaacatggggtaccaacatcgtcgattcagatactcgtgtaatggcggtgcagtttcacctgaagaattcgatgcagtggcatcggcttatcagattctgggtgaagctgtcgtagcactgtagtagtattaggtggtaacggagacatatatatatatatatatatatatatatatatatatatatatatatatatatatatataaccctattagtttcacttatgtttgtatgcttataagttacatttttaaatttttcaaacttgattttagatttgatttgatgttgtttaaagggttaattggatctatgccactgcaactttgccaaattaaaaaaataccaccactattcgtcatatcagtcacatgccacttaaaatttctaaaattggaaccatgccactcccgtcactttttctgtctcctctccaacaattgagctaggtgagtggacggccccgcggcatggggatggaagccttgcaggccggtaggttctccctcatgtgggcgaggccgccgacttcgatctgggtgagctagtcgaggagacgctcgaaggcatagcccatgaggaagtccgacatggtctccgggagcgggcggaggccggagcccgcgccgtcgtcgtcgccagcagctacggcagcgggggagcggtgaggcacgatgacggggttgaatggcgagcggtcgctagccgccgctgctgcggcagcgtagcgtgtccgtcacatgcgcaggtcgttggtgtggtgcgcgcgcgggtggcgaaggcaggcggtgcgtggtgggggcacacccatctcctcgaggatgacgccgccgtagtccgggcaggcgacgatggagtcttcgtgaggggcagcgtgcacgaaggggtcacagctgtagcaccagtagtaggaggacgccggcgcggcactggtggcggaaggggaggaggaggaggaaaaggaaggggaagaagccatcggaaaaggatctgcctaatcactttttgttctctctcagatctgcccagaaaccaccgcaagaagggttttttatttggtttgttgtttaccagcggtgatcaaagacttagtttctcgagggcagcacggttgcagcaacagcaggaggaggaggagcggtgtggtggtgggaggttggtcggaagagaggagaggagaagaagaggagaggagaggagaggaaacatgaggggaaacgattaaactggaggaaaagaaacgacatgagagaggagacggaaaacgtgacaagagtggcatggtttcaattttagaaatttccagtggcatgtagcctatacaacgaatagtaatggcatgtttttaatttggtaaagttgcagtggcatggatccaattaaccctaactattatgatcaaaatttatttattgactactcgctctacttcagattacaagtcatttttaactttgatcaaagtaaatatgtttcaagtttggtcaaatttgtaaaaaaaaatactaacattttcaaccgaaaacaattatatcatgaaaatatattcgattatagattcaatgaaacttatttggtgtaataaatactactatatttatttataaacttaattaaatttagagtagtttgattttgaccaaagtcaaaatgatttagtaatatgaaatggaggaattacatactccctccgtccaaaaaaaactaacaaatctggataaatggtagctcagattcgttgttctataagggatctttttgggacttatggagtagactagattctataaccacattactccaaggacttcctccgttttaccatgtaagtcattttagcatttcgtatatttatattgatattaatgaatctagatatatatatctatctagatttattatctgtctagattcattaaaataaatttgaatgcggaaaatgctagaatgacttgcgttgtgaaacggagtccatattatttaaccggacagagtatttcattccggcagacacatttatccaacctgaaccgcccatgtttccatcgagggagcagtgaacctttccccggagcgcgcgaggcgaatcgcgaattcgacatttcgaggtacacacagctccctcctcccttccatctctccatgcatcgatcccctcccctagaatgttcttcacggatcaatctctcctcgagtgtgctttgctgtgttacgatctcaaatcttgcttggagttgtgctgtggattcatggcttcttgattcttttggtcttgtgcagttcccacgcgctccacctgttcgacgaaacgcctgcccgagcggtttcgaggtacggcttccaactcttcttgcatcgatcctccttctctggatgttcttccctgaccaatcaatttcttctcgagcgtcgtttcttgtgctacgatctcgattcttgtgctgggagttgagctgcgggttgttgggttcttgattcttggttttcctctctcgtgcagtttctacgcgcgcgacctgttcgacgaaacgcctctgcgcgcgtgctcggccgccatggaggggtcgcctagcaagaggaggggggtcacggccccagcgcacactgacgacggggactggttcagcgacgtcccggacgacgtcatcctcaacatcatgtctttcctgaccacgcgccaggctgtgcagacgtgcgtgctgtcgcggcggtggctcaacctctggcgctccgtgccctgcatcaacgccgacgtcggcgagttccagcggagcgacactgagtgggaagagtatgatcaagagagggagtcggcattcaagatgttcatggatagggtgctggagctccgcaacccggccgccccgatacgcacgttccggttcaggtgctgcagattggacggattcgaaggcacctcggacgaggcagatatgaacagatggattacccacgctatgcagaagcagccctgggttctggatattctcgtgctgtatgacgcattgaagctcgatcactctgcgtttacctgccgctacctcacaagaatcaagttcatcaatgttcttatgatgccaggtttcttccagcaactcgagatgggttgtccagtattggaaaatctctttttagatgaatccatcgttgcggatgttgagatctcctccaggacactgaaggttttgaccatcaagagcactcagttctcctataagttcaggactactatttcgaccccgagtgttacttatctgaagttgtggaggcctgtgaacggcatatatgtgttcaacgacatgccattactagtgacttcaattctagtactttatgatgtacaagactctagtgatttctgccaaaatctcaggagcctttctgctgctaaaagattggagttcgattattttgggaggaaggtatggttattggtctcacacatccccctttccttattacatccatgcatctcaatgtagttgtcgatatgaaaaaggaaaaactcaagcatggtgtttcttattgacacttcacaatagcaccggcaaaactaagcgttgcataactaattcttatgcgtgaaatcatgatgtgttgtaaggatgactgatgacatcaatcatcaatgcaatctagctatttcgtgtagtcagttcatttgtatataaatcaagctgttggggtcaagcagacatgaactatctaagttggctattcaatttcacaatgaaactggagcatttcccatttggtaactcgacatgttcttgttcgctgtaatattgggttgtcaactgaagattcatattcatattttgagaaatctgagtgtttgtctaatttcagttgtcattactgcacataaatttgaaaatcaagacaacctcaaagtcaacatacaaatggaaatgtctccgcaattgttgaaagtcttgcaatagttttttgtgttgtgtttagactggcgtagctacttaaattgcatcaaaagcatcctgacaattaaatcgcatgtgctattatggtcttttatcgcataatgttagtgcgctggattgtgttttcatgttttgttggaaattttgtctataacatggcaagggttttctgttgcaacataatcatttcagtatcgtgcagctgacaatggaaaacaatttgcaattgtacccaaaattcaacaatcttgtcagcctgactcttggtcaatggtgtttggatgcgaacttctatggattggttgtcttccttcagaacgcaccaaaactggagaagctaactctggaacttgaaaaggtaaatcgtttcatccatatgtatactgacccttctcgagagatctttcacaaacacacatgtcaatcagggatgtagcttatttgttttctttctataatatcatcagaatacgccggaaagaatcattggcaagcttgaagatagatcatttacatgtgagcaccttacccgcgtcgaagttgtatgctcggagggtgatcccctggtcaaagatgtggtcaacttctttgttaatagtggactgacctctgctcaggttcagatcatacgctggtgctagatcgagtatgcgtgacctgcaattttctggtctgaggagatatgaaacgtcaaaaaggatcaagcattctctgaacattccattcaaaaatcgctctcttgcagttacattcgttgattccagttgagtcagaaagcacatagacatgtttactgcttttgtttggtgctatgatgtcagtagaagcaatcatgtattggttcctgtacttgcatccttctgtgatgttctgttgtacagaagatactgcatgtctgcatgtacatgcttgggtactctatttggcctttatgttttactgacatgatgttacactcctatgactctgctggctctatccccttccatgcttctaatgttcacatgagatcttaattttaggtggttctagaaataatgaacatggttatatatcaacgagctgcaacaatttttatatcagtggaaaacaagaaacatcacaaaactgttattttttttaatgcagttatatctttgttatgaaaatgaaaactgtcacactcgcacacattgttatggaatctgctgcgtcacacgttgtattctttgaaagaaaatgtcgcaaactgtcgtagcaagctgataagattttcagcgaagctgtcatagcaaacggcggagccatgaatttttgtcatgtggggccgactattaatacttcacattttaatgggatcatttatgcaaatcttaatggatttacacatgaaaattttaagactctcaagggtgtttgtgaaatagttgtggggccagccgaccatatagctaataggttggctcaaacactagttataaggggcttgagttaccatgcttgcttcaaaactctatgtaaatcttttagaaattatataaaaaaaataaaatatataatttctaacgtgttaaatcagccctaggcccgcaaatattttggttctgccgctgactgatcgtagcattgttgtagttagtaggtggtgagagagacataagacctgtttgtggagattaagattttgatatacagctggtgagaatctagagaagctatgaaacccaacctagattttgacttttagttcattttctagattccataactacaaattctcaaaatttggataaaaatctaaactgtttgagaaagcttctagcagctaaagattttagggaaaatgcaatttccataagcttctccaaattgacccatagtgatctacaaatgcctatgggatgacaccatatatatgttgcaggcgtgatggtccaacgatgggacgtttcaccattagcataaatattgtttcttataggagtacagtatccattcctcttatagtcacaaaataatgttgttctagacttttgaaagttttttttttgccgggttgacaaaggattagccggccaaatttcatcgatattttgaggagaaactgttaaaaatttaaccacgacagtatacccaaaactacctgagacaagcaagaaagaaagaactaaagtgttggttgtcggtccaaagggaaatctcctccattttctgttaatctgaaccatccatcttccatcagagggactaaagtaaaaccgcaaatacacccagcgtcccaacaaaaacaagcagtcaatcgagcgcttgagacgccaacaccattcgcgatttcgaggtacacctcccatcaccttcaactccatctcttctcgcatctttcttctatcgatgttcttcacggattcaatcttcaatctctgctcgagcgccgcggtctcaaatctttgctcacggttgagccgcggattcatggcttcttgattctttgattttgtttttcctctactgtgcagtttccacgcacgccacctgttcgacgaaacgcctctgggcgtgcgcgtgtgctcacgggctcacggccatggctccggcgcacgccgatggcaaggactggttcagcgcgctccccgacgacatcgtcctccacatcatgaccttcctgaccacgcgccaggccgtgcggacgtgcgtgctgtcgcggtggcgcaacctctgacgcaccgtgccctgcatcaacatccacatccatgagtttgggcggaacgaaaccggctttatcaagtatgatcaaaagatggagttgtcgttcaacagtttccttgacaaagtgctgaagctacgcgaccccgccgcgtcgatacgcaccttctgcttcaagttctacagattgaccagaatcgaaggtgcctcggcctcggaactcggaagatatgagcagatggattagccacgctttgcagaagcatatgcccgagttctggacattgttgtgttgtctggtaaactggagctaaaccactattctgcgtttgcttgccgcttcctcacagcaatcaacttcgttagtgttgctatgaagcaaggtttcttcaagcaactcgagaaaggctgcccatcgttggaaaatctctccttagatgaatgcatcattgtggatagtgacacatctcctctcagacactgaaggttttgagcatcattgatacttggttcccctggaagtacaagactactatttctaccccgagtgttaccattttttccttgtggtggctttgagcggcacaattgtgttcaataacatgccattactagtgaattcattgctggtacttcatgtcgaacaagcctctagtgatttctgccaaaatctcaggagcctttctgctgctaaaaatttgacctgccatttctattatgatgggaaaaaggtattgcaattgatcttagatatatatcccccctgcccttattatatgcatgcatcttaatataggtattgatatgaaaaataataaaacttaagcacgctgtttcttcttgacacttcacaattccactatattagttacctgtaccggcacaactaagcgtggcataaccaattcttatgtcatgaaatcatgactgatgccatcaaccatccaatgcaatctatttcattgtattcagctcatttatacataaataagacttttggtcaagcagacctgaattatcttagttcgctgttagatttcacaatgaaagtggaccatttcccatttggtaactggcatgttcttgtgtggctgcaatattgggttggccactgaaaattcttcttttcagaaatctaagtgattgcttaacttcaattgacattattaaatataaaattgaaaaataagataaatatgcttcagcaattgaaagtcttactcctgctgctacctcactatagattcgcgttgtgtttaaaatttttgacatagcattgtgtttaagctgatgtagctacctaattaacttgcatctgaagcatcttgactgttaatccacacgtgctaaagagattcattgagaccaaacaagtgtagcattgtttattctgattctttgttgacgcaatttctttttctagtggtcttttatgatccgctatgttgaagttatagttgtacctgcaccgcaaatataatacttattgcataatgttagtgctctgaattttgttttcaagtttctaatttaggtaatcatgtttataaatggccttctgcaacatagtcatttcaatattgtgcagctgacaattgaaaacaatttgcaacggtatccaaaattcatcaatcttgtcagcttgactcttggtcaatggtgtctggatgcaaatttctatggattaattgtttttcttcggaactcaccaatactggagaagctaaatctggaacttgaaaaggtaaatctttccctctaaatgtatactgatccaacttgaaagatttttagcaagcacacatgtcatcaggagaatatagcttacctgtttttcttggtatatatagcatcgttggggaaaaacatcacaaagaatgattggcgagcttgaagaaagatcatttacatgtgagcaccttacaagtgttaaagtcaaatgcttggcggatgatcccctggtcaatggcgttgtcaacttttttgttaaaatgggattgaactctgctcaggttcatatcgaacactggagccagccagctctaggatgaaaattcctgtctgagatatgaaaagtaaaaggatcaagcatttgttttttttttatataatggaagctttattgaaactcgatcaattacattcgtttgacattccattttaaagtcgctctctttcggatactagtgatcgtgcacgtgcaaggcacgtataagccaatatcaattaaaccagatatatcctctccaactaatataaatcaaactcgtcatattgcaagagaacatttttattatgcacaaaccatattaatagtggtagtaaaaatatgatataaacttatgatgcttatttcataattaaactccttgtgggtttcataatacattaagggactatatgtcggctattgtaaataaacctgttcaaaacttaaatgttcatgatctaaacagtatatccatcaaatccccgatacttgtgtttatgctatatacaactgtattctcatccacttatcctttcttacataacaacgcacaatacagattacaaagcaattacttgcaaagaactttgctagtgaaaaactggttgaaagagatagtaaacagataagtggaggaacatatagtgcttatgtatatcagatgaaagtaagataaatgtgagaaaatacaacgcacatacatggctataacttcgaatataacctttccatggcacttgcatttcataaagtaacatgagggtatgttgacaagtaactgcattagctatctttttctccctaatcagaatattttggagttacctgccaaatgtagctgaatttgttttaacaaatcgaaatgtagctgccaagcagcaagccaaaaagaggtaccaaaatgtgctgtcgttgttagctagttggatggctgcaagtgggaaaaggtcaaataaaacgcttgtatctcaatttggcaaaagatggactgattaaaaacacacatagacacaattttgcaatagaggcgtgatgtgcctgtatctcaatatagtaagaaaagatcagaatggccaggcagaaggaataattcttagaatgaattaacaacatgcgcttggatagacaataattggcatatggctctatatgagaaaacatcaaacaacagtttccatatttcgtaatttctgtcattcacaaatgaatcgcattacaatataacaagtataacttctaggtacagcaataatatagttaataaaatcatgtaaaaattgccatttatacagtataagcagtagaaatatgaagggccagatcaacgcagaaataattttgctaaataaccatccttgactttcatttgtgatgaacaaccaccttactgtattatatatagctctcttgctagtagtatttcaattagtgtatgtgaagaaaaaaaatcaaatattcaattagtattcatacattggtagaaggtcatgcccagattgttgtttgtgatcacattcttccttttgaagagagtgctcagccaatgtataggattggcctacatgatctgaagtcccctttctaatgcaagtagaaaataattaaggaatgaagctaatgttggtgctgataaaaaagatatggaattgaattctatcaatcatggaaaaagttgaccaataaacaatggcaaaattatggatagtagtgtgtctggcatataccaacattctgttttgcatgggctagaagattcaatgagaacagtgcagataccgtgttcgcaagaacaagacgatagtgcatatatatgagaaaaaaagtgaccataatccctaaccttgacacatgacaataatccctcctttgcatgtgcagttcttcagtgcaaactaaattcaccaaagaaatactcactgttaacaaactgcatctagtagacagtgttgctttccatcatctcgttgtcttgtgctcttaattcctgacaaatcaggaatcaaacaaaaaaaacaaaaatttagatgatggagtgatagtttgaaacaaagagatcaggctcatataatccctggaaaatcaggaatcaaacaaatttagatgatggactgatacagggaattgatggctcatagacaaagaagatgcggtcaagttcatggagctcatccatgaagtcgtgctggcactgacattgaagtcagccaggcctccaaccaatctaatttttgagtaaatacgctgagtatttttctgcaattttttgtagtcttgagaacaatccattggatttttttgtccatgagtgaatgaagccgttacctgcatcggatgcttcttcccggctgcacctcagggcactggcggtggggaaggcacgtgcggggtggagccctagcgctggcggcggtgaggcgcggactggttggagggcaggcaacggcgccggcgccggcagtagagaggcgtagccaccggcggaatttgaggggcaggcgacgacgcccgcggcggcggtagggaggcgcagccaccaggggaagggaggtgtgcccgatggtgccggtggtaggaaggcgcggccaccggtggggtggagggcaggcggcagttttgtcgaagaaaacaatttgcgggcggaagtgcggcgtagtcatcgcggggtcaagaggagatttcacctaacatattcacggatgagattattccaccttgcggatgaatagatgagataagatgaggtgatttggcatgtaggattggaggggtgaacttctcctttttttttatattagtatagacattctttgattccagttgaatccgtaagtatatagacatgtttattactagctttgtgtttttggttagaaaataaattaaaacctagcttctacattcaaaagaatgtacacaaccagtctagcttggtgctatcgtctatgacgtgagtacaaacaatcatgtctttcgttccatttaagggcattcatcttgtacttgctctctgttgtactcaaaccaagacggtactgctctgcgtatacatgtttgctcggggtactctatttggccttcatgttttgctgacgtgatacaatcccattatactggctctacttctttcgttccgtaattgttcacgtgagatatgaattatgtggttttgactgaacatggttatatctatatcattgagctgcaacaattttgatatctgtggcaaacaagaagcatcacaaaactgtcattttttgttcgtactgttatctttcttacgaaaaagcatcatcgcccacattcagctgacaataatttggcctctctaaacgttagcagtctcatatttttttcacttatgcttattcttattagctaaaactaaaatttttatctttaaatttgaagttgattttgggattttcttttccatcgtaatttattttcagcatttgcttttagatcgttaagaccacacatataaaagttttattcacaaattattttttatttgtaaatatgttatttcgttttttcctccaatatgcctaacgatggggctgcagaataaaacaatgctccaatttttgtactggatggacttgctaggcctttcataattttcggttagattttttctacatacagaaaaatatatggtttccatcaaggtattgaagtgcaatttgtatttgagtaattatctgaagagatatgtcattacaataaaagaatttagtaggggaatcattaagctaataagctcccgcgttctaatctttctgaaagaaaaaatctaataaactacatcaaccaaataattataatttcatatacttgaaaaatatcttcaagtcaggccttcgatcttgagcgagcagctgtgaaggctgcctcccaggtcattgaaccttctcctcagctccatgaagagctggatcgccatgacgctgttctgcccggccatgtggcggcgaggcagctgcggcggcagccggagcatccctccgacggcggcgaggccgccgtgcatgtggagcagcgacgccatgtgcttggcgtcgaacacctgggtgccgaagacggcgccgacctgcgccaggaagcccagcctcgtcgccggcagcggcgcgccgccggtggccagcctgaggaggaacgcgacgtcgtacatgccgccgaaggcgacccacgtcacgccacggaggccgaggatgccggaggcggcgagctccgcagcgaacgcgagggcgggcacgccggcgagccgcgcggcctcgaagtcgaacccctgggccctcaagaactgtacggactccggcgcgtggcggtggtagcgggcgtcgaaaccggcaaagtcgaaatcccacatgaactcgacgagggcgccgtcgacggggagacggccgtcggcggcggagagggtgatcccgagctgtagcaggcagagctcgtcggcgttcgccctcaccgccgcgtaccgatcgtcggcggtgacccccgcccctctcgggtgggggtggacgacgccggggaactgggtgtcgacggcgacgaaggggaaggtcggcatcagcgaccggatgagcgacatctcacggtggaggttcaccgccgtgaccttgcgggtgtgcacggcccgcgccggtggctgcgtgtagaacaacgattgctccatcatcctcggttgcgacgacgccatagacgaggacgacgaggcggccatggacgaacaccttgcttgcgttgtgtgtcgcactgtcgatcacgtggtgaggtgaggcgagcccggtgcgaaatatatagggagaacgctgagttctagtcggattaattagagtcgcattaattaatgagttctagtcggattagcgatgtattagtacgtctagtcggagggaggcaggcttctttattaaatgtttcttatagtcaccaccgttgatcaaatataaatgaaatgaagccattgtttagttctaaattttttcttcaaacttttaatttttccatcacatcaacacttttctatacacataaacttttaacttttccatcgcatcgttccaatttcaaccaaacttacaattttaaggtgaaacacacccgaagtactagttcgtttgtcccaccgaaaacgccgggatagaagcgacgccgtcgcgggcgccgctcaccctcgccggctcaccgccgttgcccggcccgcactgagcgcaaagctgaaggctccgtttggatcgtcgccggcggccggcaaaaccctagcgcatgcggatgcggctgcacgctcgagagtcaacaagtgtccggatcgaaaaccagatggattgcatataccattgacgtctacacatctgtatctctcaacggttggttatgtaaaaagtctttctacgtcttgatatgcaggtaatgtgtcttgttgttggtctgattactatgcaaaccacttcactagattattcgattcttttatccttcctccgtttcatattataagactttctagcattatgagtttaaaacacaatgctagaaagtcttataatccgaaacaggggtagaatatgattgcttcgtccttgatcatatatagctttaaatagatgatgcagatatatattatttacattggaccagtttaatctgaaaataatggattattattaatataacaggcagatatagattatttacattggaccagtttgctaggaaagttattacgtaatatggagtagtacttacatggcagaggcctcgattaatacattaagggaatgtttgcttgatgtctaaccttgccataactaagtttaggctagttgaggcatggtggcataagtgtggtttaaaaatggtttaaaaaaaagtgtggcttaaaaatagttggctacaagtgtggcatgcttagctccaactttgagagtatgacatgcttagctccaactttaagagtatgacatgtgggtctaaggctaagaaagtgtgttatgacacaattgcgatagcgaaacaaacacatacctaaaaaattgtgcataaaagtgtggcgtagcaatatgtggcaaccaaccaaacaacccctactatatagatcttcatactcattgaattgattgaattgcatatgtgcttcctatttgcaggtatagcagatgaaaacatgattattgttcttgtgtatgtgggtagaagaatccaatatggagctatgggtgcagaatatagtattcctctaaaaataacacttccagcatatgacactaccacattcaaagatatgagaaatgagatctttcggggacttggatatgatgaggaactgtactcaataagtatacaagctcggtttgattttgaagcccccggaccacattatttctagataattttaatttatgattttgggacgctgagcttaacatagtccgcctaggacaaacggaggaaatagtaaataaaaacatatatttagaaaactaggaagaaggacgctctggctgatagcgtcctaggcggactctgttaagctcaacgtcccaaaatacaaagtcaaaatgttttaagtttgaccaattatatagaaaaaatagtaatatttttgactcaagataaatttatcataaaaatatatttaattattaatttaataaaactagtttgataatgtaaatattatacgtattataacctaaaacggagggagtacttatttaatttcacggtaaataattattatatataaaaatttcgcttgaaaatgtttattttaaaaatcagaaactaaaaaagttcaaattgtttttcataaaaatccccaatcttcttctccattccaatggtggcacactaccaatgcgaggaccaccggatcctctcgtcgccggtggtgtccaccgtcgccgctcagtccaggttaaaggaagcaaacaaaccactcgtcccgtagtgcactcgagagaagacgcgagcaccattggaggtatggctcccctcttttcaccaaacgtttcttgaatcattccgctgatcaatttgtatttcttgtgctaagatcatgaatctttttttttagaaaacaggtcaaatacccggctttttactgaaagccaacgtaggctaagatcatgaatcttgcttggagttgagctaggattcatggtttactgatttttggtctctgccacgtgcaacagcagcataggcgggtgaaattagaaatgtgtagatcaccatcaccacaaggagggtgtcttaaagtagtatataattaagtatacgtatatatttccaagacattgatttcaatgcacacgaaatccaaccattttcaacaaatcatgtgtgtttagaagcaatttaaaattcaacatgtgtcaaaggactgtctaatctccgcttgacagaaaaagaaaaccctaatatgttgcaaattttgggtcgtttgattgctttaagattcgagcaaatctcccaaccctaatttccatcacctctttttctttcctcttttttattccatccccgccgccgcacaagccccccattctcaacttctcctcgtgactatgctcctgtgctgccgccgacccacaacgctgccgcccggcctcatcggcttgacgaaaagcggcgacggcaccagcgaggtcctctctctcgccggcctcctccccctccactctcctcctccacccttctctttctcctcaagccgatggtggtgaggtggtcccgccttgctatcttccccatctcctgtggtctctagtctctggatctaccaccaccaccaaccggcacctcgtagctcgcttgtatccaccacccaccaccgggccatcaccttctagatatatccatctaagcccgacaatacccgccctcttccctcaccctactctcatctcccacaccaaccttagaccctaaaccctaacttgttggattgtggtcgatcgttggatcttcgctggagttggaggagaaagggtcaccagatctagagaagaaggacatggggtcaaagtcgccggatcacaaataacaaagcaaatcttaaggtttgaaatttgcaagttttttttccctaattttctgtcaaataaacatttgtttttttaggtaaatgtcaaataaacatttagcaattagaaatgagatgactactaaaaaggaatcttttcttcttcatatgtgttggcgaacggcttcgtcagactctcgcggcgcgctccacgcgcacgacgcgcaccccgcgcacgacgcgcagcgctcctcgctccgctcgcaccgctgcacgtcccttagatcaggggattagttaggcccaggcaactcccaagccttgttgtacatgtataaatataagctccattgatcaatgaaagttacggttgatccaaatctccttctacatggtatcagtgaccctctgatcttagtcttccgctacctctcccttgctagccatgtcgcacagctccggcgcttccgacgcctcgtccacctctgacgaagagcctgtgccggcgccttccacctctgttcttcaaaccgtcaacatccgctcccacgtcccggtcgtcctcgatctcgacgtctccaactacagccagtggcgctgcagcttcgaatcggtcctcggcaagttcggccttgaggcccatgttcaggagccgcccgctctcgacctccgcactgccgagtggcgccgtgcggatcactgcgtggtcaattggcnnnnnnnnnnnnnnnnnnnnnncgtcttcgacgtcgtctacaagccccgcgcctctgccttcaccgtgtggagcgacatcgaaggcgtcttccgcgacaacgccgtccaacggtctgtctaccttgagaccgagttccgctcgatcaatcaaggtgacatgaccatcacgcagtacaccgccaagctgaagcaactcgccgacggcctccgtgacatcaacatgcccgtgtctgagcccagccaggtgctcaacctcctgcgcggcctcaacaccaagttccgctccctccgcgccagcatcgccgaccggaatccgccacacactttcatgaccgcgcgctcctacctgctgctggcggagctccagatgcagcacgacgccaaggctgaagccggggaggccctctacgccggcaccgggtcttcctccggcacctccgacaccaccggccagcctcgtcccaagggacggggcaagcgtcgtggccggggcggcggcgccccacctggcggcgctccttcgactcctggcggcggcgctggtgccgggcacgacggccagcctcgccctcctgcgccttggggctacaacccctggacaggctttgtccaggcctggcctttcccgttccgggctcccggcgcgggtgtgttgggccctcgcccgccgttccaggcccaacaggccatgaccgcgcagcacctgcttccggctcttcctccggcatctccaggagttcactccaccggcgcctgggacaacagtgcgctctacagcgccttgcagtccgccggcgtcgccaccaccactcctccgagcgctgcggattggttcctcgacaccggtgcgtcagcacatatgtcctccacccctggtattcttgctcatccccgtcctcttcctttctcctcttgtatcactgtcggcaatggtgccaagctgcctgtcacgcatacagcttccacccacattcccacatcctccactgatctacaccttcataacgtgcttgtttctcctcccttgattaagaatttgatctctgtgaaaaagctaactcgtgataataatgtctccattgaatttgatccaactggtttctccatcaaggatcttcaaactcaggtggtgaagctccgctgtgacagcccgggtgacctgtaccccctgcgtctgccatcgccacacgccctctctgcgacttcctcgccgtcggtggagcattggcatctgcggctcgggcaccctggctctgcttccctgtccaaggttcttggttcctttgatttccaatgtaataaatcagccccccatcactgttctgcttgtcatgtaggcacgaatgtgcggcttcctttccactcttcatctagtcagactctatttccctttcagttagtgcatacagatgtttggacctctcccatttatagcaattccggttacaagtattatgtggtatttcttgatgattttacacactatatttggacctttcctgttcgcaataaatctgaggtgtttcatactgttcgttccttctttgcttatgcacacacacagttcgggctccccgttttagctctgcaaactgacaatggcaaggaatacgattcttatgcacttcgctcactcctgtctctccacggagctgttcttcgcctctcctgcccctattcctctcaacagaatggcaaggcggaacgtatcctccggacgatcaatgactgcgtgcgcacaatgcttgttcacagcgctgctcctttgtctttttgggctgaagccttgcagacggcgatgcatctgatcaaccgacggccatgccgcgccacgggctccctcaagccgtaccagttgctgctcggcgctcccccgacgtacgatcatcttcgcgtgttcggctgcctctgctaccccaacaccatcgcgacagcgccgcacaagctcagcccgcgatccctggcgtgcgtcttcatcggctacccggctgaccatcgtggttatcgctgctacgacatggtctcccgccgggtgttcacgtcgcgccacgtcacgttcgtcgaggacgtgttccccttccgcgacgcgccatcgcctcgcccgtcagctcctccgccaccggaccacggcgatgacactattgtgctgctgcctgctccagcacagcacgtcgtcacacctgtcggcaccgccccagctcacgacgccgcatcgcctccgtcgcccgcgtcgtccacgcccagcagtgctgctccggcccacgacgtcgcgccgcctccatcacccgagacgtcgtcgccagcgtccgcctctccacctcgacacgccatgacgacgcgtgcgcgggctgggatcagcaaacccaacccgcggtacgccatgactgccacgtcgaccctgtcgccgacaccttcgtctgttcgcgtggcgctccgggatcccaactggcgcgcggcgatgcaggctgagttcgacgccctgctcgcgaacaggacgtggactctggttccccggcctcccggtgctcggatcatcaccggcaagtgggtcttcaagaccaagcttcatgctgacggctcactcgacaagtacaaggcacgttgggtggttcgcgggtttaaccagcgcccgggcgtcgactttggcgagacattctcgcccgtcgtcaaaccagcgaccattcgcaccgtgctgacgctgatttcctccaagcaatggccggcgcatcaactggatgtttcaaacgcgttcctgcacggccatcttcaggaacgtgtcctgtgccagcagcccacaggctttgaggatgctgctcgcccggcggacgtgtgcctcctctcccgttcgctgtacggtcttcgtcaagccccgcgcgcttggttcaagcgcttcgccgatcatgcaaccagcctcggcttcgtccagtcccgcgccgacccctccctgttcgtgctgcgccgtggctccgacacggcctacctcctcctctacgtcgacgacatgatcctctccgcgtcctcgtcgagcttgctgcagcgcatcatcgatcgccttcaagcggagttcaaggtcaaggacatggggcccctgaagtacttcctcggcatcgaagttcagcgcactgccgacgggttcgtcctcagccagtccaagtacgccaccgatgtcctcgaacgtgcaggcatggcgaactgcaaggccgtggccactccggcggacgctaaacccaagctgtcaagcgacgaggggcctctcttccaggactcctcctggtaccgcagcattgccggcgctctccagtacctgaccttgacgcggcccgacatcgcctacgccgtccagcaggtgtgcttgcacatgcatgctccgcgcgaagctcacgtcaccctgctgaagcggatcctgcgctacatcaagggaacggccgcgtttggcttacaccttcgcgcctcgacgtcgccgacgctcaccgccttcagcgacgcagattgggccggctgccccgacacccggcgttccacgtccggcttttgcatcttcctcggcgactccctcatctcctggtcgtccaagcggcagacgaccgtctcgaggtcaagtgcggaagccgagtacagaggtgtggcgaacgcggtggcggagtgcacttggttgcgccagctgctcggtgaactccactgccgcgttccacaggcgacgatcgcttactgtgacaacatctccagcgtctacatgtccaagaatccggtgcaccacaagcggaccaaacacatcgagctcgacatccacttcgtcagggagaaggtcgcgctcggtgaactccgcgtcctaccgataccgagtgcccatcagttcgcggatgtgttcacaaaagggcttccttcaagcatgttcaacgagttccgagccagtctctgcgtcggtgatacgacggctgcgactgcgggggggtgttggcgaacggcttcgtcagactctcgcggcgcgctccacgcgcacgacgcgcaccccgcgcacgacgcgcagcgctcctcgctccgctcgcaccgctgcacgtcccttagatcaggggattagttaggcccaggcaactcccaagccttgttgtacatgtataaatataagctccattgatcaatgaaagttatggttgatccaaatctccttctacaatatgtttattttttgctaaacaaaatgtttaggaagtaaggcggtatacgtacgaacccgtcccgtttgttgtaacaccattcaatccaaggtatggttccctcttttcatccaatctttcttgaatcattcctctctcggtgttcttcacagaccgatctgtatttctgctcgatcgaaaatcgtttcttgcgctaagatcttaaatcttgcttagagttgagctggggtttactgattcttggtctaacgcttactgtgcagctccccacgcgcaccacctgttcgacgaaatgcccctgcgtgctcggccgccaatggaggacgccgccggcagggacaggctcagcgacctccccgatgaaatcctccaccgcatcatgtccttcctgaacgcgcgccaggccgtgcagacgtgcgtgctgtcgcggcggtggcgcaacctctggcacaccgtgccgtgcatcaacgccgacttcgttgagtttgattccatcggataccaagggcccgtggtgccgttcaagaggtttgttaaccggctgctggagttccgtgatcctgcctccgtgatagacacattcttgctcaaatacgccatgccggacagattggatggatacaaggcttctaatgaagaagctaacaggtggattggccatgctttgcagaagcaggccaggattctagaggttgccgtgttcttcttcccattggatcttgatcactcagtgtttacttcattctacctgagaagaattgagttctcccatgtgtacttacgcaaaggtttcttcgagcaaattgagacgggctgtccattactggaagatctcttattacatcaatgcttcatttgggatggtgagatctcctcccagacactgaaggttttgaccgtcgatgcaactgaattatacacggtgaaggagatgtctatttctactccaaatcttacttctctgaccttgtctggtcttgagtatcccaaagctgtactaaaggacatgccattactagtgactgcatcagtatcggttacatttgatgcattaaacttcgacggttattatgatgctaatgacctccgccagtatctctggggcctttctgctgttagaaatctggagttccattatgagggtgcagaggtatgcttattgctaataattacatagtataccaatgcatgtttatttaggtaccaatgtgaaaactgaaacttaagaatgctggttcttcttgacacttcattattgctatactttaactacctgtacctgcagaactaccgttcatagctaattcttatgccgtgaaataattatgtatcgacaagataactgatgttaatgttatcaaccacaaggcaatacaattcatgtactctggtcattttttgaacataaatcgacccactgtcttgaaagtttattagttggtagtttgatctcgaaaggaaactagatcatttctcatgcaaggactcaaatgttctagtctgggtgcaatatcagggttgccaaccaaatatgcatcttctccgatatctggttgattgtttaagttgaaatcagtacaaataatcttatcttactttttgaaagaggggattgggggtgattgtaggttgtacactcaccccgagtccagacattttgtagctgcaaacatgcatgttgttttgtaagatgtttatagagaaaattttcatttgtgcccggcgaatatatttcatttgtataggtgatcatttggtcttgtatattcatgcatattttagatttcaggattaattgtttattgcatttatattttatagtatagttaattgggatgtgttacaatgcacggacactatgctagcattaatttgaaaattaagagacattccaaggcaatgtacaaacagaaaattaagagacattagtgctcttagttgggcaagtttggtgattatggaagtgtataatcatttaaatcttttgcagctgatgattgcaaacaattcgcaatggtgtccggaatttgtcgatgttgtcaacctgactcttggtgaatggtgcctggatgcaaacttccatgcactaattgtattccttcagaactcaccgaggctagtgaagctaactctgaaactcgcgaaggtaactgctttcctccaaatgtatattgttcctgcttgaaagatttttcacaagcacgcatatcatcaagaataaagctttacctgttttgtttgctataggatcgttggacaacaccacaaagaatcattggtgagcttgaagaaagatcatttacatgtgagcaccttaagattgttgaagtgatatgcttggagaatgatccccaggtcatcggtgttgaagatttctttgttcgtagtggtatgacatccgttcagtttcatatcaaacactggagaaaagacgaggagtataagttacctgcttttattcaatactaactgagtgcccatgcgttgcaacggaaacatttttctagttctatacaaacaagagatatgtcaccttttaatagtttcatggttcatactgcatttttttctcatggtgctaaaagtttagtacccagagaaaaataacaatattttgtgctatattcagcttgacacatgtatggttcattcatttcatctgcaattagataataccataaaaaacatatatgtttttcatgacagtgacaagaatgaatgatgagagtcaaggttgatttttttttaatcttaatcgacaattgatctgcgcggcagctacaattcaaatttaatactgccaaactgactgagcctaagcatgattgttgtccagatcattgttcgaattgcagtctcatgtagaacaccgaaccttctagccctttatagttttttttttgtgtagactggtttctaaaattgttttagacgggtgccctttatatttttcgcaagcataattgtactcctgatggcattttacactaaaaaactattcagaccaaataaatgttgacctggtttaatttagagagaaacaaagaatcaactgtgaaattactcgctagacatgatgacatgaaaatatataatattcaggatgaggtatgacaatgtgatttatcaggtccttgctatccataattatatcattaaaaggataataaaacaagcacaatatattcatacaattcactgctgaaaaagaagtgaaaattagttcctatttcttccaatggagacaattatccactgcatactacacttagtacactggaaagcccatctttcggactaaagagaagacaagatcattagagagtaaacagagaagccaaaaacaaatacacagtccttttagacagtaaacaaagaggacaaaaacaaatacacttggtgactgctaccactcgatcctcttccttgctaactcgttattcggcagcacaaaacatatttgtgatcaaagagaagttcagagaacatatataaaataactcgacctgtgagggtaagacaacctggacattttgcatagaagaaaaccttctcatgtaggtcgacaaaaccctgaacccctatcccacccttacacagtggtactgtaacccatatgagaacaaccaacggccttggctgggccttagacgtatactttggcgtgggacaaacgagggggttttgtaagttgtaaccccagcttgaaatttgttcctacggggagtcgaacccaggaaatgaggagtgctactagagccacctaaccaactcaggtagaggcccgcacatgattatttataaagatataatattatgtttgagttcaacacgcattgaagaatacgttaaacgtcagttgaaattgcagttcaatataatcttggtggttttgttcctgctcccaataattatttataaagatataatgtttttgtttgagtttcaacacatattgaagaatatgttagttgtaattgcggttcaatataatcttggtggttttgttcccgctcccaataaaattaattatccccccccccccacccccctttccccggtcacggaaaattatagaatctactagtgatgccactattgtggaatcaagatcttgattctttcagtgacaattcaaaaatagttgaaatgcgtcatgtgtaattttggatgatcatattaatttctagagtaaatttcactacaaatattttgaccaaactatcataaaactacaaatttaaagtgttatatcataaagttacatatttaacaccaattttatcacaaagctacagatttttaacgctaagtattgcaaaaccacatatttaataataaatttgtcgcaaaaactatacattttatgtttaaatccttagcccaatgttatgtttgagctagaaacatctaaattaaattggtgctaaacttctagttttattataattttattactataacatcctgaaaatccctaataataaaaatcactaaaatttcgaactttttaaaacttttgcatcatgctggatgttatggttgctattgcttgccaaactataaattgtcacgattgaagattaagctaaagccgtacaactaagaagtaattagaataagataattattattaatcctataaatatttgtgtacatgatagcaagccaaataaaacacaagtcaattattaataattacaaattttatgttaaatacttgaaccatgtcgacaagtgtcatgacatctaagtaaccacgaagtagtcgccactacaatgattttatatatataggagtgttccactagaataattaaattaatatttataactttcatcgagtctctcatgggatggattcactcatgtaaaataatttgtcatgcaaataaattgaactttatacataaaatatgtttatgtgagtgtttaattaaacatttaggtcaatattgtaccaagtatcaatttacttttatggaataatagattaaacatgtccttgtaaaatacattgttatacaaataaactcgaccaatgtgctattgtattattaaggtcacattagaatatttaattagtttttaagaaatatcaaagcttataggttatattggataatttttggataatttaatggaaagcaaattcatttgggaactaatgaataaccaaataaatattcaaatcaaacatttgaattctcaaaaccaaaatatattgattacatttcaattcaaattcaatcccattcacttttgcaaattagcccctccctttccttcctttccctttttcttccttttctctcttttctcagctgccactattcactgtccgccaaccgttcgatcccgtctaccgcgtgcaccacatcgcttccggccacgccagtcacgcccgtgccgcaccgcaaccgcgcctccttcccctcagccacgtccgaccccaaccctagccgcaccgcacttgctgctccgcaaccgcatcgcgttgtatcgcgccgtgcgtcgcatcgtgccggacccacgcccgcgccagcgtcgtcccttccgtgccgcgtcgtgccagggcccgcgccacgccaagccgcacctctaaccgctctcctggattctctccaggaaacacggagctgcgccatcgcccatgtacgcgcgtcgccgtcgccacgcctgccttcatcacccagacacgtgcgtcccatcgcccccatccacgcccaatggataaaacggagccctctcctccagctagcgcccagacctgcagtctataggttatatgtgtgatgattaagccacagaaccttaatggagaaggagatgaatctcagccgcgtcatccacctcattgctcttatccgatcaccattagtactctagctcgcctaggcatgtgctggtgatcttatccccatagtttgcttgcatcctaagcgaagccctcaacaaaatccccatacctctcagccttcttctcgtatgcatttcatcgaacaccttgcgatcaccctctcaccaccgctagagatcaccattgtgaggctccccggccggagctggaggttggacggagtggaggaagagccgtgctgccgccgtcgccatgggggaagccgggtagccgctggacatccagaaacgccgtcgagcaccttacgtcgccgccgtctgcccctgtcctgcaccgcgtcgagctccacttcgccgcgtttcgccatctcgccgtctcgcggtacaccctcgcgcctgtagcgtcctccatacatctaattgctagcgccggctccaaaatcggcgattagcgcccatggccgtgccgccccggccgccgtttcgtcgccggcgagctctccgtgggtaggctatcccgggagctcccctctccatatagttcgtgaaatcgaatccccataccccgtagatgctcccgcacccttcaattcggccggaggatgtccctagcaccgaagccccttgtagccgagctcgggcatggcgtcgcctgatggcgccgcgcgcccccgtctcctcgcgcgccggctgccattggcgggagattgccggagctcctccgcgcctcaccccggccgtcgccgagccgcccgccgccgtcccggctcgggccggccacgccgactgcgccgagccgcgcctctgcatcgctcggtaacgggcgagaggaagaagaagatgaggagagagagaaaccgtgtgggacccacatgtgattagcgcacagtaatcctatccctaacggtgattatcccactcaatggcaggtggggtccctatagttaaaatctaagaaaacacaattatatattttgttcctatgacaggcgggacccaatggtaattaaacaagcaagtttgaccctaagtcaaccatgccggtcccacatgtcaaccacactgggttttggataatgtttccgattaaaaataaatcatttatgaacagtgcatttttacaatttctcggattaactcaaatttgaatctttaaattagtataacttattcattttagctccgattcgagtgaaacttgaacctaaattcatctaaattcataagctttccaatggtatataactcattatttaataaaatatattaatatcaaatgattagattatggtcaacttaaaaatgtgctaataaataaaattgatattgtacagtagagtagatgtcaaataaatatatttaacatgttttgtcactgtagcaaccacataatctaagtataagtgatgtctcaaatgaatggatgtataggaaaatactagtgcttatttaatattcgatggccatataattaaattcatgacttaaaaattagttacataaagtttagcttcatattttgtaactaaaatattaatactcatagataaatctttaacttgtttatgagaaataataacagagctgggtgtgatgaaatcaatcgaatgatagatttaaccagtgcaatatcctatatagtagtatatttataatttggttgacacctattatttaacatattatttaacagaacaataaataactcatgttcggtaaataatccaattaacatattattggacttgcatgtacagtacatccatttaacacatacacagtaagtcaatcacctactgttgcacctattaaactatgaattgtttgataaacatcaaagttagataaaaacactaattataaatctagacctcgttacgaggccacgtagacaaataatctgtacctataacctcacagatctatatagagcatggatgattattaacccttttataatttataatgacaagtaaaatatgatcgtgattaaaataatgccccattggtaaaataataatataaatgattcactgtaattatttgattgatcctaaatctatccaacaacggaacctctagtatatgaccattttatttagatagatgcatgtgtagacataatccttccatagccattagctagactaaaccaccatgacatcagaaagactaagaaaccttagctcttagcttgattagaatccattagcaaacgcaagtagtatgagcaaccctaggttcgacctcaacaattatattttgtttgcgcacattggattgttgtttgaacattgatttttctcgcgtattatagtattggtgtatcgattagtcgtgaggcaacgtatgcagcttccaggaggtgaacgttgatcaatattatatcaagaataagaactatcctaagcaggcaagtcatcaccccattccctgagcatgttgatcccaattgtgaaattgttttgtttacaaataaaattgcatgcagtgatgaatatcctacttgttgttatgccatgcctttgattattgcttatctcattattcccctgtacccataattatgtatgagtccctagtcacttatgacaaatgcttagtaatgctaatttagattcatgcattctcatatttatcaaatgctttatgcttgggaaactaccttggggaggtagttgagatacggcatgtggagacatgagtgccacattgccatgacattgatgagatgatttgtgaaagaaaatgaaaactgaacaaatgttttcgactagggcggctggaggacttgggtggtgtccggaaaaggctagtgccgtccctggttagttaaggaccgagccatgaagctaagcatgaaacgacccccgtacaaccgtacttctcgtatgggtatagacctagcagagtaaatagccgagcggaggtagtatccctgcatagtggttttcttgatgtgtgtgaggcagggcgtacggtggggcagccattggtaggaccacgaggggcaggtgcctacagtggtgtcgccatcggtaggactgccatatgtaaacctaaacttaactataacttaatgcatgtgtgagtcttcccttcccgggagagccagaactcctctcactgctagaaaccttggacgcctagagtgcatgaggactaaagttcatggagcgggtactgccaaagtgaggttattgaaaggctttgccatgacgcgtctcatgtgttgggatgaggctcatgtgttgggcagtcacggagtatgggtaaagtgtacttccactgcagtgtgagtaaaccaatctattcgaatagccgtgctcacggttattgagcaccgggacatgtattacacttggctagactctaaattcttaaaatgatgggtgggatgttgcatgatgattttgtactggtggaacaacttctcgagaggcgagaagaggtagaccccagaaaccatgacgactagtggcgggaagctatccttgggaacacaatggatggtggacagaaccgtcgctgtttaatgaacaatggaattaaaacttgaccagtttatgctaggtcttaggtttgtgaaatgatatttgaaaactcagctttacgcaaagtaaccataaccactccttgtattatcctgtacattactgcatttttttgtggtggcttgctgagtacttttgtactcattgttgctctatatatatcttttagcagagtgttgaagagaagcccttgttagtacgcttgcgtacctaacaagatgatcggagtgtggttccattctaggtctcgttcccagtcgactgcttgtggcatgttaaccgggcccttgtattattttgtctttcgctgttgttctctgatagttatcggcctgcctggccctaatgtaagcatataactcttttagcctgaattcattcgtgatatgttgtgattcggctgtgtgtaccaactactgatccagggattggtactgataaacacagaagatttccgatttccaaaatcggggatcgacaattactaaatctaaatctatagttatgtaatacttcactttaaattagtagtcacgtgataaatttaatattaaacatgtagttttattatatatcatcttgaataaatatatagtcttgtaatagtttgatcataggtttattattttactcaaattttcaaaatgttaaaaaataagttccaacctaattgcataacttcatatcaaatcgctaaaagcaaaaaggaacacatggtatttgagcaagtactataaaatttctaaatactagtcataagataccaatcaagcttaaatggtaatatggaggagaggagagaagaaagaaatgagagtgaaatagagaagttaattggtgacaaatgcgttgaggttagtgtaatagaggtaatatattgtataggttatttttaaatttatgagaagatgacgtggataaaacttgcttgaaccaacttggggatggtgttttcaagcaggaatcctatctcgcgcagatgcgcgagcaaactaactcggatctactaggctcaccctaccctacactgcagttgttagcattttttttctctttttcgagtgatttcctctccttccgtcgttttcccgtgcaactttttgtctctcgtgattttttttctttttctcgcgcaattttttccttttttttttgcaagattattttttcccgtgtgctatcaggctaagtttcaacttcattttattttgaaaatttttgactcaaaatttaaaaacttctaacataaaattgaaaagttctaactcaaatttagaaattttcaactgaaaatttgaaaatttcgattaagatttgaaaactttcaactaagatttgaaactttcaatttaagatttgaaaaaattcaactcaaaattgaaaacttgcaaatcaaaatttgaaaactttcaaatctaatttgaaaactttaaagttaaaaattcaaaactttcaaatcaaatttgaaaactttcaactcaaaattttaaaaaaccatatccatttttttaaactttcaagtccaaatttaaaactctcagttcatcttttaaaattttaattcaaccagtctgttcgttattttgctataaataatcacgcttatgctaatctaatcgcgtttagcgctaagcgaggggaggggcgcgtctgcgtgtggcatggcgccgtgcgcgcgagttactgtagcagcgcggatgcgcgagttacgagagaagcggaaaactgaaaacgcgcgagatctcgcgtattactccttgtcacggacagtttgagagcgggaggcctcctcccaatctccccccttccccttccatagttccatggtggcgctcttcagacgcgagcgcgaggagcaccgggtccgcttgccggtggccggcctgactcgttagccgccgtcccgtccggggcgaaaggaagcatacctcgctcactccatttggaggtaatggcttcacccaatctttcttgaatcaccattcctctctggatggatgttcttcaccaaacaatgctgtattgccgctcaatgtagcatcgtttcttgcgctaagatcttgaatcttgcttggagttgagagctggggattcatggtttattgttccgttactgtgcagcttcccccatccgcacgcgcaccagctgttcgacgaaatgccaccgcgcgctctgcccccagtggaggacgacgccggcagggactggctcggtgacctccccgaggaggtcctccaccacatcatgtccttcctagacgcgcgccaggccgtgcgaacctgtgtgctgtcgcggcggtggcgcaacctctggcgtaccgtgccttgcatcaacgctgacttcgatgagtttgatctcgtcttttaccaaggggacgacgaggactatgatgacgtgctggcgttcaaaaggtttgttaaccgtctgctggagctccgcgatcccaccgccatgatagacaccttctggcttaggtacaccaccagaccagaaggaaacacgaattccaatgaagatgcctacgggtggattagccacgctttgcagaagcaggcccgggttttagaggttgtcgtgttctgctgcttatttgagctggaccactcggtgtttacttcctgctacctgagaagaattgcgttctccggtattgttttatgcaagggtttcttcgcacaacttgaagctggctgtccagcattggaagatctcttcttacatcaatgcggcgttcacgatgacgaaatctcctcccatacactgaaggttttgaccttcgatagtgtttttttctacatgccgatggacactgttgaattcaccttgctgaacaagacatctatttctcttccaagtgttacttctctgaccatatctactcccgagggtttcacacctatactaaaggacacggcatcagtagtgactgcatcagtatcagtatcagttacaatgtctagttttagatttcgttttgatgctaatgatctcggccagtatctccagagcctttccggtattacaaatttagagttcaactatcagggttcaaaggtatgcatatttctattacatagtatgcatctttatttaggtgtcaatttgaaaaacttaaagttaagcatggtgttgtttcttcttgctacttcataattgcaattgtttaattacctgtacctgcaaaacttatgggcattgtttggataatgggatagggaaatgatttcccaactatcaaaaggtatctttaaatcctaaccatttattctccctcttccatttaatcctaacccttcattcatttcctaatcccaatcccacccttcatttcccattatccaaacacacccatgattcaagtgatcattttgtcgtgaaatcatgatgtgttgatacgatgaccactgatgttatcaaccactcaatgcaatatagttcatccactccagccattttttgtacacaaatcaatccgttgaacacttgtcctgctgtttctttgttggtagttttatctcaaaatgaaactggatcatttctcatgtgaggactagaatgttctagtctggatgcaatatcagggctgccaaccaaatgtgcatcttgtttgacatctgactgattattttagttgacatcagttcacatcttaccttactttttgaaagagggggttagcggtgagctggtgattgtaggttctagacccaaccctagtccagatttttcttggctgcagacatgtatgcattttatttctaagatatttatagaaaacaatattgcaattgcatatgcggccatttggtattgtgtaatcatgcatgaaatcgttggtttccggattaattatttattgcattttatattttagacagtatgttgaattgggatatgatgcaacgcacagacattatgcatttatgctacataaatttgaaaattaagagacattcgaaggcaatatgcaaacagaaagtgcttcaggattagttgaaaatctcacttctagtgcttcatcatgaaatatttgtactgttctttttactagtttttgttacatgacttgcatggaaagtatcctagcagtaagttaacatgcctgagactcgcattgaaaatatgaacatgtataatattgtttagtctggtcttttgttgacataatttcagtttctcctgtggtcttttaccatccgttatcctaaagttgaagctattatacatgcactccaaatagaattctttatcacatattgttaatgctctcaatttagttgccatattttctgattatattcatttgaatctttcgaagttgacaatcgaaaaccatttgcaatggtgcccggaattcctcaatgttgtcaacctgactcttggtcaatggtgcctggattcaaacttctatgccctaattgtcttccttcagaactcacctagactacagaagctaactctgaaactcgaaaaggtaaatgctttcgtccaaatgtgcactgatcctacttgattgctttttacacaagagttttcacatcgggatatagatcacctgtttttgttgctgtagagtaatatgagaataagtcgaagaatcattggcgagcttacggaaatatcgtttacatgcgagcaccttaatactgttgaagtgatatgctcggagaatgatccccaggtcatcactgtgcaagatttctttgttagcagtggcatgacctctgttcagtttcatatcaaacactggagcccgtacgcgaatgacctaccggcatttattcggtcgatatgaaatggcaaaggatcacgaattagtttgccatcccattgaagaaaatcactctctttcgcctgtcggctacatctgctggttacagtagagtgttcagtgatcttgtttggtgctttctgctatgacgtgaaggtgagtagaaacaattgcatcttgccttgcatgtaaggtcagtggtattgtacttgtttgctgcgatcacatgatgatttgtagcaataatgatgctccaagaaaaatactgtatggctatggcgtctcctgatacagcctgccactgctttctcaacttggctggtctccggtgaaacgtattgtatttgtctctctcctaatataatcccatgttatagtgttgtatttgtgtttgtattaacaactgattcgaacggccaaacagattgatagctgttagattaatatcgattggcgttatatattaatagaagtttaagtatacatctaaagcctaaaagaaaggtaaaaactgcatatatatacttgcacgtcaggccttcctggcaataatctcgcaatgagcttagagaagtagtacaaccaggcaattccagatctgttccttgtagaacagactttcttgccatttataaactactccccagaatgaccagtgacgaggaaatccaacacaaattgtgtagccgaatttctagcaaaaaccgttgaaaaaaattcatcgtttagcaaagtgttttcataagatcatacttcctccgtttctccgtttcatattataaaaaaaaaattcatcgtttggcaaagtgtgctacgatcttgctgatttgatgtgaggagagtgattttgtgcatgtatatatagccacaaataagcttgagtaacagaagtaggctgatcagcttggacaaacgaaagcaattcatctttcagacccaaaataaagtgattaattagaactaaaccacaaagcaggggatcatacagtcgagtcgaatttgatagaccaactcattgaatttagagcggtattcattcacagtaccagtttgggtcaacaacaacaattcatccatcttaacactgcgcaaatacacatcaaattcaccagaggttgttgatttttatataggcaagtcatgccaccccacctcaagtttccacgcctggtaccaattagcagcttacccaattaaatttagtgcagccgcagagaccataaaaccctcagtaatttaatagaaggagaaatacgtcttacaattatcaatccacatacgaaccccggtaccatcaaacataggaaaaatccattttagtagtccagtggtgatgccccaagtcagccgtatgcgaaacatccaattgaggatcatgatgagatacctgacgttggggtgtacgaggtggcggcgacggtagaggtggtggaggctgtgaggaagaagccgccgatgtcgagtctggagtcggtaagatcagtttgctgacgcggagtggatggggatggtggagacgcaaccactgcggccttcaaggcgcgagctacttgcgtctactcttgctgcacttggccgagggaagtcatggagcaatcaaccttggtctgcacgtgatcctagcgctcgccctactgcgctaacttgaggttgatctacgcgaggtgcttggtgatgtcgtccacgccgtggaccttggccgcaacagctttcatgtcgtccatcaagcgctcctccatggactccatcgcggcaaccacttctacattacctagatacgacgatacggatacggatacacgatacggcgatacgccatcttcccaaaaacaaggatacagggatacgcgtatatatatatatatataaattaaaaatacaaaaaaaattgaagagtaaactagaccattagcagaacagagcatgccattgtcaatatcatgccaccaaccatcatattccagtatcttaccaaagtaagaacaatataaggctaaaccagtgcatatataagtgcaggattacaaatagtacacgaatcataaattaatagttcatcgacatacatagtttcacacatcacatcacagccagttcacagagatagtagatagcatcaactcatcatagagctaataagaacagagttatttaggacttcaaattcaactcaataactagatagttggataaaatcaattgttgctttcttccattgtaactgaagtggttgaagccccattatcgtcttgtatgtccaatgcaccaagatcttctagcaatatctcaagaataggctcatcaggtgacagtccagcgtgctaaagaaaattagcaccaccatcaaataactcaaagctatctcctgcaacatcccacatagttgatgggccactatggtactcttcagatttcctagaaagaagacgcaaattctggtgcacaaacactaaatcctcagcacgtgcagggttaagcctacaatattgcaattgtaatcagtttcaagcattactaatatacaagaaatcaagtaaggaaggaacagaacttatttcttattgaactatggatcaaaccataggtgctccaatttctttcagcacatgatgatgatgttggctgtccaagtaattttagtgccaaacatggaatcctaaataggagatttaccgacggcggcgacgttgcgccctcggagacgacggctgacgacggaggcgcggcgctgcggctgcgcccagcggagacgacggcggatggcggaggcgcggcgctgcggctgctgcagctgagggcggcagagatgcagcccgacgacggtggacagcggcggcgccgacgcagcgagccggcgacgacgcagccacgcaggagagcaagcagaggttgggactgggttgggggaggtggcgctggggtgtgggatttggttcgctcaatgcggctggggggttttgatcgtctgatttagggtttgtacgtatcggagacgtatcaggaattcttttatttatttggaaatagtaaaatggggggatacgtacgggatacgtatcggggcgtatccgatacgtatccgtatccggcgccgtatccgatacggatacatggactgaacggcgtatctaggtaacgtagaccacttgtcgggcttggacactctacttcgccgataccgtggtggaatgccaccgagcacgactgaacccgagcaggggatttacggcacaatccaaaggaaaagcaccaactcaagcaagagaattaccagcactagcccacatacggtggagaagaaccccaagaccgaaagtggttgataccaacttgtcacaacccaacgccggcggcgagactagttggaatcagtaggatagagtaaaacagaggagagagacatagagggagacagaggaagaagacaaagcagattggggaggattttttcttttcatttcataattaatttccaccatacagcctggaggttataaatacatcacagttcaccaactcatatgatccacatgtcattttctaccttttctactttatgctttctttatcaggaaacgactctaggcattatgcctcttctcttttatctactttatgttcctcttcatgtattgtagctgccctaattccctgatgtccgccgtgccattaaggtgtgacaccaacccatttcgtgctgcagactgcaaaggacgctgctcccaatatttcattgtgggctagggggtcgagacgagacgcgatgcgagagccatcggaggtacggttttcttcttgcatctttgccatctggaggcgtagccaaggggaataccccagaatttgggctagagaaccctccaccccaaatagccacagccaagaaacatctagggttggagggagtccagtccaccaccaccaggcgcgcctccagtgctccctgctgtccacgccggcgccgcgcctccccaccgtccccgccgccgtccgctccgtccccaccgtccaagccgccaagccgggggccgcgacggagcgactcctcgggtcgccgcctcgccggttgcgggttgccggcttggtggcttggcgcggcgccttctccagttctcttgcttggcaactgatccggcgctccaccattcaaccgacccctgttgaggtaaggtgaggtgaggtgaggtgaggatggcgatgatgaaccggacgcgggatctgctgatggaggggttcgagggcctcgtgcgggagggctccttcagctgggccctcccccgccgcggggcttcgccggtggacgacgccgatgaccccgacagctcctcctcctcctcctccggcaagcagccctccatctccggcctctcccccaaggccaacgccgtcgtctctcgctgctcccggtaatggcctccctacacacgcaattgcctagattctactgaaaattgggatttcttgggttgggtttctagggatgggaaatgctctggggaagcattttctttctgatatactactaggttactgcgttggatgtgacaattcttcgaaattctgcaattaagtggctgttcggtggctttatcagcaaccaatattactttgcatatgtttgaagatcgattattagagtatgtagtgctcaggatgtgctctagggcctatgagttcgtgttggatctgaaatgggtttggtttatgatgtccaaagtccaaacgtcaactgctgtgtgcaatgtagttcgttgcgtccattgtacttgttccgagggaattttaatatagaatcaaaaccatagctgtttaatatgtccctaaggtgggttttctttaagggatgttggtaaatgaataacttgtgtgagctaatatagtttatgtcctttcagaatgacctgcaattcttttattagcttgattggaaacatgttgatgagcatcctatgcttcatggaaccaatatgatgttgtttgcatttgctactgttctgttaagccaattggcatagttgtgtaatattagtttttccaaatcgctatgtcatgtaaaatcaattcccttttcatgcacaaacttatgtaataccagttttgctttcattaggtgctgaacatttgccttttgtgttaattacatttcagggtacttggtacttccacggatgagctgcagtatgactttgatatgcaagcatctgattccataaagcagccaagaaattatgcaagaaattttttggaatattgttgtttgagggcacttgcacatgcctcacaagttgcagggtatctttctgacaaaagctttcgtcgcctaaattttgatatgatgctagcttgggaagttccctcttcttcaagcgagctcactgttaaggttacaattttcctttctttactttcttaaatagttttcttttgttcacgccttatataatttgttagcgttgcattaataaaattttcccaggttacttcctcgtattaagggcttttaagaatctttctacatattgaatttcatctcctttcccttgcaggttgaagtagacaacacagtcagtttagaggctttttcaagaatagcacctgcaattccaacaatcactgatgtggtaacatgttcaaatctatttgatgtactttcatcttcaagtggaggccggcttacatttcctgtatatgataagtaccttacaggattggacaggtcactttctctactggtctgtccattcaattttatttgttgttggtttggatatttacatggtcagcaatagacagtgacaaactgccttttctaatttcatatcagcagtaattgaatgttatggaagttctcttgatgaaatgtctaccactagtaatatataatttatctgacaaatctaaatagttatatgcctcttagttgtcaaaatttgaatgtttgtatgcaaatgttgtaaaatgatgtccttttgagaatatggggaggcagggagtattacttaccataattatcatacatattgacttatattttctcttttgtttaccttccaaacgtacagatacaacttagatttacatggtgcagtgtagcagaaacaactagtttcttgtcccatgatgaatattttttttttcaaaatgaaatgcataaacatgttgtgcatctctttagtgcttattctcatcagtgataagtggataatccactttcttgatttaagatagagaaaatttgggcaaccattataggtctatagctctttatttctggatgtttaacctgttacaaccttacaatagatgttgttatcttcctactttgcactgataagtatatcacctgtttgagttaagattgatgtagtagatccccttgttaactattctccatagaaaattatggggcatatttccacaagccctctgttgatgtttatagaaacacacacgcacacttcccaatccatattttgttggtaattttcccatagtgcccatgcttaaagaggcctgtacgcatgcacgcagttagattttagtgaggtgatgcattaataccgtgcatgcaactagaataaatggaggtatttagataaaatagttggcttcctttggtctatgagccccaaaactatatgccgtacaattttctagggagggagtacccttttacatgctcaaagttgtacctgctaatacagggactagggtgtaatgtttatggtaccatagcatgtaaacaattttggagaatgaataaatgcaatatggtgcataccattatataggcatggacatagattctactatcaagttcaatggttcaatagcaagcaggttatctgattgttgaatatctttacatccttgttcatatagagataccattatatttccatcagttaatatacataacctactagtttgtactctgaatttagaattagtgtctgaagtaatataataattgggattcctttaaaacattaaccatttcttcatgctttaccatttttaaaggtagatctgtcataaatgaatgggaatatgggattgcatattgccaatttttgttaccaaaataagttcaattatgctcttttttttttctggagataggatatgcaagcataactttctgttggatcttgtttcataatgtcaggactgagagtatgttttacctcatgtagagcaattaagaaaatgaaaggacaatctgagtcctcgcttttatctgcccagcggtctcagagaggagaaaggattgtagaagtagatggaacattgacgactcaaccagtacttgaacatgttgggatttcgacatggccaggtatgtctgatttctcagtgaggagaaatgatttcttcttgtttacatgctggcatgttcttttaacttgccttgttacggttttatatcactgggtttcaacttttcctttcctggcacaggaaggttaacacttactgatcatgctctttacttcgaagcacttcgggttgtgacctatgataagcctaaagcttatgagcttgccgaagatctaaagcagtctgttaaacctgagctgactggtccatggggctcacggctatttgacaaagctgttatgtataaatcaacaactttgtaagttttttcacacttagcaaagcaaataagcaatagagtactacatctatgctacttaaaatgttagtagtggtggtgtccgttctgccacaccacccctaccactgatatttaggaccaataatctatagtattacacaaacctccaacgagtcctctcccgtttcactgttggtttatcttaaactttgaaatcacctacttattcaatctatactacttcaaatgtcagtagtggtggtgtctgttctgccacaccacccctgccactgatacttaggccccacaatctatagtattacacctacctccaacgagtactctcctgtttcactgatggtttatctacttatttaataaggaaaatcataaaagtgttaatttgactaaatatgtgcttaattgacttgataagctagaaactgaattcgttttccgttgcaacgcatgggttcttggctagtaaacgtaatagctgattcctatagtggtattttgctaattagttttaatttacaggtcgttgctatccattcctttttattaggagatagtagcaacatgtatccctcacctgatatccttataactagcacatagatttgctcttatcacctttagttacatgtttttctttattgttaatgcaaatgcagaacagaaccagtgatcatagaatttccagagttggctggccactttcgtcgtgactattggctggccatcatatcagaaattctctatgtccacagatttgttaggaagtttgacataagtggagttgacaaagaggaaacaattttgaaggctgtactaagcattatgcggctacaagctattgaagagttagccattccagtttctaatcgattcgagtctcttttgatgtttaatctatgtgacaaacttcccggaggtgatgtaatacttgaaacactagctggttctatatcatcgagaagatcaactcaagttaaccaacctggcactagcagtggaaggcattcaatgtccccctttactgttctgtcgaatcttggagtggtatcaccaattaataaaggtgagagactctttgttggcgagatagttgttggggaaatgagtgccttgcagaaggtagttaatgagtcaatgaacaactataagaaggttgaattggcccaagccacagttgatggagtcaaagttgatggcctggatacaaacttggcagtgatgaaggtatactcacaacagaattagccttttcaactgttaaggatctgttcaattcaatgtttgggtttagctactccctcatttttcgtgagcaggcttcctgatatgtgaacggggcctaattaatcagaataaattgtggtttatccaaattgatttcagcaccattttgatctgttaaattattcagaacaaaactaacctatttagagcttgtgcatcacaaaaataaaaagtaatttttgttgaagtatatatattcatggaaatagaaattaatcagcaattctttgtttgtgaccattcaccatatgttgtttttagacttcactgagatccttattccaatgtaatatttttgctgaagtattttgttggagaaatttgcctgatcatacctatattttccagcttttacatatttctgcatgatacataaaattccaaaattattacctctattttagagattgtatatgaattagaacttgccatattaccacttgttttgaaagttgtgaatgtagtaatttgaattttgatgaagagaatttattcgcttatggaaatttgaaggtataaacatgttcaatgcaaatcccgttgggtatgtactccctctgatcataaatatttgatgtttaggtcaacatttggtccaacttttcaaactttgatcatcaattatttctcaatgcttagtttaaaaaggaaaaaaatggtaagcatagattttccttgaaaagcactatcatattttctttatgattttataaacttattctattataaaattgatggtcaaaatttcaaaagtttgaccaaatcttgttttaaacatgaaatatttatgatcagaagttgtatattgtttttagccagaaggtttttgttcacaatattttatactattgttgcttgaaacatgtctagcaactatacagattcatccccgcaaaaaaaactatacagattcatgtttccttttttttatatcctcacttgtatttaggaattgctatctcccgtaagtgagctatggaggtttttggtgttgctggcatcttgggatgagccaattaagtccatggtattttgcttttcatcgtcttatatcattatcaggtatgctaaactctcatggatattttctttttggctttatgctacatgatgctttttaactgtggtacactatcgtgatttttttataactttgtgcaacttactaatataatgtaatataaacataaatcactagctcctttggagtgaatgttgcttcgattgcctctaatataatccaccccaattttaactagttcacgtgctttccatccaccttgctgctgccccgttgacttgaattcaaggataccatatactcccatttgagttgcaccatggaatgatgtcatcggaggtggtggaacagcagatggtgctataggaagctcctcatattaagaagagtggtgtagatgattctcatttctttattaaacacttgaatgatgattatgccttcctgcttataattacgatcagcgtaaaacctacctgatttaggaaggaagttaaactgggtcgaggtgaaaacaaaacactagaaaagtcctgtccttagtccttattatactgcatagcaatacctccatacaaaaagtgatagaatacttaattcaactgtacatcacaaattcatcagtatctagcatcttattgcagtgacactttaagcctagtagtagtaccacactagttctaaatgttgtacccaacatcaatccatcctcaacatgtagcctgattacctggtgaaaacaaccgtaaccactggattttgacattggttgaatactaagcaaaaacaactgtaaccactggattttgacattggttgaatactaagcatgtattaaatttgttgaatgaacaattaagaagcatagatcatatgtgaggtatattttcatagttaacacttgcagcaaattacttcagttcgacaaacacttcagaaatgagaaataatacttaaatatatataattatttggatgtttggatgtgtcgacatttttcagaaaattgtgaatccttgtgccaagaagactcaagctgttgatttcagctttcatatggttcttgtccatgtccatgtatcattgtgatgtagttacatctatatataccaattagtccttagccaaagtactaatgtagctgctacttgtgatctatgttcagtatttttaggaaattcttggctatcataacttgcatttgcacttgcactcatccacaaagtactgatgaggcttttcctagcttgaggaaggtacagttaataggattttagcattgctaataattttactctaataattattacttaacaaagtactttccttatcttccccagtgtgttcctataacatttcacccctgttggagataactcgtctttgatcaagaagtctggatagcacaagctaaaaccacccttctccaaagttgtacgcatagctgccatccctttccactaagcaaatacttacgaaaggcatattactaatctgcacgtgtaccacccagtcgtaactcgtaagtagggacatacttccataaaagatgtccgaggtgccttaggccctgtctagtattatgtacacatggcatggcatggtgttgaacctgttcgaaatagtgctgggacaatatgtcagcatcttcattctggtcgccatgccctacaatttactcacccaacattgctgcggaattctagaggcactaagtttcagtagtcagtatggactgcaaatctccacccctgtacagccaatatcaaattgcctttttcagtacaatgagctccatgtcttaaggtatgaatttgacatggtgggctacaaacctagaaccatatgtattttgggcttgcagttggccatgagtgtatatagaagttgagaagattagtataggttctactagtgatcgtagtgataaatctaagaagtaaagctatctcttgtgggctttgtggaagggaatgagagaaaatatgaggtagcatgtttctggccttggctggagagagtaccaaaataattcactggtgctgaggctatgagctatgtccaattattcttcctaattaaaatatattttacagtccttgtggagaacaactcatctaaatgttactaaataagtgcagccgtggatatccgtgcccaacgtttgaccgtccgtcttatttgaaaaatttatgaaaaatttgaaaatatttagtcacacataaagtactattcatgttttatcatttaatagcaataaaaatactaattataaaaaaatttcaaataagacgaacggtcaaacgttgaacgtgaatagtgcaaaactgcacttattttgggacggagggagtatcgttcctaacagccttagctataatgacattcttctgtaataaaacattttccttgaaatccaaggggacctgcaattattgctgttcctagaagaatgcgcccataatatgatgaatatttgttcttttgtgatggatactacacaattttttcattcttcacatttgtaatatcctctgtttttgtgatggcacagggggtggttagtctattttcttgttttggtgctcttgttttcggcagctttcatgttccttacaagactaactagccatggaaaaccaatgacggaggtcaaagtgacatctccacctccaatgaacacaatggagcagctcttagctgttcaaaatgctatttccaaagttgaagagcttgttcaggatgcaaatattgttcttctgaagattagagctttattgttggcttttccctcccaggtaactatatttcttagttcttattcttcatccttttagggagctagttactttgttcattcattttttgtgcttcctaggctaacaaataacattaacaatagtatactatgaatatatgtgcggtattcaatgagttagattttattgcggaaaggaaaccaaaagctacacttcagcttgttgatgaatgatgctatgaaaagaaaataatgatatgcgaactcaagaaaaacatagattcaactagaaagatcaggttagctaatcatttgaaatcaaatttactaacccactctgttttttctaagcgtactacagcatatgcatcttgtctgatatactgctaattattctacacatttagcatatgaacatttggtcttccatttatttttcttgatggtcaatagagactttttaaattttccagttaaattccttttgtaatttcaatcctcataacagattacgcatgtaacttattgtttcgaatttgtgtagtctatagaaacgagtggatgcttctgtgtttatgttacttttgagtcccaattgatattttcccttaaataaggtatcttcatcaatcatgaggtacaaactattgaagttgtttaaccttctgcatccactattattcagataatgattatttattattattctgaaagagagcatatcaggtcccaattgctccccctcttcattttatgaattggatgagcaaacaatcatttcatatttagttggaaggatttggaaatttgaactgaaaagtagtaaaaattagaagaaaaaaaagtagtcatcaaagaatatatgaggtaattccaggattgaagacgatatacagtctttcctccatccaattgtacagacctttctgccttgctggaccttggtctcaccttcagtcttttgattgtctcatagaattggaagatagatggcatcaattgggttgcaaaacttagatgaatatgttaaaactgttgataaaacttctgcatttttctaaactttgctgaaccttgtgagatccaacatatcttgcaccttgagcctatctatactcctatgaaaagaatccaatggtggtgcattggatctgccacgccacctattcccgttatagtttttacatattacacggtaaacttcttaacaatatgtaagaaccaaatcaaaatggagagccacatataaaattaaattaacgtgagtattacttatagctaaaaggtgggtaacatatttcatgaaaagtatgcttttatttattataggaaatgttatgtttttttttccgttctatcagtagctagttttttttttttgtaaaagataacatagcacccttcacttacctacattattttggttgtcatatttcacaggctactgatagagctatacttgccttggtagtgatggctctgagccttgcattcgtgcccacaaggttgcttgtcctgatgatgtttctggaggcattcacgaaccactccccaccaaggagagcaagcacagaaaggtggaccagaaggttaagagagtggtggttcagcattcctgcagctccagtagtcgtggagaaggataaagaagacaagaaaacaaaataaaagatatatatgtatattcaatgtaattatgtgccatgtttggccgatgggttggggtggatcaccaacgctcgtcttgtacagtagcagctagtatttttcaataaaaatgcgagttctcacctagaattaattgcttgcctcgtactttgattatttcgtatatagtttcatcgggtgatcgggaatgttggacaacaccccaggtttatgtgattttagctgaatttcttactgtttgtcgtcatttttcttttaggtgacaagtgggtttaacaacctagttttgccagttagggttcgtcttttggattcacatcacctgtctttgtaagttgagaagtgtccatgtattcacgataccctttgcatttcaggatttgccatccaattaatgtgtcgtccatggttctatatttgacgggtggtttttttagacagacccagtagtcaagggtgtgtaataaactctatattcgaagtgtggttagtataaaaaatcataaaatctataacgagaggcatctctatctggtcttacacatctatctggtcttacacatcgacacctggcgtggccatccgatttagtcggaagtatcagagtttagaatttgagagaaacatgagagtgtcaggcatgcatgtctttttttcccttcttataaagttttctcttaaatttcttatccgatatacaatccgattatactattttgatcattgcaattaaatctttacaacaagatattacatgattatattatgatgaaaaattataaattacttttataatatatctaaattacttttagatattactaaattacttcttagacaaataaaagtaaattcaataaagtcttatattatagaagtaacttaaaaaaaacattgtcatgacattagaagtaaatttgttatagggataaaaacataactctatatagaaattaaattaatcagcacaaattacggaattacctaaaaaaaataaaagtaatcacctcagagtattatgaatgtaatttttatatatgattaaagtaacttatgtatataataaaagtaatttacaaacataaaaattttttcatcataatgtaatcatgtaaaatcttgttgtacagatttaattgcaatgaacacaacggctaaaacgaaaagttgtatatcctggctaaaacgaaaacgttcactgcacatcatcatccaaattaaagcccatgacctttggaacgaatcgggtccactctggagcagggccataagggcgatggcctagggcccagccaaccctgatctagtatatatcctgtataggtatttagcccaatagcttagaattgatccttctcgttgattagaattgatgatccaatccatcgatccttctcacttgatcaggtgatgatccaatccattgatccttctcgctgattagaattgatctgttcttctaatttattttttccccattaaattaccaagattagggacttagggttctaccgttctgggttcaaccgttcaagggatcaatacaagtatacaaccattcaatgcacgataagtccataagctaattaaattaaggtatatggtggattagttttcattaggcctaggctcttgattatatagatttttccctcactgattttaggtcatagtactttgtttctactgtgttttttaagttttcaatcatactatcgatattatttatcgagaacaaattactatattgcaacttacaaactgcttgatttattatttaacatgttagaaatatttattgatattacaagttaacaaaaatagccttaacttctgaagggcctgtagcgtgaagttcgcctagggccctcgaaaatgttgagccggtcctagaatatgaggaacctggtgagcgagttgggtaggaacttcctcgcgaacatgaagtaggccgtcgtggtgtcgccgttgtagtcgcatgtcgtcccggtcccggccctgagccaccggaggaagtccggcgccgtgacccccattcttgtgaacctcgccgggtgtggacccacgtcacgctctggttggcgacgcgcgacaggtgaaggatgcccaggaatgtgggcaggtagtgctcgtcggcgtagcagttgcggctgcggtgcctcactaacacagggaagtagatgacgtcggcggcgaggcccctgtctacctcgaaccactgcgagtctgcgagcccttgccccactgcgcggcagtgatgacggggctcatgctgcgcttgtaccggccgcgccccgcgtgcctggcaagtcgtaggactcgaggtacaccttggtggtggagttgatgaggtacaagtacaccgtggacttgcttccgagcccccgtgtcgctccgctccagggcgacacgggaggcgactcgaggccgccccgccgccagccttctctccctcgcctcgtccgcctcgccgccacccgagcagccgccggcaaagccgggcggcagcaaggacggcggcggtggggccttctaccccctccaacacccgacggctggggccctgacgggaaacaggcggagggacggcgacgcgtcgaggtggctccggcgccaccgacggccagaggcggcagagccggtgtcgtcgctagcggatctggcccatcccccctcccccgcgtggccagatcgggacagagcggcgctggccgggcgccgcatcagaggaggacgaggcgccagctggggcagtcgtggcaccgacggagaaggccgacggtggctgacgcagcaccggctagggcagtcgcgacgtcgacggaggaggcgacgtcgctggcggcggggacgaggcgccgccggatctggctccctccaggccagatccaacgctcgctgctgggccatcgaaggaggctagctcccgggtggtggggcagaggaggcggcgacgggatggaggtggcgatgggatggaggcggcggcggcgacaacgacgagatggcggcggcaacgacgacgggacagcggaggcggcgctggtggcgggagaggcatgggcctggctgcgcacgacgccgctggctctggctccccccagttcggctccatgttggtatttcttaacgacattactagaaataattcccagcaatggcgcataaatactcctagtatattatggttgcagagttcatccgcaagcgcacagatataccattgtagtttttcacccgagagtattccaagggtatcgtatttgtttaatcatgtgggaagatcatagcagagagaaccgtactaataatttatatagcacacattcggcattccacaagacctacattcttttttaaattcactcgcagacaatactacaaaaagggccataggtgccggtttcccaaccgacacctattggtcggcaccaatactaacaaccgcacctatgatgaaaattgaactggtacattcagctttgctcgagccaaaaaaaaaagaggaccggtgttgatggtcgttagcgatcagtttcgaccgtcaatactaccaaaataaaggagaactagttatgcttgcaatgcatatttgtgttagaataataaatattccactagtactaggattactaaccacttgccgagaatgaacataaaatggaggagaatcgacatcaaaacaagcgatcaatcaatcggacgatgtcgagaatcagacttgtggaaagataggacaagaactcagaaataacacgaccaattgggccaaaattcacaagtttacaaagtatatcaagaggggaggccgccagccgaaattgggctggtttggcccggcccatggttcagctgaacccccacctgctccgttggatgtagggtttggcgtggacgtccaggattacaccccaatgacagttagagggcatttccaaccattccaattgccataaccgtcattgggaggctataaaaggagtttccatcctcactctctgtagacccccgattttaaaaatcggaaatcttctgtgtctatccgtaccaatccctggatcagtagttggtacacacgtacatagttggatcacaacatatcacgaatgaattcagtctaaaagagttaaatacttacattagggtcaggtaggctgataactatcagagaacagcagcggaagacaataataatataagggcccggttaacatggcacaggcagttgactggagaacgagacctagaacaagaccgcactccgatcatcttgttggatacgcaagcgtaccgacaagggcttctcttccacactctcctaaaagatatataaatagcaagggtgagtaccaaccgtactcagcaagccaccacaacaacaatgcgtatgatagaaggtatttcaaggaatggcttcaggttcttttgcataaagctagttttgcaattcttttcacaagcctaagacctagcatagactgttcaagttttaataccagtgtttacattaaacaacgacggttctgtccaccatccattgtaatcccaaggatagcttcccgccattgagtcgtcattgttttctgaggacgtccaccttccctcctcttgggaagtggctccatcagcataaaattcatcatgcaatatcccatcccacacaagttaagaatttagagtctagccaagtgtaatacatgtcccggtgctcaataaccgtgagcacggctattcgaatagatttattttactcacactccgcgactgcccaacacatgagccttgtctcaacacatgagacgcgtcatggcaaagcttttcgataacctcacattggcagtacccgctccatgaactttacatcctcatgcactctaggcgtacacggtttctagtagtgagaggagttctggcgcacccgggaagggaagactcacacatgcattaagttataattaagtttagattctcacatggcagtcctaccgatggcgacaccacgtagacacccgccccgcggtcctaccaacggctgccccaccgtagagccccttcctcacacatcaagaaaccactatgcatggatactgcctccgcttagctatctactccgctaggtctatacccatacgagaagtgcggttgtacgggggttgtttcatgcttaacttcatggctcggtccttaattgaccagggacggcactagccttttccggacaccacccaaatcttccagccgccccagtcgaaaacagttgttttcactttattttcctttcataaatcatgtcatcaatatcatggcaatgtggcgctcatgtctccacatgccgcatctcaattaccttcccaaaggtaattgcccaagcatatagcatttgataaatatgagtatgcatgattctagaatagcatttctaagcaattgtaataattgactagggactcatatgtaatcatggttacaaagatttaagggtgatcaataaataaggcatggcataatcacaaataggatgttcatcattgcatgcaatcttatttgtaaacaaaaattaatttcgcaattgggatcaacgtgatcaaagaatagtgatgacttgcctgctcaggatagtccttattcttgatataatcttgatcaaccttctcctcctagaggttgcagacgttgcctcacgactaaccgatacacaaggtctataatatgcgagaaaaaccaatattcaagcatcaatcaaatatgcacaaataaaatatatttgttgaggtcgaacctagggttgcttatactattcgtgtttgctaatggattccaatcgtgctaggggctaaggcttcttaatctttctatcgtcagcgtggtctatttaggagttaaccaacttagtataaatgagatacacatctagctattgtgtggtttagtctagctaatggctatggaaggattatggctacacatgcatctatttaaataaaatggttatatactagaggttctgttgtcgtatggatttagggtcaatcaaataattacagtgaatcatttgtattattattttgttgatggaggcttcactttaattatgaacatattttacttgtcacaataaattataaaaggttaataattatccatgctttgtatgttagagttgtttagattaatcatattatggttacagattatcccatcacataattttacaatgaataatcccaatttacagttgaactataattataattatatgaggtcaagatttataactagtatttatctaatgtacatgtttgtcatatactccctctaatttaatatatgcaacacgcaaattaatactataccgtacaactataatgggatgtatagtataggtgtgtgcgcaatgtcttaatattgaatcatttatttgaatagctactatttactacgagctacacagtacatgtgattttaagtggatttatgagtgagttaccgtctatacaacttaagagtcgatttccaacctaaacatatactactgtataggaaatgctgttaattaatttcgtgctggtgattttagtctcactagctctgttattatctctcataaacaagttaaagactcatctacgtgtgttcaacttttagttacaaaatatgaggctaaactttatgtaaataatttataagtcatggatttagttatatttggacatagactagtaaatggcattaatattttcctatacacccattaatttgaacgattgattataactaatttatgtggttgctactgtgacaaaacacattaaagataattatgctattgtacaatatccatttttatttattggcacactatttaggttaactattatctaatcatttgatattaattaatttataattataaatatattttattaaatagtaatttatataccattagaaagcttatgaatttagatgaatttaggttcaagtttcactcgaatcggagctaaaacgaataaattatgctagctcaaagttcctaattcaactaattgcgaaatggcactgttcctaatagatttatttttaatctaaccttatccacaagctatagtggctgacaagtggggtcaaggtcttgattttcttttctacagaattatttttctaagggaaattggatggaattaatgacaggtgggcccactctaacctctctcctccattctcttctctctctattctctgttttctcctctctctctcacggcttcggctagaaccggcgggcggcacggcccgacggcaagcggtgggggagggggaggctcaccggttcggcggcggggtcgacggagacgaggcggcgaggtcgacggcggagcacggcgcggcgacgaggcacatcgcggcggcggggcgcgtcggctcagcggcggcggcggcggcggcttccaacgaggcggcgacgccggggatgggaaagagaggggaaagggaggggaggtggtgggggtagtgtggggagcgatgggcagccggggaggggtttatataggcgcggggagggcggtcggcctaagggcgctgggacggcgcggcgcgcggagagcgaggcgacggtgacgcacggcgacgcgacggcgcggggctcggagcggcgacgcgacggcaggacggcgacaggcgagcggcgcgcggcggctccgggcgcgaggctgacggcgacggctcgcggcgcgcggcgatggcgacgtgacgggcgacgcgacggcggagtgactggcgcgcggcggcgcggcgcggcgcgcgcaggggcggcgcggggctcgagggggagcgcggggctcgagagcaccgcgacggtgagcggtgcggcaatgatggcgacgacgcggtagggagacgacgcacggtgcggctcacagcgatggcgccggcgacacgcgcagcgcacgcggagggaacggcgatgggacgcggttaggtgagggatggcgcggggctcggcgcggcaggagcggcgacgcgagggcgatgggacggcgcggcgcgacggtgacagtgcgcggcgcgggcggggctcgaggcggtgatggcgacgcgctggcgcggtagtggcccggggcccggggcgcggcagcagctcagggcgacagcgacgggcggcgagaggacgggcgacagagcgcggcgggatggcgggcgcaggcgcgaggcggcgagaggacgggcgcacggcgacgcgcgcggcttggccgagatgacgcgacggcgacggcgcgcggcgatgcgacggcgacggcgacggcgcggcgatggaacggcgcggcgacgggacggcgggctgcgcggcgtcagatggcgagggcgacggcactggcggggcgcgaggcagcggcacggcagggctaggcgcagcgcgggcagggggagggcagcgataggacagggtcgagcacctaggggcaatgaacagtactttttcctattttgcctatttgattgatttccttttcaaatcttgttttataaacctaattttcaccccaatatatgttttaatttagatgaaagtttaccaaattttaatattacccatattttattcttatatatatttttctattgtattatttaaatgaggtctaattctaaaattaacctagataattttggaggctcgagggctctaaaattaattaaaatatcctaatatggcccttattattacaatagcacattgaatgaacttatttgcatagcaatatattttacacggataggtttaatccaattattctataaatagtaaattgagacttggtacaatattaatctaattgtttaattaaaactcacatattcttatttatatataatcttaatgtatttatatgaccattattttatatgagtgattttcatgtcatgaggaagttggcgaaatgttgtgagtatcactctatatattccggtgaattacttatttataaacacgatcattataatggtgatcatcatttcatgtgttcttatatttcatgtgagattggattcaaatgaattggatttaatcttactatttctttagctaattgtgacatcaagctatcaatcatggttcgaatatttaatatctgaattgtaatttataatagaaattaatatttgactttactatcttgtgcataaatattggtagggttattaataaataacatattctcgtaaattatatctattgcttaaatttagatcttttctttactttctttgtgatcatttacggtttggcaaccaatagcaatcataacaaccagcatggtgcaaaagttttaaaaagttcaaaattttagtgatttttattgtcaggaattttcaggatattacactctctccacactcttcaagctaagctctctcatactctctcaagctttagtttagtattctcaagctagtggagtaggaagagttcgggtatggctccagcagctctcatttcttcttttgtaagacttgtactttatttagaatattcttctttatacatttctagtattgtaatactttccaagtatatgaatgctaactttactttatatccgaattatattgtttatattgctagcttatctgggagatgcaatggaacatgtatagtgtttgcttatgcaattactctatgtgatgacgatgatattagattagtatctggtagtttaggcgtagtgtctagattacaggatatcattatttggggttatatgctgcagatgagaggtgggccgctgatggtgacatctcagtacgggtactcctccgcgcgtgtatatagtcctaagttaatttcatggggagggtactcctccgtatttagtcccggttgtatggtcatgaagggcagtcataaggaactcgatagtcaggggtggcttcttgaagcaccaggagggcattggaaagagggtattagctagttaatcttatagctaggatgtatatataatatgtatactagaagtatatgaatagattcttttctattttctttccacttaactcagataatttattatgagaataagtagtcttatgcttgtgtgtcactctaccctttgcttatattaacccactctacaagtaatatataaattattagtacggttctctctgctataatcatcccacgggattaaacaaatacgatacccttggaatactctcgggtgaaatgctacactggtatatccgtgcgcttgcggataaactctgtaaccgtaatataccaggagtatttcgggcaccattgctgtgaattatatttctacttatgtcgttaaaaaataccaacaaccggctcgaattgagccgaactcactaagcaccatcactcccaaatcaaattgaaaaccccaaatcatccacaaatcatcaccaaaatcgattgacatcacataatgaacatactcaacaacaaaatcatccacaaatccaccaaaacatctaaagaaaatctacaggagacgtgggagggagaggggctggccctcgggcttcatgctccaccatctgcttcgttgctggtggttaggggagggcgctaccaccgctcgccgcctcccctcttgtgccgcggcctcccctcccgccggatccgatggaggggagggcaccgcctacaaccatcggcgaggtgcgccgcctcccctcccgtcggatccgacggagggggggggggcgccgccgcggcctgtcgcccgccgcctcccctcttgcaccgccactgacgcctctgccgggccgccatgcacaatagagagaagcaagagaggcgagagagagagagagagagagagggagagaggcaagaaagacagcgagagagaatgagagagatcgagagaaaggagatataaggctagctggatagggaggccgatgcttatggatagtttggttaatcaggtgcttatgatcaggtaattatatacatgatagttaagcaatgtgtatggttaggtagatgtaccttgctggggatagtgtggtgatggaaaacggatcggaggcctcgccggggtcggtgtggacatagacggattagagcccgcggtgcccctcaaagaacttctcccacagcggcgccaaacggaaaaaaattcatcatttggcaaagtgtgctatgatcttgctgatttgatgtgtggagagtgtgattttaatttgtgcatgtatatatagccacaaataaagcttgagtaacagaagagcatgagacaagggtgacacgggtggtgaccgccgccggtacgccaccacccccgcccaccttcctcctccgcctcaccgccgcccgagcaggccaccagaaaccacgcggaagccgcaaggatggcggcggcggggcctccttctcccccgaagtcgcggggtcggagcccacgaccccggccagctcttgggacggcgtcgtgacagcctagccgccggcgtcgaaggtgacgagttcggtggctgggtggaccgggtggtgacggcgaggcggcgacgccggtctggcgccctccccgctagatctggcaccctaccgtccggatcctgcctcctcggtgtgggaggccggccccccgtgctggcgacgacagcgaggtgctggggtacggcggcgttgccgcgaagctaggtctagcgccccttgccagacccggtctcctgagccggtggcggacgtggagtggacggtacgacggtggaggccggtgagacagcaggacacgactgtggaggtgacggtgtgaacgtctgaggcgagagcttggcgagagggtgcaacgacgcgacgtcgacagtggccacgcccatgcggtgcctttggcggaaggaggagacagcggtggggatggaagaagttcaggtgttggctgggatccggtcgcgccggaggtggatcccccctcccccctcccctgagggcggatctggtgcggggagagctcgcggcaacggcttcggtggcaacgacgcagagctcgtggtgacggtggcgacaatggctggacgacaacgacagcgggtggctggccaacggcagcaacggctgatggctgctgtggcaacgaggtgcacccgcggcaggagcggctgtcacggcagcgacagcggctggacggtggcgataatgtggctggccgatggcagcagtggctaccgtggctgcggtgggaggaggcatggcggacttggactgctagctgggggagtggcagacggccacacctggctggcgcgacagcgattggacggtggcgacaatgtggctgggggggcgctggtgcagtggtcccacatgtcgccagaggatgagcggtggtggagcattggtgcgtcagccgtggacttgtatgtggtgagcggcgggtgaaaacccagcccggccttggctggaccgacaacaatggttcattccccctcctgagggtgttgtcatgccgtctcatcccttaagggtggttgccgggcgaaagcccagtcttggctctttcgagaccctgacggacagtggcggctgttttccgtcgcttctctccttggagatgtcgtttaggcatccccttgccaaaactactcgaatgattggtgcaagcacgcttaggatggagttgggctttgtgttggttgtaagggcgttttttgggcgatctcgtctgtgttcctttgttggcctagcgatagtcgttcacgcttagcgacggccggtccggtgctagtcttctcccggacctgtgtgttggcgctgtcgatgtgtgggtagtggtatattttttttcctttttcctggttacgatcttcagggctgtaatcttgtaattttttcctactctatcaatagaactttacaccgtctcttgcgagtcgttcaaaaaaagagtaacagaagtaggctgagcagcttggacatttaaatgaacgcaattcatctttcggacccaaaataaagtgattaatcacaactgaacctcaaagcaagggatcatacagtcgaatttgataagaccaactcgttgaatttagagaggtattcagtcacagtaccggtttaggtcaacaacaacaattcattcatcttaacactgcgcaaatgcacatcaaattcaccaagagattgctgattttaacataggccagtcatgccaccccacctcaagtttccatgctagataccaattagcagcgtccccaactaaatttagtgtagccacggagaccataaaaccctcagcaatttgatagaaggagaaatacgtctcacaattatcaatccacacacaaaccctagtaccatcaaacttaggaaaatccattttagcagtccaatggcgatgccccaagttagccgtatgcaaaacatctaattgaggatcatgatgagatacttgatgctggggtgtacgaggtggtggaggctgcgcggaagaagccgccgatgacgagtctatagagtcggtaagatcggtttctgacacggagtggatggggatggtttagacgcagccgctgtgaccttcaaggtgcgagccacctgcatctactcttgctgtacttggccgagggaagtcatggagcgatctaccttggtctgcacgcgatccaagagctcgtcctgctgcgccaacttgaggtcgatttgcgcgaggtgcttggcaatgccgtccatgccgtcgaccttagccgcgacagctttcatggcgtccatcaagcgctcctccatggactccatcgcggcaaccacttggcggacttggacactctgcttcgctagtgcagtggtggaacgctgtcgatcacggctgaacccgagcagaggattacgacgcaatccaaaggaaaaacaccaactcaagcaagcgaattaccagcactaacccacagacggtggagaagaaccccaagaccgaaagcgactgaataccaacttgtcacaacccaacgttggtggcgagactcgctgaaatcagtaggacagagcaaaacagatgagcgagaggtagagggagacatgggaagaagacagcatattggggaggtttttttcttttcatttcataattaatttccaccatatagcctggaggttataaatacatcaaagttcaccaacccttgtcggtccacatgtcattttctactttttctactttatgttttctttaccgggaaacgactctacgcactatgcctcttctcttttctctacttcatgttcctcttcatgtgtcgtcgctgccctgatgttcaccgtgccatcagacgtgacaccagcccattccgtgctacagactgcaaaggaggatgcctcaagccacgactgctcccattccgtggtgcgctggagagtcgagacgagacgcgacgcgagcgccattgaaggtacggttctcttcttgcatctttgccaagagctcggactaccatagaatttggcccgggccccccccccaaaaaaaaggcccaaataccctgtttggcccaagaagcccaaaaacagctagggttggagggagtccagcccaccaccaccaggcgctgctccacgcgaccacgccgccattgtcgtccacgccggcgccgcgccgtccccgccgtcgtccgcgccgtccccaccgtccaagccgccaagccgggggccgcgacgctgcgacagcgattcctccagtcctcctcgccgcctcgccggttgcgggttgccggcttggtggcttggcgcggcttgcccgcccgccttctccagttctcttgcttggctgctccacgtctccactgatccggcgctccaccattcagcccaggtaacgaacagatcaacaaaacactagaacggctgcctaaatcgatgtgtgattagagatcagtgaatttgtgaataagaataactgaatatgcaatttataagttgttactgattagtgaatgtgtgctattgtttgtaggattggtaaaacatgaagaggagcggagatattgcgtcattatttgggaaccatgaagcaaaaacaatggagattccagaatcttctagttcttcgaatgtattcattggtgatgaagctcctgtacctgaagaagaaccacgacaagttcctacagatgctgtaagacattatttttatcgcattttcactaaatttgtatttgtatatcggctttatggtacaagaaaattttagcatgtgacatgaacgtgtgaactagcactacccaagaaaaaattcctagctgcgccactgactgggagttcttcaccggtagattctgctcgcgaatcgttgcttgcactgcgatctcagttcttgcttacttgcgctgttgattcgtatgaattcatggcttcttttggtcttccgctcttgtgcagtttccacgtgcacctcctgttcgacgaaacgcctcttcggtatcggccaccatggataggcgtcctgggaggcacaagctcaggcgggtcaaggcccatgtgcgcgctgcccgaatggaccggatcagtggcctccccgacaaaatcctccaccacatcatgtccttcctgaacacgcgccaggctgtgcagacgtgcgtgctgtcccggcggtggcgcaatctctggcgcaccatgccctgcatcaatgccgacttcgatgagtttgatttcattgcttaccaaggggacgatgaggactacaatgacgaggtggcattcaagaggttcgttaaccaaatgttggagctccgcgatcccaccgctatgatagacacattctggctcagctacataatatgggacgggtacaatgaatacaaggattccaatgtagatgccaacaggtggattagccatgctttgcagaagcaggccagggttatcgaggttgtcgtgttcgcctttccattggagctcgatcactcagtgttcacttcatgctacctgagaaaaattgggttctcctgtgtttctttacaccaaggtttcttcaagcaacttgacaccggctgtccagcattggaagaactcttcttacatgattgcatcattgcggatgaggagatcttgtcccagtcactgaaggttttgaccatcgacggcactgaattctccatggctaacaaggcatctatttctattccaagtgttacttctctgaccttgtctattgaggattccacacctatgctaaaggacatggaattactaacgaccgcatcagtatcagttaaatttaatacattcatattcagttatggttttgatgctaatgatctccgccagtgtctctggagcctttctggtgttacaaacttggagttcaattatgagggtacagaggtatggttatttgtattacttagtgtatccacccaccttgatttagttatcaatatgaaaaaactgaaacttaagcttttcttcttgtcatttcataattgcataagtttagtagcctgaacctgtaaaactaacatcgcagagctaattcatatgttgtgaaaccatgatgtattgataatatgacggatgttatcaacatttgatgcaatctagttcatgtactctggtcatttgtgcattaatcaactagccctgaagttttttatttggaagtttgatctaaaaaatgaaacatgatcatttctcatgtgaggactttacatgtcagtctagatgcaatatcagggttgtcaaccaaaaatgcatcttatccaatatctgatagactattttactttagttgtactttttgaaagagaggtttattggtgattgtatgttctacacctgccccaagtccagattttttgtggctgcaaatacgtgtgcatgctatttgtaggatagtgaaagaaaagtattgatttgtataggcagtcattttctcttgtccaatctttcatgtaatttttagatttcaggattaattgtatattgcattttatattttagatagtatatttagttgggatgtgtaatgtgttgggtgttacaatacacagacattatgctagcataattttaatgttaggagacattaaaaggcaacatacaaacagaaaattcttcccgggaattgttgaatgtctcactcctactgcttcctgatgatatatttgtgttgtttttttactggttttggacttccatggaaaccatcctgacagtgagttcgcatgtgctcgagagattctcggtgaaaacaaacaagtagaacattttttattttggtcttttgttgacatcagttcattttctcctgtgatcttttgccatccattatcttgaagctctcaatttagttggtaagttttgtgattgaggaagtgtggtgtataatcgtttgaatcttttgcagctgacattcgaaaacaatttgcaatggtgcccagaattcatcgatgttgtcaacctgactcttggtcagtggtgcctggatgcaaacttctatgcactaattgtcttccttcagaactcaccgagactagagaagttaactctgaatcttgcgaaggtaattgctttcctcagatgtatactgatcctgctcgattgtttctttttgcacaagaggttgtgcattgggaaataacttactgtttgtcgtgctacagtgcattgcagataaatctccaagaattgttggcgagcttatggaaagatcatttacgtgtgagcaccttaagattgttgaagtcaaatgcttggaggatgatccccaggtcatcagtgtggaagatttctttgctagtaatggcatggcctctgttcagtttgatatcaaacactggggccaatacaaggacgagttacctgcatttattcggtatgaggagagatgaaatgccaaaggatcatgcatttgtttgtcatcccattgaagaatcaactcgctttctgctacattcactggttacagtagagttttaaggtctcctgcatttttgctggtctctaggaatggcatccaataacttgctagttttcaactgaacaaatcgagtaatgtgtcattctactcctaatctctggttacattagcagttgttcaaccaagaacctatttatcccttgtacaacagaatttctttccattcatcaactatttttgtcgagtctcttcagtttcgttttcattttacaaaaacattcttatgtagattaaacttttttcccatcacgacgtgagcaagtacatatcacagcaccccaccacacaaactgctcacttaattggcttcgccaagaatgtgcaacaatcacgatcaacgaatcttcatggcgacgaaatccaacaatttgtgttgccacatttttggtaaaacctttgagagaaaaaaatcatcctttaggtaaagtatttatggagtaatcctttaatagataacgctgttgactttttacatgatatttccattcgttatatttaaaataatacataaatttatttatgttgttgtgaaaagtttaccattaaagagacttttaaatatgaattatattttagcatatttacattaattttgaataaagcaaataatcaaacgttatttcaagacaacaaatcagttgatgctgccacttgagattttaatctaggtatttgctagattttcgaatgcctaaaattttgtaaattttcaggcatcataaatcttacattgttagtcctaaatttgcaatgctatatgatgtgtaattttcagttcattttatcttcaacttctttgttatataccgttttagtttatttactttatcaaagtttttttgcatgtaattttatgaatttcatatttagattcatttttttagtttctatttaaaagagaagggactttgtttataaataagtaatagacgagtgatgatagcaaccatttgattgtcatccaaagaataaaaaggtgattgaaacttctgaatatttctgtagcctgaaatcaagagacaccctgtaatatttcatatggccatcaaaggtagctcaaataaactggccatttcagaaattattgcacttttttttactggtatggaaaacatttcgtttcacctatcatgcataatctctcatgttctgttccataatatgcaccatgtctaacaaaagagaaactatgcgtggtaatgccattatcttcttgatggtaatataagaaaaaaattatcattgtttcttaaacataataatataagaacaaaatattttttttgaattttgtggaacaattagagtggacggtaattgtggctttgcaaaacacaaaagaaacaagaagacagttgtacatcttgggccagaatagacaacagggcccagcccattggcgattatcagcccatctaacagagtagtcaggttttttctattaaaatggaaaagacgtggtgcgctcgagacgcggccgccattggagctggaggtacggctccctccttccttccttcccccatccttgctgcatctttcctctctgggagttcttcacgggcacattcctgctaggcattcgggactcgatcctttcactgacatctcagcttttgatttgatttgtgctgtggattcatggcttcttgttcttccgctcttgtgcagttccccacgcgcaccacctgttcgacgaaacgcctctgcgtgcttggccgccatggaggggcgttcttgcagttgcacgcaggaaggtcaagaccccggcgcacgctgccgggatggactggatcagcgacctccccgacgaaatcctccaccgcatcatgtccttcctgaacgcgcgccaggccgtgcagacgtgcgtgctgtcgcggcgctggcgcaacctctggcgcaccgttccttgcatcaacgccgattgcaaagagttcgacttcttcgggttccgaaggagcgaggtggagttcaagaggtttgtcaaccgactgctggagctccgcgaccccatcgccatgatggacgcgttctggttcaggtaccacaaattggataccgacactacttcctctgcagacaccaacaggtggattagccatgctttgcaaaagcaagcccgggttctagaggctgtcatgtacccctgccacctattggatctcgatcattcaagttttacttcacgctacctgagaagaattgggttctccggtgttcgtttagaccaaggtttcttcaagcagcttgaagctggctgtccagcattggaagatctcttcttacatcactgtaccattgaggatgacaaaatatcatcccagacactgaaggtgttgaccatcgatagaacttatttcttaattgcgatcaatgccactgatgttcagaagaaatctatttctgctccaagtgttacttctctgaccatgtatagtcctgagggttcgttacatatactaaaggacatgacatcgctagtgactgcatcagtttcatttagtgaattcagagttcattttgatgctaatgatttctaccagtatctatggagcctttctggtgttacaaatttggagttcaattatcagggtccaaaggtattgctattacatagtacaattactgctactacatacattcactcttctttattttggtaccagtatgaaaaactgaaagttaagcattgtgtttattcttgccacttcattattgcaaattgcaataatttaattacctgtatggctgtacctgcaaaactgacgttgcagctaattcttgtgtcttgaaatcatgatatatcgataagataaccaatgttatactctatgcaacatagttcatgtcctccaacctttttttttttgtacttaaaatcaatccgttgaacacttgtcctgaagtttctttgtcggcagttttgatcttgaaatgaaactggatcatttctcatgtgaggactcaagtgttctagtctaattcttcaggaattgttgaaactctcacttctaatgcttcctcatgacatatttttgttgttcttttcctggttttggctacatgagtgtcatggaaaccatcctgatagttagttaacgtgctcaagagattcacattaaaagaacaagtataacattgtttagtctggttttttgttgacataatttcattctctcatatgatcttttaccaaccattattttgaagttgaagctatagttatacgtgcactgcaaatagaatattttatcacatactgttagtactctactgctctcaatatatttttgttggcaagttttctgattataattgaatcttttgaagctgaaaatcgaaaacaatttgcaatggtgtcctgaattcgtcaatgttgtcaacctgactctcggcaaatggtgcctcgatgcaaacttctatgcactaactgtcttccttcagaactcaccaaaactacagaagctaactctgaaactcgcaaaggtaaataccttcctccaatgtatactgattccacttgattatttttcgcacaagtttgctcatcagaatattgcttacctgtttttcttgctatagtgtacttcggaaatacaccaaagaatcattggtgagcttacagaaagatcatttacatgtgagcaccttaagattatcgaagtgatatgcttggaaaatgatccccaggtcatccgtgtgaaagatttctttgctagtagtggcataacctctgttcagtttcatatcaaacactggagccagctaaaagaggataagttaccggcgtttacccgcattcctattccgtcccattgaaatcactctctttcggcttacttggctggttgagttctaaggcacgtcgacatatttactggtctggtttgatcctctctgctgtgatgtgggtacaaacaatcttgtctcgttgcatgtataagtaagtatagttttttttttggggggaaacacaaattcagtcgttagcctaaaatgttcctccatgaactaggactgtatatggtatcatatttgagtactatatatatgatttgcatgttgcaatcccatgacatgctttcacttgtagcatgcttctgtccggatgagtccattctatagtactttcattttaggctgatttggtattctggtcaagcttcagctggtgattacggggcatactcgatacttcccgtcgacaactggagtagtcattaacaactgtgttaagcccttaccctgaagtcactaacaactggagcttcattctcatttctcattttaatctaaataggaataggtctgcttcgccccttaaagtatgaaagagaattttctacacccaaaaatatcaaaaccagttcaaatagcctcctagagtggttttattatacacacgatgacatggactatagaggagactattgaaatgggctaagcactttattcacaagtgaaatgggctgataatgatttaaactagtgttaatatataatgtttaggcttgccgacatgtaagtgaaaaataatagtaagatcaacttggatttgctatgctaatctttatgccatgcaagctaatgccgctaccacatacccatctacatgtcaaaaccacctacaaaaccacttttggggttatttaaaccggtttttcatatcagtttcgtactttagggggttaagtaggccaaccttaatacttcagggggtaaagtagacttagaccctgtttagatgggactaaaacttttaagtccctatcacatcggatgtttggacactaattataaatattaaacgtggactattaataaaacccatccataatcttagactaattcacgagacgaatttattgagcctaattaatccatgattagcctatgtgatgctacagtaaacattctctaattatgaattaattatgcttaaaaaatttgtcttgcaaattagcttttatttatataattagttttgtaagtagtctatatttaatactctaaattaatgtctaaatatagagactaaagttaaagttaagtctctggatccaaacaccaccttactccatccaaataattgaaaggtgaaaatgtgaaaccctctatgcaaaactacagcgtcacatcatcaaaagaatatggaacgactgattttcgctccagaggttgcagactgttggatcattggattggcaaaatatctcaatacttcaggaaacttcttttatgttataatcattccatgttcctagagccttcataaaagctcaaggctcgcgagctgcccgagctcgactcgttctaggctcgattcgagctcggctcgagctccaaacgagcccagcccgagcctctccctaagctcgcgagctttgtcgagccgagctcgagcttccaacgagcctagtaatatatgatttttgttgttatattatttatatatcttgtattgacatcatatgtttattttattcttttttcctcttctattaatatgaagaactagaaattaattattttttaaatattatccttaaaatatatattgttttacttaaaatttaagctctgtagtcgagctcgaactgagcctgtcggaaagctcgaatattttataggcttggctcaagcttgtattgagctcgagcctaggcagacaagcgaactcgagctcggctcgttgagagccctagttctattgtttctttttcattgcctacttctgtccggaggagtccattctgattgtggaagacatattgttttcaaattattgttattctttactccacctacattccagtttactaacagaagtgatcgcaaatggcaagtttaataccaatttcccccttttttccaaccagtcattaacaattgtgctaaacccttgaaatcatttggccgaccaatttatatcctttactaacattttgtttccgaatcaggagcttcattctcgttttaattgaggattaaaattataaactggacaatcactccattctcaaatataaaacttttaggagtattttttagattgcttattcttccatcaaccacggggtcatttaatgtttaacctaattaatcccaagctaaaatgttagatttcgtaacattagcttagagcaatgtcaatagtatagccaactactagctccaaaacatctatagccaatctaatagcccattcatacaatatttaactataaaaatatacttcactattaatacccggtcccacctctcatatacacataacattttggagtccgtgttgcagccggctataaatatgtagctcgctttcttctctctcttctcttttcttctcgatatatggttatagctggcttatagcctgctattgtacttgctcttatagttcgttttttaattctatataccgattaactcttacgattacttttcagagtgctgattcttccaccaaccgcgagtcatttaattttgagtgaagtgcaccagcggtccctaaacttgtgtgggtgtgtcatctaggtccctaaactctcaaaatgcatttttgggtccccgaacttgtcttgggtgtcatatagatccaaacgggctccgacccgctccatccgctgacgtggcatgccacggtagcgcctacgggtcagcggggacccacatgtcacctctgtgcatcatctccaccgccctggaagccgagagagagagagagagagagagggaaagagagacgccggcggtgctcgacgcatcacgcgtgcccgggacgtggcaacgctgagctccactcttttcttcctcagacgtgtcgccttctcttctacattcttcaggagccgaacaactcggacgagagagagccctatgcctctccgtcgcccacattctcgtcgtcggtcgcgaagaagacgacgctcgctgttgccgacgagtcgtctccatctccaaatctttcccgttccatacttcccacatcatgccgagcaaatctccttttgaccccatctcgttttatccactgcagcaacggaaacgcgaccttgcccacgagagctccagaactcgcaccgggcgccgccgccatgacgtcgtcgctgttccggccgacatggtccatctcaagccaagccatcgcgccaaagtcatcgcctcaccatcatggccaaaagccctcaagaaattttaagaatcgtgcacagacgagggagatcaccgtcatcttctccaattccggtcaccgagtgccatcgccaatccctctctcctcggtgagccacggactaattaatcgtgcatgcaactctttagaaacctcactgaccatccatgcaccttctctaagcattccaccacccaagcgagccgtcgccgtgaagccgacgttatccaccaccgccgggctgtcttttccattgctgctgttacccagacgccatgccgcaatcaagttccagtgagcacctagggacctgctagactcgcatgcatgcatctttttgcactaaatcgggctggggctctacatgcacaagcgtaccgaagaccaccgccattcgcgacaccactggcatcgattccggccacctccggcgatgagaccaccttcaacaggatcgcaaggaagttctcagcatttcttcttgtggttgtgtcggccaaagaatcgtcgttcgccgacggcatcgtcgtgaaggaacgccggccggcaaactctgcagcagcagctgctgctgctttctccctgtgcctatgacaggtgggccccgctccattagcacgtacaggatttgattagagtaagtttaaaacatgtaaagttctttctgtaaatattgttatcatgtcatatatttatttttataaatatgactgacatgtgggtccccactgacacgtaggcgctaccgtggcatgccacgtcaccggatggagcgggtcggtgcccgtttggatctatatgacacacaagacaagttaagggatctaaaaatgcattttaagagtttagggacctagatgacacactcgcacaagtttagcgaccgctggtgcacttcactctttaatttttaacctaatattaaccccaaacatcctcttactcctcaactacacatcatttaatgaggcaactgtagtcttttcttctcaatcttactatgctaaacaactccttgtttgtgaagttggagattctaaaaacagccggtgaagatctagtctagaaatggtagattttttaacttaagtttatagttcattttctaaattctatatatacaaattaatccttataacccgagtaaaattctaaactatttcgggagccgaagattcgaagagaagttgtagctatggaggctttccaaatagagcatagaaatacttatattctactccatccgtttcaaaatgtttgacaccgttgactttttagcacatgttggactgttcgtcttattaaaaaaatttgtgaaatatgtaaaactatatatatatatatgaaagtatatttaaaaatgaattaaatgatatgaaaagaataaataattacttcaattttttaaataagacgaatggtgaaacacgtactaaaaagttaacggtgtcaaacattttgaaacggagggagtataacggagaaaggaggaaatcagatggaacaaatttacaagcacgtcgtcctatacatacaagcaagcgtctatctaccgaaatgaacagccaggtgtccaaagctgacgcctcccaatctcgaattcgaggtatgcgcatggctccctccttcgatcgatccgttgtttgtgttccttgcacctatcatcatcagttcatccacaaatctttgcttagaattgcatgcgggctcatgtctggttgattcttggttggtcttggggggtttttgtacgtgcagcttccacgcacgcgcactacctgttcgacgaaacgcctctgcgacgtgctcggcttccagcccgcgccatggaggcgccgcctgtcaagagtgggtggcgggtcatggccccggcgcacgccggcggcagggaggaccggctcagcgacctccccgagggtgtcctccaccgcgtcatgtcgttcctggactcgcgccaggccgtgcggacgtgcgtgctgtcgcggcggtggcgcgacgtctggcgcaccgttccccgcgtccacgccgatttctgcgacttcactctgaactggaccagcgacgacgacgaggtggacgaagcggccgtagcggaggacgaggtggtgttcaacaggttcgtcaaccggctgctggagctccgtgatcccaatgcctcgattcgatcgttcttcctcagattctgcagatcggatggaggcgatgatggctcagcagaagggaacagatggatcagctacgctctgcagaagaatgtccggattctggaggtttccgtgctgtcctacgcattggagctcgatcactcggtgttttcatcgcgctacctgaggacaatggacttcagcaatgtcgtgatgaaccaaggtttcttcaagcaactcgagatggggtgtccagaattggaagagctcttcttggatgaatgtttcattgtggatgatgagatctcctcccagacactgaaggttttgaccctcgatgccactcatttctgctgtggcttcaagacttccatttcaagtccgagtattacttctctggccttgcactatcctatgagtggcaaacctgtactgaatgacatggaagcactagtgagcacgtcgatgctgctttgtcatgtgaaagacgacgattttgctgctaatgatctccgcgactatctctggagcctttataatgttgaaattttggatttcagttatcacgggaagaaggtatgcttactgatcttacatattttcccttgtcttatgtgccctaactgtggtatcaatgtgaaaaggtgtgttgatagggtggatgatattatcaaccataccattcagtccaatttagttcatctgttcatgtactctgtctatttctacataaacgaaccttagttagcaatttgatttcacaaatgaaattggatccatttcccgtttgatggcacaacatgttcttgtgtggctgcaatatttggtttggaaactgaaaatgcatcctgtccaaaatccaagtgattgtttaacttcagttgacattactgcacatttacaggaattctgcatatatatttgaaaattatgagatattcaaatctcgaagtcaagaaatgaatggaaaatgcttcatcaattttcaaaagtcttattcctgctgctacctcgtgatacttgcatggaaatatccagataattaattcacacaagctctataaacttccattggaactaaacaagtatgtcattgtttaatctggtttttggtagccataattttttttttcttgtagtattttactatgcattatcttgaagccatatttgtacctgtactgcaaccagagtacttatcacataatgcccatgttctcaattttgttgccatattttttgaatatttttgtctataatatggcatggcttttatacaccacataactccaatgttgtgcagctgacaatggaaaataatttgcaattgtgtccgaaattcatcaatcttgtcagtctgactctcggtccatggtgtctggatgccaacttctatggactaatcgtcttccttcagaactcaccaatattggagaagctaaccctagaactcgcaatggtaaatattttcctccaaatgtatactgaccctacttgaaagatttttgacaagcacacatatcatcaggaatatagcttacctgtttattcttgctatagtatcgtacaggaaaattacaaagaatcattggccagattgaagaaagatcatttacatgtgagcaccttacgagtgttgaagtcatatgcttggaggatgatcccctggtcaacgacgtggtcaacttctttgtgaatagtggaatgtcctctgttcagattcatatcaaacaatggagccagagcgagtatgagtaacatccacttttccagtctgaggacatatgaaacgtcaaaggatcatacattcggtggtcattccatccaaaaaatcactctctttcagctacattccttgattctagtagggtttgaaagcacatagacttcttggtcggtgctatgacgtgagaacaaacaatcatagtcctatacttgtatatatgttgcttctgtttaaatactccatttggcctatgttctgctgacgtggtgttacattcccattacatgctttcacttcttctggtttctattaatcatatgcttggaggatgtttaatcccctggtcaactgcgtgaaaggcttctttgttaacattggcatggcatctgttcagattaattgatatcaaacactggagccagttccagcgtgaggtactgcaattttcctggaaatgtttgaatgaaatgacaaaaagatcaattcagttgttgttccattgaagaagcctctctttctgggctggttatacatttgttggttccagctgagtttgaagaacatagacatgtttgagtacaaacaatcgcgtgtcttgcattgggttgcttcattgcttgtaacttgtaagttgtatggtcagcagttcttctgctgtttgatgatgtttgtttctgccagagcggggataccttgttactgcaaattaaaacataaatcacatgatgtaagtagattgtgttgatcttgtgatcaactttcaaggcagatagaaatgtttactgctcttgtttggtgctgtgaaaattttaacagtcgtgcctttagctgcatgtaagatagtcttgtactacatgtctgcggcaatcacagaatgtggacaacatacaaatggaaaatgtctcagcaattctggaagtctgacagcactcttaccttgtgaatcatgacttcaggctgcgctcaggagtggatgttgtaatcttgtctcttgcgcacgcaaaacgtagctgactcgctaacatataattaattaattattaactaacgtaaacttaaaaatagattaatatgttttttaaaacaactttcctacaaagatttttttttaaaaaaaatgcatcgtttagttcggaaaacgtgctcgtgaagaattaaggattagaagttagaaagttgtggtaccaacacacccttaatcgcgtaggcggctatataaattaatacgaagtgtttacatgtcagattcaaaatggtcccaataaatacacaaccatttcaatgggggatgggggcatataactactttacatcctccatttatattatacgtcactttgattcttttttaagttgaacttttttaagttagaacttttttaagtttaaataagcttataaaaaaacatagcaatattttcaatgcaaaacaaacataacatcaaaataaaatatattgaacgaaactaatttagttttgtaattattgctatatttttatatatatttggttaaatttaaagaagtttgatgaaaaaatcaaacaatttataataggcaaaatttgctacacgacatgcaaaaaacgtgtaattggctgagatacaccgtaaaaacgtgacacggctgatacacactctaaaaattgtataattggctataggacaccggaggcaatatttataatttccatatcgaaaaaggtgataatatttttcaaatggcgagattgcccctgccatggagcagggccaccgccaattcatcggatcggattgcctccgcgcctacatcgccttctcctcgctctccgtcctcctcctcctcggcggccacgtcgccctcctcctcctctcacggtgcctccgcctcccgctcgacgccgtctccttcgcgctgctcctccccaacaccgccgccgcgctggcgctcgtcgcgctcgtcgccatcgccgccttctggttcacgctgctcccagagtggatcaccgggcgctactcgtcgccatggcgttggtcctcgacgtcgccgttggtcctcgctgaacgaggagatcccagcgctgctcgtcgccatggcgttggtccttgctgaacgaggagatcctggtgttggtcctcgccgtcgcctgcagtggtaccccggcggagcgccgccgcttttcctccgcgcgccgagccgccccgtctcgggccatcgcgctggccgagcgccgttcctccgctccaccgcatgcgtgaggaagaagaaggataggagagagatgtgggcctcacttatgattagcaaatagtaatcaccctactaattaggaacaaattagtccatgacgcgtgggccaggtggttaaaaacctattaaaaattagattaagcatacactatccataacacgtgggacccaccggtgtttaaagaagaaaagagaaagggcaatccagacatttagaaaaataacctattttgacccgcaaaaaataaaataatgcgaccgatgtcctacggccaattacacgttttgtttgtagtatccatcagccatatcacgttttcacggtgtctctcagtcaattacactttttttttttttgtcccgtggcaaatttttcctttataatatgaacttataattcgaaacttagttactcacggatgaagcgggtcaagcttacattctgtggctattgggctctgatgggaagcccatcaaagtagctgaaactaaatgcgcgggaaataattagagttgtggagggaaaacgaggcatcaccgctttatttcggcgctggaaatacaaagagattgttcgtcttcctcctcttcacagcccaaacaccgagagacgagcaccaaaccaatcgaggtttgtttcttcctttcttccaatcatcgttgcttgccagagctgctgccttgtcgaatcttgcttacggttgatctgctgcgttcttggtttcttggtttttcccctctctgcagcgggcttccacgcgcgccacctgttcgacgaaaggcgtctgagcgggtgctcggcggccatggaagagccgcctggcaagaaaggtccggccatggaccccgcgcaagactcgggcagggactggctcagcggcctccccgagggggtcctccaccgcatcatgtcgttcctggactcgcgccaggccgtgcggacgtgcgtgctctcgcggcgctggcgcgacctctggcgctccataccccgcgtccacgccgacatctacgacttcaccccggacgggaccatcgacggcgagggagaggaggacgtagaggaggccgaggtggtggtggtgttcaacaggttcgtcaaccggctgctggagcgacgcgatcccaccgcctcaatagagacgttcttcttcagatgctgcataccagacgaagacgacgatggatccgcagacgcgaacaggtggatttcctacggtttgcagaagaacgcctggtttctggaggttgtcgtgcagctcaactcattggagctcgatcgctcggtgttcaattcaatctacctgagaagaattgccttcggcaatgttttcatggaccaaggtttcttcaagcaactccagattggctgtccagcattggaacgtctctacttagatgattgcatcgttgcggatgacgagatctcctccaacacactgaaggttttgaccttcgatactactgaattctgctatgagcacaggatttctatttctattccgaccgttactactttagccctgcgcaatactatttgcggcaagcctgtactaaaggacgtggcatcactagtgagcgcatcagtggtactttattgtgtggaaagcggcaatttcgatgcttatgatctccgccactatctctggagcttttctcacgttaaagatttgattttcagttatcaggggagaaaggtatgcttaccgatcttacatattccaccttgtcttatgcatcttgacttaggtgtcaatgcgaaaaggtgaagtgtctcttcttgatacttcacaattacatgacatatcaataggataactgatgttatatcaaccaatcatctaatatagttcatgtactctgtttcatttctatataaatcaacatgttgatcacttgacctgaagcatcttagttggcagttcgatttcacaatggaactggagtatttcctgtttgataactgacatgtgctttgtgtggctgcaatatttgggttggcaactgaaaatgcatcatccaaaatctgagtaattgtttaacttcagttcacattactccatatatatttctttcctgagaggagtactacacatatatttcaaaattatgagacattcaaagtcaacaaatgaatggaaagatgcttcagcaatttttcagtgtcttactcctgctgctacctcgtgatacatttgtattgtgtcgactggcttagctagttagctacccaacttgcatggaaaaaagcctgataaataattcacacatgctctatagactttacgtgggaccaatcaagtatggcattgtttaatctggtttttggcagtcatcatatctttcttctttccttgtggtcttttactatccattatcttgaagctatattttacctgtactgcaaccaaaatacttgtcacataatgttcatgctctcaagtttttctttggcaagttttgtgaaattttatctacaatgtcaatatggcatcgcttttatgtagctacataatcactccactcttgtgcagctgacaattgaaaacaatttgcaatggtgtccaaaattcttcaatcttgtcggcttgactctgggtaaatggtgtctgaatgcaaacttctatgcactaattgtcttccttcaaaactcaccaagattggagaaactgactctgatactcgctgaggtaaaacaatttgaaatgcatcctgcatacgtgaaagcttttgcacgagtgcacatgccaatagaggatatagcttacctgttttcctttctgtaggataattgtaaaacatcagaagtattcatcggtgagcttgaggaaaaatcatttacatgtgagcaccttacgagtgttgaaatgaaatgctgggaggatgatcccctggtgatcaacgtggttgacttctttgttggtagtggaatgtcttcttctcagattcatatcgaatacgaagacgacgatgaggatcaatttcatatcgaatctgatgacatgtttgggtttgagttcgagtatgaggacgaggacgaggatgaggatgaggatgaggatgagtaaagctcactcagtctaaggacatgaaacatcaaagcggcacattccatccaaaagatcgctctcttccgtcttcctctgattccagttgacttcgaaagcagagacatgtttactgatcttctttggagctatgatgtgaagaatcatgtctttcgttgcatataagctcagtcgtcttttgcttgtttgcttctgtgatattccaagaaccaagactatgtgctacatgtctgagtacttcattaggcctttatatatgacgtgatattaaaattccatatcgtacttccactttctattactcgtttttatctatcactgcctactgtcaggatgtgaccattctgacaatggaagagatacatcatttgtttctgaatgattattccttgatctactccctccgtcctctaatataagggattttgacattttgcttgcactgtttgaccacttgtcttatttaaaaaatttgtgcaaatataaaaaacaaaaagttgtgcttaaaatactttggataataaagtaagtcgcaaataaaataaataataattctaaaattttttaaataagacgaatggtcaaacagtgcaatcaaaatgttaaaatcccttatattagaggacagagagagtataaaggaagccaagtattcccctatgtccctaatcccattctagaattataaatctggacatgagatatgattagacatatcctagattgctactcctgtttcaaaatatttgacaccgttgactttttagcacatgtttgatcattcgtcttattcaaaaaaatttgtgaaatatgtaaaactatatgtgtacatgaaagtatatttaacaataaatcaaattatatgaaaataataaataattacttaaattttttgaataagacgaatggtcaaacacgtactaaaaagtcaacggtgtcaaacattttgaaacgaagggagtacattttaagatctgggtattaattaacacatgcaattcatgttagcatctctcttcgcctcataagttttttttatgcaaaatacaaccaagactttgcccagtagttatatattataaagaaagaagagttatttacaaaaaaataaaaaaacaaagctaaaacagaagaattacagattttgtaaccagctaagttgttgttatatattatatatgtgtgttaaactttatcactcatcacgccaatataaacttgtgaataggctaaaaatggaggtgaaaatagaacagaaatggacgacaaagctatagtggataatagtattgagcctcgtgggttgtcgatggatggcacgacttgtgttcaagtaaataagtaatcaactagagatgaggaaataaaacaatatctttctaagataatggatagaaatctggtctctatatccacaattggatacacataacccaaggttaaggttatatgaatacttagatttcatgtacaaaacacattaataaaaaaacaaaaccccaggtattaacgtccaacttgtagtatttttatc

SEQ ID NO: 49208 - DNA, 22702 bp, Oryza sativa
acataaccacatgtaatttcataataccacaccattaactttttgtctttgatatatcatgcatatgagttctaaacttatatctgaaatatatgagtttttttaattcactgtataaatgttgtagtaatctaagggcctgttcactttgatgttattttcaaccttaccaaattttggtaaagttgccaaaaaagtggctacatttagtttgctgtcaaattttgttaactatataagaaatcctgccaaaattttggcaagttgccaaaatttggtaaggtttttttttcatcaaagtgaacaggccctaagtgaattattttttattttgctacagtactaaaatagattggttaacattgtagtggaataatctcaccatgtgctagagaagttctacaacaaaacaactccagatctcttccttgtagaacagattttcttgccgtttataaactactcccctgaatgaatcttgacggcaaattgtgttggaaatggtgaggaaatccaacacaaattgtgttgccgaatttctagcaaaaaccgttgaaaaaaaattcatcttttggcaaagtgttttcataagatcatacttcctctatttcatattataagtagttttgttttttttctaatcaaatttattttagtttaataaaatttatagaaaaatttaacatctaaaacacaaaattagtttcattaaatctagcatcaaatatattttgataatatgttgaaaatgttattatatttttctataaacttagtcaaccttaaataagtatttaagtttgattaggaaaaaaattaaaatgacttataatatgaaattgagaaaattcatattctaaatacacttttgttattttcgaactataaactcttaggtgctgatgcttagttacaacttacaacaacccactaattcttaatttcgagttcaataagtaactaaatatgccagtcagaaattcattttacaaatttaatggtatggaaaacattttaaaaccattaatttcggtcacgttttgttccatctcatcatgtatgatgtattataccgaattttttagatgtaagcacatgcaatccagtaattacaaaaataagcacgcaacaaccacatttagatgtataggcaagatgctcacatgaagcacggtgcttccattgaaccacttgaccaacagactaatgggccgctgaattaagaacgttagcgcaagaacccacatcaccaattggttaaatgcatcattacgggagcatgcatggtttaattgtgttgtttttattttacaactcattgtagcatatgtatttcttacattattttttttaaaaagaaaacatatacattattttttaaaaaaagaaaacatatatatgttttcttttttaaaaaaataatgtaagaaatacatatgctacaatgtgagctatgataccaaaactattgctattagagcaagttcaatagtatagcccactactagctccaattcatgtatagccaatctaatagccaattcatataatactacctccatattttaatgtatgacgctgttgactttttgtttaacgtttgaccattcgccttattcaaaaaatttatgtaattatcatttcttttattatggcttgattcatcgtcaaatgttctttaagcataacataaatattttcatatttgcacaaaaattttgaataaaacgaatggtcaaacgttggttaaaaaatcaacggtgtcatatattaaaatacggagggagtaattgcttattatactattaatatatggtcacacctgtaatacacacattgtgtcttgaagtccatgctacagctgactataaatctgtagctcactgcttttctctctcatcgtttatctcattaaaatatgtttatagctagctaatagcctgctattgtacctgctcttagctgaagaaaaagaagaggattaatactattgggctgctcgcacgttaatgctagaaacaagaccggctgcaaaaccccccatatacttcgttaggtcctcttggtcaacccgatattgacagtggtcaagtacttgtgcgaaggttggttagaattagaattccaaacaatgcgtgctcacatatgtaattattgggctgcgtgtgtttagatataaaaaaaatcggtattatatcgaacaaagataaaaactacattgtgatttcgttaccttattgatcgttgcctccacgcatgatgtcataattgttgtcaaacatgatattagtataagcaaaattacttttcttggattttgtcgaacgataatagtgggtgatataatattgtcttggccaaaaaaaaaactatgtagttctacatcttgggccgcgcaacatggcccagcccattccgtggggcagactgcgaaggacgccgcctcccattccgtggtgctctggaaagtcgaggcgcgacgccggcgacgtgagcgccattggaggtcggcggcgagttcttcaccggcagattctgctcgcgactccttccttgcactgcgatctcaattcttgcttacttgcgctgttgattcatatggcttcttttggtcttctgctcttgtgcagtttccacgcgcaccacctgttcgacgaaacgccactgcgtgatcggccgccatggagggtcgtcctgggaggcgcaggcgcaggagggtcaaggccccgacgcgcgctgccggcatggactggatcagcggcctccccgacgaaatcctccaccacatcatgtccttcctgaacgcgcgccaggccgtgcagacgtgcgtgctgtcccggcggtggagcgatctctggcgcaccgtgccctgcatcaacgccgacttcaatgagtttgatttcattgattaccaaggggacgatgaggactacaacgacgaggtggcgttcaagaggttcgttaaccggatgttggagctccgcgatcctgccaccatgatggacaaattctggctcaagtacaaaatatcagacgggtacaatgaatacaaggattccaatgtagatgccaacaggtggattagccatgctttgcaaaagcaggccagggttatggaggttgtcgtgttctcctttccattggagctcgatcactcggtgttcacttcatgctacctgagaaaaattgggttctcctgtgtttctttacaccaaggtttcttcaagcaacttgacgccggctgtccagaattggaagaactcttcttacatgattgcactattgcggatgaggagatcttctcccagtcactgaaggttttgacaatcgacgacactgaattctccaaggcgaacaaggcatatatttctattccaagtgttacttctctcaccttgtctagtcctgagaattccacacctatgctaaaggacatggcattactaacgaccacatcagtatcagttaaattttatacattcagttatggttttgatgctaatgatctccgccagtgtctctggagcctttctggtgttacaaacttggagttgaattatgagggtacagaggtatggttatttgtattacttagtgtatccatccaccttgatttaggtatcaatatgaaaaaattgaaacttaagcttttcttctcgtcatttcataattgcaatggtttagtagcctgaacctgtaaaactaacatcgcatagctaattcatatgttgtgaaaccatgatgtattgataatatgatggatgttatcaacacttgatgcaatctagttcatgtactccggtcatttgtgcattattcaactagccctgaagtttcttagttcgaagtttgatctaaaaatgaaacatgatcatttctcatgtaggactttacatgttctagtctagatgcaatatcagggttgccaactgaatgcattttgtccaatatctgacagactattttactttagttgtactttttgaaagagagggttattggtgattgtatgtcctacacctgccccaaggccagattttttatggctgcaaatacatgtgcatgctatttgtaagatagtgaaagaaaaatattgatttgtataggctgtcattttcgattgtccaatctttcatgtaatctttatatttcaggattaattgtatattgcattttacattttagacagtatacttggttgggatgtgtaatgtgttgggtgttacaacacacagacattatgctagcataattttaatgttaggagtcattaaaagacaacatacaaacagaaaattcttctggggaattgttgaatgtcctactgcttcctgatgatatatttgtgttgttttttttactggttttggacttccatggaaaccatcctgacagtgagttgcatgtgctcgagagactcttggtgaaaacaaacaagtagaacattgtttattttggtcttttgttgacatcagttcattttctactgtgatcttttgccatccattatcttgaagctctcaatttagttgataagttttgtgattgaggaagtggtgtttttgcagctgacgttcgaaaacaatttgcaatggtgcccagaattcatcaatgttgtcaacctgactcttggtcagtggtgcctggatgcaaacttctatgcactaattgtcttccttcagaactcagcgagactagagaagttaactctgaatcttgcgaaggtaattgctttcctcaaatgtaatacagatcctactcgattgtttctatttgctcaagaggttgtgcattgggaaataacttactgtttttcgtgctacggtgcatttggaaaaaatctccaaggatcgttagcgagcttatggaaagatcatttacatgcgagcaccttaagattgttgaagtcaaatgcttggaggatgatccccaggtcatcagtgtgcaagatttctttgctagtaatggcatggcctctgttcagtttcatatcaaacactggggccaatacgaggaagaggatgagttacctgcatttgttcggtatgaggagagatgaaatgccaaaggatcttttgcatttgtttgtcatcccattgaagaatcaactcgctttctgctacattcactggctacagtagagttccgaggtcttattttgcatttttgctggtctgtagtaatggcatccaataactttgctagttttcattccactcctaatctctgattacattagcagttgttcaaccaaggacctatttatcccttgtacaacagaatttctttccattcatcaactattttttgttcagtctcttcaatttcgttttcattttacaaaaacattcttatgtccattaatttttttcccatcacgacgtgagcaagtacagatcacagcaccccaccacacaaactgctcacttaattggctttgccaagaataatgtgcaacaatcacgatcaacgaattaatcttgatggcgacgaaatccaacaatttgtgttgaggttgccacatttttagtaaaactattgaaaaaaaaatcatgagatgaaacggagggagtatttcatagcatcataagatgaaaaaaaaaacagggcagaaatttataagcgaacattagtatgatcctaaattagcgatgcatccatctatgtcgggaattcctacaccaccgccgccttcggccggcgacgacgtcacgcagctccgtgcaggtgcactccaccttcgcgaggtcctcgccggcgagcctgctcaggatctccgccgcctgcagccaggtcggccgggagcggcatgaaccgcggcggcaacacagcgtgctgttcttccagctcatgtccgccaagaggcgccggccgggccagcccgccggcgagctgcgtccagaggatgacgccgccctggtcgttggccagagcgtgcgccgtcgagtcgaggtcgccggagaggacctcgtcgttggccggttgccgacttgccgtcgccggtgaggtatccgtagaacatgcacggcaaggtttcttccgtgcccgcatagcctcagcacggcggtccctctgccggccgccaccgcgccggcgtcgatgggaatggcatcgtgcaggtgcagtggatgcattcttgtttgcgttgtcgtatagttgatgagttcgtcaatttagtttttttttaatataaaaggaaactattttcgcctctgtgattgactttgatgaagtggtcggtgagagcgaggtggaatgcccttatcatttacaaactcttttggaaattcatccacgtttaccaaatcctttcagttgatgctaccactttgagatttttatataggtatttgctagatttttcgaatgcctagaaatttgtaaattttcagtcatcttaaatattaaaaactagcatggtggcccgagcagattgcgcggctagcatcattatattttctcatataaaagcatatatattttctcattatattattcaaatatattaaaatgacaacataattttttgcaataactttacaaaactactaatgtgtaatattcatattgtattttatatacgtgttagttattaattatttttaatatcaaattttagttatttgtaaattatatatattcatatatggactctagactcgtcttttaatattttttttaattccgaattttctataaattgtatttctatatagactctatactcttcttccaatattatttatttttatttctgaatttttattatttctaattgtatttatatgtggactctaaactcatctttcaatattctttaattttttattttgaatttcagtaatttctaaattatattcctatatttactttaaactcttcttcccatgtttttcttaatttcgaattttatttatttgtaaattatatttttatacggactctaaactctacttttaattttattatgtttattccaaatattagttagttttaaattcctatatggactctatactctacttctaatattccttattttttaattccgaatttctattttttcttaattgtatttctatatggactctatactctacttctaatattccttatttttaattccaaatttctattatttcctaattgtatttccatatggactctatactctacttctaatattccttatttttaattccgaatttcagttatttcccaattgtatttctccatggactctatacacttggactctagtctcctcttctaatattccttattttttaattccgaatttcagctattttctaaattgtatttctatatggactctactttttctttttatccgattaatgtgagaatttctaggccatgagagcgaacgtggaggctcctttttctattcctttaataatataatagattgttagttcattttatcttcaacttctttgttatataccgttttagtttatttactttatcaaagttttttttttcatgtaattttataaattttatgaatttaatatttagattaattttttagtttctatttaaaagagaagggactttgtttataataagtaataggcgagtgacgatagcaaccatttgattgtcatccaaagaataacaagaggtagggtcggaaacgccatgcggcaatacagacaaactcttgttcactacggccacaacattaacaatagggagtggcgccaaagctaaattctgggagtctgcctggctccagggggtgaggcttaaagacctagcaccgttggtcttctcgacctctagaaaaaaatagaacattgcagcaggctattcaatcagatcaatggctactcaaccttaacctgccggctgaaatagcctggacaacgaaactaatagactagctcgttaatgtcttgagtgtcatccaaagtataaacctcatagataacgaggagctaggacaaaatcatgtagagtacacagcttcattggcctacaggctacaaggctcaactcctaaggcacaacaacttcaaactttaatgtgctgatctagaagccctaggcgcctaggaagtgtaagacctttgcctagctgatgatcaaaaacagagtctagacttcatataggctagcaagccaagggtagccgtctggctcaagagacagccctgcatctcctcgtgggttgcggatatacaagaagaatctggagggaattggctgtttgaatgtcatataacatgttgagccctacctaatgggaactggccacgatagtacatgaatggtgagaggcaaccggaaacataagaggagtgccaaagcaagcaattcacaccttaatgctactggtctcctgggagaattggaaagaatggaatcaaaggaccttccaacacagagagctctcgacgcctagcctactatccaagatcacagagaaagcaaaaaacttgggcccttgccggcacaagaaaactcgtggattggctaccttaggaatccctacggcatataactactttatctatatacttcgttcaatttatattataagttttttttttctaagttaaactttttcaagtttgactaaccttaaataaaacatagcaatattttcaacgtaaaacaaacataacatcaaaatatattgaacgaaaataattgtgttataaatgttgctatatattttatataaatttgattaaatttaaagaagtttaatgggaaaaaagtcaaaatgatttataatatgaacttatatactccctctttccacgtaagttacatttattacttttgtcaccaagaataaagagaaattaactcatcttacatgtaacaaaaatgaagtgtatgcacatatacaaccgataagtattaagttggctcgtcgggttctgatcaaacattcaagttacctctctatttaagttttagatgtatataaactacgaataggaacaattcatttgaaaaaactaaaatatgaaaaagttctagctcttaaggatggtgggagtaatatgaaacttagttactttcggacgaagtggatcaagctgcgttctactccctccgttccacaatataaggaattttaggtttttgcttgtaacgtttgaccactcgtcttattcaatttttttttgcaaatgtaaaaaacaaaaagttgtgcttaaagtacagtagataataaagtaagtgcaaaaaaaatctaaataagatgagtggttaaacgttgtaagaaaaactcaaaatcctttatattatgtattatgggacggagggagtatgtctattgtgctctgatgggaaataattagttggggggggggggggtgggaaacgaggaggcatccccgctttttatttcagcgccgcaaatacacagagattgttcgtcttcttcctcttcacagcccaaaccaatcgaggtttgcttcttcctttcttccaatcatcgtttcttgcatctgatctctattctctcctcgatcgccagagctgcggcgttgtcgaatcttgctgacggttgatctgctgcttgcttggtttcttggttttcccctctttgcagcttccacgcgcgccacctgttcgacgaaaggcgtctgagcgggtgctcagcgcgtcggtggccatggaagagccgcctggcaagaaaggtccggccatggaccccgcgcaagactcgggcagggactggctcagcggcctccccgagggggtcctccaccgcatcatgtcgttcctggactctcgccaggccgtgcggacgtgcgtgctctcgcggcgctggcgcgacctctggcgctccgtgccccgcgtccacgccgacatctgcgatctcatcccggacaggatcatcgacgtcgagggagagaaggccaagatggtggtgttcaacagcttcgtcaaccggctgctggagcgacgcgatcccaccgcctcaatagagacgttcttctgcagatgctgcataccagacgaagacggccatggatcggcagacgcgaacaggtggatttcctacggtttgcagaagaacgcctggtttctggaggttgtcatgctgctcaaaccattggagctcgatccctcggtgttcagttcaatctacctgagaagaattgccttcgacaatgttttcatggaccaaggtttcttcaagcaactccagatgggctgtccagcattggaacgtttcgacttagatggttgcatcgttgcggatgacgagatctcctccaacacactgaaggttttgaccttcgatactactaaattctgctatgagtacaggatatctatttctactccgacagttactactttgggcctgcgcaatactattggcggcaagcctgtactgaaggacgtggcatcactagtgagcgcatcagtggtactttattgtgtggaaaccagcgatttcgatgctaatgatctccgccactatctctggagcttttctcacgttaaagatttgattttcagttatcaggggaaaaaggtatgcttactgatcttacatattccaccttgtcttatgcatcttgacttaggtgtcaatgcgaaaaggtgaagtgtctcttcttgatacttcacaattacatgacattgtttacctgtcccctgcaaaactaactgttgctaactaaatcttatgtcgtgaaatcatgacatatcaataggataactgatgttatatcaaccactcatctaatatagttcatgtactctgtttcgtttctatataaaacaacatgttgatcacttgacctaaagcatcttagttggcagttcgatttcagaatggaactggagtatttgctgtttgatgattgacatgtgttttgtgtggctgcaatatttgggttggaaactgaaaatgcatcatgtccaaaatctgagtaatggtttaacttcaattgacattactgcatatatatttctttcctgagaggaatactacacatatatttcaaaattatgagacattcaaagtcaacaaatgaatggaaaaaatgcttcagcaatttttcagtgtcttactcctgctgctacctcctgatacatttgcctattgtgtgtcgactggcttagctagttagctactccctccgtcccattataagcgcagttgtgggtttcagtgcccaattttgaccatttgtcttatttgaaatatttttatgattagtatttttattgttattagatgataaaatatgaatagtactttatgcatgacttaatttttaaaattttttcataattttatcaaataagacgaatggtcaaatttgggtacggaaacttatggctgcacttataatgggacagaaggagtacccaacttgcatggaaaaaagcctgataaataattcacacatgctctatagactttacttgggaccaaacaagtatggcaatgtttaatttggtttttggcagtcataatatctttcttctttccttgtggtcttttactatccattatgttgaagctatattgtacctgtagtgcaaccagaatacttgtcacataatgttcatgctctcaagtttttctttggcaagttttgtgaaattttatctataatatgtcattgcatttatgtagccacataatcactccagtcttgtgcagttgacaattgaaaacaatttgcaatggtgtccaaagttcttcaatcttgtcggcttgactctgggcaaatggtgtctgaatgcaaacttctatgcactaattgtcttccttcagaactcaccaagattggagaaactgaccctgatactcgcagaggtaaaacaatttgaaatgtatcatgcatatgtgaaagcttttgcacgagtgcacatgccattagaggatatagcttacctgttttcctttctgtaggataattggaaaacaacagaagtattcatcggtgatcttgaagaaagatcgtttacatgtgagcaccttacgagtgttgaagtcaaatgctgggaggatgatcccctggtgaacgtggttgacttctttgttggtagtggaatgtcttctgctcagattcatatcgaatacgaagacaatgatgaggatcaatttcatattgaatccgataacatggttgggtttgagcttgaggacgaggacgaggacgaggacgaggacgaggacgaggacgaggacgaggatgatgaggacgaggacggggatgaggatgagcaacgttcactttttcaatctaaggacgtatgaaacgtcaaaggggcacattccgtccaaaagatcgctctcttccgtcttcctcctttgattccagttgacttcgaaagcacagagacatgtttactgatcttctttggagctaggacgtgaagaatcatgtctttcgttgcatataagttcagtcgtcttttgcttgcttgcttctgtgatattccaagaaccaagactatgtgctacatgtttgaatactttattaggcctttatatatgttttgcaaagacgtgatattaaaatcccatatcgtgctttcacttcttggttccattaatcgtttttttttctatcactgcctactgtcaggatgtgaccattttgactggaagagatgcatcatttgtttttgaattgatcatttcttgcttgatctagaaaggaaggcaattaagtaacaccggcaattcatgttagcatctcctttcgcctcataagttgttatatattatatgtgttgaacttgtccactcatcacaccaatataaacttgtgaataggccgaaagtgctatagtggataatagtattgagcctcgtgggttgtcgatggatggcatgagttgtattcaagtaaataagtaaatcaactaaagatgagaaaataaaacgatatctttttaaaataatggatagaaatctagcctcaacatctacaattggatgtacataaccaaatgttaaggttatacaaatattcttgtacaaaacaaattaataaaaaaacaaaaccctaggtattaacgtccaacttgtatttctatcaggatggggtgagatcattctgattgtggaaagtatacacggttaatattattttgagtaaattcataaaacctcaggtattataatctgaactgtacaaaatcatagggggttttgtgcgttgcaaataaccacaggtaattttattagctgttttttttctttgatatatcacgcatatgagtgtcagggttatggataccacatacctaataatagttgactaaatctcggcaggatccaccatataccatgtcttatacggaaacaatattcggatatggatggagttccgcataagaaagataactagagttctacatggaaacgacaaggactactcggattgtatccatattggtttctctagttctacttagacaaagggacacctatgggtataaatacaagtccccctaggaggagaggggacatggaacaatatatcaagacacaagatcaacatacaaaccaacatacgccaagacaagactccggatatcgacttcagacataggcatggctagtcccctacggtgcctatggctaccgtcagaaaagatatagcgttgtctctgatctcgccggatgcggattcgacgaggaagactaccctgctgtcgactacgagtcagtacaacagaccgccaagtcgacaacagttagataggctaccccaaatattatactggtgtgattatggtgaataagagcaataccagcttcggccaataggatgtagggttattaaatgttgtagtaatgtaagtgaattattttttattttgctactaagatagattggttaacattgtggtttcgtgaaatcttaggactaaaatactcatggttatgtgacatatgctaaaactcgtgtgattttgtgcgatttgaactacaatacccaaggttttatgaaatttactctattatttttatttcaaaacacacacctccaaatatagacaaaattaccatatttttctcgctgtcaatgggtatgtcatctaccattgaaaaatatcaatgtgtacaacgcttatcattgaaagaaaaaaaattaacagtaaatgtgagcacacgcgtgaagtttataatttgaacccgagtgtgcatattccaccacaaagggacagctgagctacacacacatcgtagataaacattaatttgtttctaaatggggaagctaatattttcagtagtttttattaatgtgatctcccttcgagtaagtaagtatatactccgtactttacatccgttacataaatccatatcaaatgtattatactctcaaataagtctcccatatattcccaccgttccatattataagccgcttcgactttttcaagtcaaacttctattaagaatagtatcaaattaattttattaaatctagcattaaacatattttgatagtttgtttgttttgtgttgaaaatattattatattttttttagaaaacttggtcagatataaagaagtttgatttttaaaaaatatcaaaacgacttatagattataatatgaaacctcgttagtagataaaagtgcagccatttcactgattttttttttcctacagcataactaaactcattttgtagcagcacacatactgtacaaaatcaatctgaaccgtccgatcgtgcatcgacggcctaaaaccaccttgaagccatttatatccttaacccatcaacttctcttcttttgccttgaagttgaagcagagcagacatcctcctcccattcattcttcccgtgggtgcgtttccggttccgaggcgaccaccaaaccaatcgaggttttgcttctccctttcttccaatccattcttggttctcctcccccttgatcgctggagctttcacccatcgatttctgctcgaatcttgcgctacgttgcccaatcttttttttgctcatagttgagctgctgcggattcatggcttgttcgtttcttgcatcctttcttgttcgatcgctggattttactttgaaataaacattttttgatccaatcttgcactaggacatcaaatcttgcttacggttgagctctggatccacggcttgttgattcttggtgtccctcatttctgcagtttcgacgcacgccacctgttcgacgaaaggcctctgcgtgctcggccgccatggaaggatcgcctggcaagcgcgtgcagcccacgtccccggggagcgccccctgtactgacaggctcagcgacctccctgaaggagtcctccaccacatcatgtccttcctcacctcgcgccaggcagtgtagacgtgcgtgctgtccaagcggtggtgctacctctggcgctccgtgccctgcatcaacgccgattacaagcagttcgaggtgacgcattctgaagcgggagacggtgaggcgccggcgctgttcaagagatttgtcaaccggctgctggaactccgcgacccagtcgcctctctggacaagttctgtctccggtattccatatcttatgacaacgacgatgacactgacccgcaagatgcagtcgcgaataggtggatcagccatgcttttcagaagaaggcccgggttgtagaggtttatgttgacctcgtctacgctgacctctttccgttggcgattaatcactctgtgtttacttcaagctgaaattaatctgaaccgttgatcgtatttaatcatatggttgagatcgagttctactcccaccagattttatgggagtagaaatatggagggatatatttgtccagaggtaataattcgcgtaggggtattatcgtaatttgtctttatctaactcttcaccctctctatcctatcctaatcgacgccattcttctccctctccgcctctgtcgcctcccccaggcctcgccgtcttctccgccccctccatcgccgtccgtatcccccaccgtcgctgccttgtccgcctcctccgtcgccgtccgtctcctccgcccgcgtcgccttctccggccccctccgtcgctgtccgcctccccgccctcgccgcctccgtcgccgtctgtctcccccacccttgccgcctttcccgccccctcagtcgccgtccgtcggccccgccctctccacctccggcgccgtatgcgtctcctcccccttcggcgcccttgcctcccccgccatcttcataccctgccctcgccgcctccttcgatgccattctcggcctctcgttcacctccatcgtcgcctccatcgcccgtccatctccctctccgcgtcatcgcctccagcgccctcgcggccctttgccccatccgcctcctctacctccagcgacctgtggcggctgcggcgtacgtgctcggcgcctcggcaaggacggcggatccccacgatgtgctgcttgtatggcagtccggcggaggagaggctgatgatgcaacgtcgccctcatcttgatgttgccgttgattgttcatcccatctcttcggctgctactggttcgagaacaggtaacgtcctgtcccattttctcccatcacttcctgataaatgataatgctgtaggatcactattagatcctccaaaactagcagcctgacgcgagcaaaattcagtttttacaccaagtacttcataagatttctactgaggttgttgtcccaactatacaaatttgcaatgtgtctgacaaatgttatcaaatcaccacatagataattcttctgtgaccattagcgagagatgatttgcgcttgtgtttcattctattttagttgatgagcagccgacagcggtttaaatggttttgattttgcttcagtaaaattctagtactaattctggagttctctttacttcgtaaattacacacagatcgatttttatttgattcgttgcttgcagaaatagttccactccctgtgctacatcacataagttaaatttcagaagatactactagtttatagtggttacggccaacatagaacagttaggtccataattttgtaaggctctgcagatcattttattttggaggctttccaatatgtataattttcttttcattttttcagccatgcagtggagctccaatggtgagtttgcctttcattgtcttgtcggagattgcacgttggaattactggcaaaagtcatgcttcttgcattcaagagttgtatcctgttctgcgagtatgatctagcagcatggtatggggctgatattttataaaggacaacgaccaatgtctgaattgaaatatatatattttgtaatcgccataatttaatgtctatcacagaagcagtaatatactcccttgcgatatatcccacgtggttttctttggtagatagtgttcgtgttttaagacaaatgaatagacaaagatgatatatatttgcacttgggagttgccgtggatggttactgcaagatgctttaattttgtccatgtcgcgaggggtcaatccccagtaccacaccacttctttttttcaatcatctaacataactgcaactatcttttttatcttcaccaaacagaaattaatctgcaatcaccacggttaatatatcctgaaacttggcttgatagagctttattttttgctaattacaccccctgacctccacatttacatgcatatcacttaagaagtatataatcatctgaacaaagtctctcatacaacaaaataaaaagctgaagaaacgtcagtggtccatccccaaccttcaattgtgttgatgcttcttacacacgctccctctcatagctccggcttgaggattacttcgcaagttgcaaacatgttcaggaaagtgaacaattctatgatacaagtgaatctgacagtcgcggctgctttaaaatctcatctcataatgaaaatactctagcagttaaagaatatatatcatgatgatttatgagaatgcttgtggacatgcatggacaaattagtaaatcgacccggtccgaatggtccaggacttaatattttatttgtccaaaataaaccgttctgctatattctatgcaccatcgacttgaaaaccatattttttttaaaattgaccggtccggactgaagaagtaatcccctagagaacacacctgttactttccctgcatacacaatcatcctggaggtagtgcctaaaaatattgtgcaatttgtaaacatctccacaagacaggacaggaccctactttctgactgatgttccaacgcaagccgtagttctcataaacaaagttactgaagttatttggattagagatgtaacaactgcacagataatatatgtacatgaacatgatagactaagtgctgaacatgaacaaaaacagttaattaactgatgctaaaacaacagcctagtttgaactaatcctcttcgaaatacttctccccagcatcgtagttggcttcttttgaccaatggtcgtccagcatctcgtcattatcgatccgagagtagtccatatgcccaaagtcttcaccggacaggaacttctgttgcatcaagctggtaaattgttcaagctgatcatccatctcttcagcagataatgtttgcttcgaagtccctgcaggggatcctccagttttgttggagtcaaccatctaaaattacagagttacagcaagggctcggggaagaattaatggctaagttgaatacagggctatctgaaattgatcatatattacatatacgaagaaacaaacaatctgattttcagaatgcctagcaaatgatgatgctaggccagtttgctatttgccaaaatctgaactgtccgcagcaagtggtttagccaaaaactggtaaaataaagactagtaataatatatcctgttaagggctctgcagacttctaatatagtaagacacagtatttagatcacacttctgccatttacagatgaactccagagaacaaccgcatagattcaaaaaaaaaaaatcagtacaaccacccaaaataagattatgttcgtttcatcaactgcataaattaattgccactctaaactattgaacaattactacagtttccccacaatggctgcaaattttgtatgtacgaaggattaagtcatgccctaagcaattaattcaatgtagtagtagtagtgatgaactagctggaaatgttggatgctttaaccagttgccaaggcaagcatttgctagaaaatatcaaagatcaattgcacaagaaatgatttaatttgctacctttgctgaggtttaatgatggacttatatcagtaacacatcaatttctggaaactgttttgagtggaatttcaagtgacaggtgtatttaatttgcagctcaagaccaatattattgttcagttttctttcaaaaaaaaatcattgttcagtttcatctttcatgcttacaattcaacatacaaaatcgatttattagatctccagtttaacatccgcaactgtagattctctagtatagctataagctagtatacacagccatttgtatatgcatttatagaggcaaatttcagacaagttcaccactgaggcaacgagcaaataggcagactagcataggccactcgcagcggacagagtgggcgcaggagaccaggatgccggcatggaatagaggagaggaaggggaacagatacaggtgtggggtgggaggagtggccacctgaggattttgccgcaccgagccgctggcagcgccgccggagattttcgcctgatgcgacgcgctgcaccgccgggcaccggatgcgatgcgcctggccgccgggcacctccgtggcacctgatgagacgcgccggagggagcggagacggcggcaagggcggggagggcgggggaggtggacggcgacggaggggagcggaaaaggcgacgcgggcggaggagacggacggcgactgaggaggtggacaaggtggcgacgacgagcgatacggacggcgacggaggcaaggcggcgagtccgggggaggaatagcgcgacggagtccacacctgcgatgcgaaccgaagataccaaccgatgcgaacccaagaaaacatcccattccaaaattacccctaaggcctcgtttggctgcttgtgttttggtgtggaacaggccccaaacccacccttccgtggaatgcagcccacgcctggatcaattcccacatctggcccaaatgtgaatttggatgttcgtgtattgctgtgtattgcggctcgatccatgccgacccacgggtgagagaataatcctcacccgaggcctggaactctgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacaaaagcagcagcagcggaaaaaggcgatcctagcggggcttcagctccactccacaggcaaaactcaactggggtctgagccttggtcttccaacttcatcttcagctcagaagcactacacttctgaaaagggggaataatagcaagactgagtacaaccaccgtactcagcaagccacaccaacgatgcagatgtgcaaggggatacaaggatggtttgtggctatttgcataaaggcggttgtaaaacattttattgagcaaaacagtaaaacggttgagtaattaaagtaatattgaatctccactgatcaacgctacaccacgttgaacaggcccaaccaacccacctgaactacagtgtattgagtcgatttattaagatgggactaatcacggtgaatctggtcgatcgcccataaccgcgggcacggctattcaaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccgttcgacccaactccatcacgcccaccctcgccaccggtgcctaggaaagggtcaagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaaaggtctaatactgtaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggattttctgaactcttttcctcgcgaccgcggacttccgaaacgacggattctacacgctggcacgcaaaacgaggaaaaactctaataaaaaccaaggaaacagtacataaaaagtaaacaaacatgtagagctcaattttagatgaattttgcaatttgaatggcccaattcggagttcgaatgaattagatatgaattttagaagttttgagccatttaaatggatttctataattattaatgatttattgagcaattatcaattattttctcaaaggaaaaggcattcgctaacgtcagcaaggggcgccggcgccgacaggcgggccccacacgtcagcgagacgaggtggcggtccaccgtggaccgggaccacaagggcggtccaccgcccgtccacgggatgaacggcccagatcggcccaagccgattgggtggctgaggagagcggtggccgggcacgggcacaaccgaggctggcccgaccgaccatagagggcggcggcgcgcagtcatcggcgatggcgggcggcacagggagcggcggcgcgcagcgcgggaagcggcgagaggaaacggaggcagtagggagagggaggtggcggagctcaccgaggggcacggcgacggcgagagcagctggcggagggaggcggcggcgctccacaggtcgacaatgaggaggggctcccggcggcggaaggcggcgaccgggcggcagatggggaagagcgggacgcggcgaagccggcgatgcagccgatgcgtcgcagcggcagccggggtgaaggcgaacggcgaccggaggcggaaaaaggcggccggtagggtggtatggcggggaggtggttctggtggtggaggggaaaaagggatgggcggccgagcttgcccttgcggtagtgaagctaatggcggccgcggggtggctgaca

SEQ ID NO: 49209 - DNA, 3840 bp, Oryza sativa
  unsure (1)..(3840): unsure at all n locations
gggtgcatttttttaggccccggagggggagatcgtggccgtggcgggcggcaacggccggcgtagggagctccggcgacgtgggcgagtggggctcgaacggcgccgatttttgggggggaaatgggggagaaagtggaggaaggggaggatgtggggtggaccacgtctgcacgtgcgcgggagcgtggaggcgcgcgggggaagcggcgtcgtggggtggctcaggcggccatggcggttggggttggccggcgagaggtaggaggaggagctcggtcccacctgtcggccggatggagagagaggagggaaaccaggggacgtaaagtagactttcgcaaggcgcgggccggccgagagagagaggaggcgcgcggcccgcgggagaggaggggaaggcttgggccaagcccaaaagggaaggaaggagaattttatttgttttctttttatttaattggttaaatgatctttgtgactttaaaattatttcttgagctccgaaaatttgcggaaaaatccggagagtattttggggcacaaagaatattacaaaatattctcggccaatgatttttaaaggaaattttaatttcctctataatttcatttgattaaattgatttaacttttaatataatttctagaaatgcattattaattgatttttaatcccgaacgaaaatcggggcgttacaaactctctcgcgtgcacgccgcagctcgcgactcctcctgcaccgccgccgctgctgccttcttctccaagccgtccaccgcctcctcgtcgtcctcctgcgccgccgccgccgccgccgaaccgtccaccgcatcctcactgtcctcctgtgccaccgggcgccgctaccttctccgagtcgtccaccgcctcctcgccggctgccgtcgtctgtcgcctcatcccggcgtcaccccagcggcctacttgcttgatcaaggttcaaagtcctctcctccatctcctccttcatctcatctcattttctttgtctgtcttccttcatccacttgttttgttgctagggttagacagcggcggcttcaatatccccctctgctaggaccttcaagatctagaaagtacagccatcctgcttgggtttgatgatctgcaagagaaatattggagacgaggtatgtcaatgcttggagatatgtaaagtacagccatcctgaagggaacaaaacacagtagggaatcactagcttcgatcttgtgtcaatgcaaggagatttttagcagaaataaactacaactagtagtattcctctacacactgctgagattgtaccaccaccactgcatgatataacaatgaatagcaagcagcacacattacagtattttacactaacaccattgaatgcacaaaagagcatactagcatagtagcataccgcttctattaaacaaagtgagtgttcagttcatacacatgcataattatctttaattatttatgaacatatatagtgttgaaactaaaaactagagtgctgaaacctttttttcttttactaactgcagtcatcttaaatattcagtattccttctagtttgaaggtatgaattcgctgattaggaagagcaaggatgaggaggatgaggagattattatgttctggttgcctgccctatatcttttaactagtaatggagggatagagaaaagagtaaggcatacttcaagtcagtacagtgaagaaaaactcagaaatattttagagggacatgaaaagaattgccttgttgcattccgcatggagcctaacatatttagagcaatagtgacatatcttcgaacagaacatctcctacgtgacacgagaggtattacggtagaggagaaacttggacattttctttacatgatatctcacaatgcgagctatgaagatctacaacatgaattccatcatagtggagaaacgattcaccggcatattaaggcggttttcaaggtaatcccatctttgacctatagatttatcaagcaaactactagagttgaaactcactggaagattagcacagatcaactgttctttccttacttccaaaattgcttgggggctatcgacggaacacatgttcctatcaccatttctcaagacctgcaggccccatataggaatagaaagggtaccctaagtcaaaatgtgatgttggtttgtgattttgatctgaattttttgtttataccatctggatgggagggatctgcaactgatgctagggttcttaggtcagccatgcttaaaggattcaatgtgcctcaaggcaaatattatctcgttgatggtggatatgctaacacgccatccttccttgcaccgtaccgtggagttcgataccatctgaaggaatttgggcgtggacagcaacgaccaagaaattataaagagttgttcaatcataggcatgccatattgcggaatcacatagagagagcaattggtgttcttaagaaacgcttccctattttaaaagttggaacacatcatcgtattaagaaccaagtgaagatcccagttgcaacagtggtgttccacaatcttatacggatgcttaatggggatgagggttggttgaatcaccaaggaagcaacatatctccagaacagtttattgatgtccctgaaggtgacgacgaatatagtaatgatgtgatgtcccttaacagtcaagtagatgatggaaacgcggttagagatatgatagccctaaatatgtggaatgactacagtcataactcgtcataataaatgtgagtcttaactggtctcatgaaatattttacttctgtatttgcatcatgatgtttttgcatgcttaaatttgataccagtttttttgtattcacagcaacaatgtttggaagagggccattttcatgactgcaaaagactctacacgactcaagtggttaagtgcaaaagactctacacgactctacacaactgtgtaaatctggtactgctccttccgtcttgttactgtctctatgaaactgatgaatatatgaattagtactacactttagtcatattaaacagttggattttgtttgttgtatcacctaaaacttcaattcagtgatgctcagcaaaagtattttttgggggtaaatgttgagcagattggcagatgatacatttgtagttttcacattgtagcatcacctgagatgtaggtgtactatttatgataaaaatgatgctcattatgccttacatattattcatgctctttttgttttttggggagtataaacttttatatacatatattctaatatattattgttgctctcttcgggctctaaaagcatgatctgaatttgctgaatttggagtgagcttatctattcaaatttgaagatgcacagagtgaatttgtttaaatatactacatccgttccaaaatataagcatttctacttgtttatcaaaatatagcttgtaaaatgcacaattgatttcatcttgctccaacttttcttagtccatcagtgctcgtgtcctaggaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49210 - DNA, 1194 bp, Oryza sativa
  unsure (1)..(1194): unsure at all n locations
aagagggtagantctctnctactgcaagcagttcatcaccctccttgtcctggatcttggccttcacattatcaatggtgtcggagctctcaacctccaaagtgatggtcttcccagtcaaggtcttcacgaagatctgcataccaccacggagacgaagcaccaggtggagggtagactccttctggatgttgtagtcggcgagggtgcggccatcctcgagctgcttgccggcgaagatgagacgctgctggtctggggggatgccctccttgtcctggatcttggccttgacgttgtcgatggtgtccgagctctcaacctccagggtgatggtcttgcctgtgagggtcttgacaaagatctgcataccaccacgaaggcggagcacaaggtggagggtggactccttctggatgttgtagtcagcaagggtcctgccatcctccagctgcttgccagcaaagatgaggcgctgctggtccgggggaatgccctccttgtcctggatcttggccttgacattgtcgatggtatcagaagactccacctcgagggtgatggtcttgccggtcagagtcttcacgaagatttgcatgcctcccctgagacggaggacaaggtgaagcgttgactccttctggatgttgtagtcagcaagggtcctgccgtcctcaagctgcttgccggcaaagatgagacgctgctggtccgggggaatgccctccttgtcctggatcttggccttgacgttgtcgatggtgtcagaagattccacctcgagggtgatggtcttgccggtcagtgtcttgacaaagatctgcatgccaccacggaggcggaggacaaggtggagggtggactccttctggatgttgtagtcagcaagggtcctgccatcctccagctgcttgccggcgaagatgagacgctgctggtctggggggatgccctctttgtcctggatcttggccttgacgttgtcgatggtgtcagaagactccaccctaagggtgatagtcttgccggtcagagtcttgacaaagatctgcatgccaccacggaggcggaggacaaggtgaagggtcgactccttctggatgttgtaagcagcaagggtcctggcatacttcanctgcttgccagcgaagatgagacgcttcttggtccggggggatgcccttcttaatcttg

SEQ ID NO: 49211 - DNA, 965 bp, Oryza sativa
  unsure (1)..(965): unsure at all n locations
ncgcgtgaacgtcgactcacgcagtggcaatagcggatgatagtgcttgccgggcagagtcctgacaaagatctgcatgccaccacggaggcggaggacaaggtgaagggtcgactccttctggatgttgtagtcagcaagggtcctgccatcctccagctgcttgccagcgaagatgagacgctgctggtccggggggatgccctccttatcttggatcttagccttgacattatcgatggtgtcagaggactccacctcgagggtgatagtcttgccggtcaatgtcttcacaaagatctgcatctgcaagaaataatcaccaaacagatagggtaagaactagcacaagattaaggacacaacaacggatcaaacagcaaacatattccaacagaacatacatgtattcaaaaagatagtaacaggcacatcacacatgtattcagataggtagtaacagcacacgtatcctgaacttcagaaataagtagaatgaactagtggcaataatcttcacacagatagtaaaaagaaattaccacaatagattatatagatgaactacagattgtaacatgatattactacagattgtaacatgatattctaatatagttcttagcataaattactggcagatagtaacatgagatcattatgacagatatagcgacaagacttcctatttaccattgacaattaattaaaagagttcatcattatctaatctgtgaacatatgaaatcaaatcgaaacgcacaagctacataattgaaccatgtgtaagaagaactaccctacagatctacatcaaacacaaaacagatgtaacatattaaagcctgtgtttgcaccaacccatggcaccaataactcaatcaagagcggaacagtagatctgaacatgctcgcaacatggcctacaagatggaacacgctacaaatcgcaccaatactcangc

SEQ ID NO: 49212 - DNA, 2359 bp, Oryza sativa
  unsure (1)..(2359): unsure at all n locations
cgcgcggtganctttgatgtgcgtccgtctgcaagtagctcatattccttaaacacatcagctctagtatacgggcgatctcctctatatatggttcatatgtttgctgaaaggaagttagacatgacgaaaagttgttcatggtagtccaaaccacaacccggcccaaattgaaaagataggtttaagggtgatccaaattgagacttaggtaataaaaggtggatcaaagtgcaatttactttttttttactgtaatttcttctggctggtttgttggtcgccgttaggaccgggtgacgccgtcaaccccgcgcctccgtatttgctgacgtggggtggcgcgctggcttccgccttgacccgaatttgttttccttccgttaaaaaaatggttttccttttcttaaaaaggaaatagtttgttttttaagtctgtgtattaggattattacacttgaattttggtatatgtgtaggataatttactgcatgtttataatagagttgtactatagatgaaataacccaatttttggtataattcgtgtttggttggaggtcaaaataacaggttattttgtgaagaaaaaactccgtagtatagtaccatatccatcatgaatacacatactgcctagacgagtgattaggatgaatccatgttatattcctcaaaataatataaaccacttgatcttatgatcttatccaatctgttcatataaactggagatataagatggtgcatttcccttttgatttcttttgttgacggccatgagataggtttgcatccactgcatttatatttcggaccaatacaatgcacctattgatacatggggacagctcaactaaccatgatgcaaattgctggttggtgaccagttcttggcattatgataatgataggattaaaaaaaacagtgcaatgtctcggaaagaaaccatgacaaagggtacatgttgcattccagtttctaatgataaaattatgtgccagcaattcaaaaatcatgcgtgttccctacgcaccattctttgcaataaacaagtgcatgcacaatatgattgtgctaagggtcaagaacttgttgcagtggctaagttttggataagaccaatgaacaaacagtactagtagtttgttttatgaaatttgcatttctgcagctgttttctaacaatttcatacggcagcctatgctgattcacttggacattgccccctccataattctaatctttggttccaaataaaatcatgtgtaaccaaactgttgtagtatgaattatggattggtgtccttttttttccctccggactcctattggcaatgtaagactatatgaagtatcagatgccactcggttggagatttaactgaatttgacatgaataggcaagatcacacaaactaaagtgctccagaacaaaaacatgcagattaggctaccaacaccagcctgaaactgttcatggacttgctgcatacaaacaacacagtatataccatgagccctacaaggctatatgaatactgctgagaaagggagaaaaaggtgaggtaagaatgtagaaattaatagatactgtaaacaaactgatattccaatactaccatcatcttgacaacagcttgcttaaatcagaaatccacagttaccaacagtaatataacaagagttaacttcaacagtatttatttgtgcaacttaaaagacaccataggaagccttgaagctatcacccctatgctgaagtactgaaatgagaggaaaccatgtcgttcactcctttttcccgactccatgagacatgttgtacaccccacggccctgtttataaaacaagaaacatgtcactgtctgaacgtaaacaagaccagagaaaacaagccacgcaggaatcaattaaaagaaccccagactcactatcataaacaagctggaggcggcaagagcgaggggaatggcaacggaggtgaccacatcataacgccctttcagatacgtgtgcttggtcaagttctgaaaatactgctgctgcttaaagagcctctcgcgcggcaaaaacggtgattctgtcattctgcatcacaacagaaggaaccaagacaaatctatatcaatatggaaagaaatttatctttcttatggacatttttgcatataaagaaaaacatacagaattagtataattactgtatttgactttgagaactaatgacactagaaatcatcactgttttccttaaactgcttacttagaggagtactaactaactgctatgcagccatatataagttgtgatgaactacttgcaatcgagcacgattgcacngtgcacggcgg

SEQ ID NO: 49213 - DNA, 47239 bp, Oryza sativa
  unsure (1)..(47239): unsure at all n locations
nnnnnnnnnnnnnnnnnnnnnnnnnnnnnnnnnnnnnnnnnnnnnnnnnnaaagggtagggtttccgtcctccgatctacctcacctgccccaaaatactcatccgcagctcggatccacaccagagttcggcttcttgcatgtcgggctcgctgnttttctttctttctttctttctttctttgggtggggtggggtggggtggggttcatcatctcctaatttcatggctgaacatggctcatgaccaggattttatagagttaacagttagtcactcacaatcttcaaatcacaaaacctaaaaaaggaggtctgaagtatcaagtatgcaacaaagcatgcatatgttactaagcaacattgtatcccaacagtcttacacctattcaaaattacatgacctcaaacatacatgacaaattatacacctagagcctaccacttcattcctacaagcataatacaagaagttgacttgggcccaaaacagaaacaggttcgtcatttgtcaagcaagattgggccacaccaatacacaagaatattttattatgtgagcatagctgaacaatttctgcggggttctgaaaatcatattggcatcagagtcaaccaaagacaaacagatgctaaacacatactggtacagatcccctagatgtagccacgtcaccttcttctcccctttatggtgaacaccccttcctccatgcacgatagctgaacacctctccctctatatggtgttgcataatttttcattcacgcaatacatctatcacattttatcggtgaggcaatgagttatatattcgtaactaataagacaatgaataattttaagttacggcataatgctattttgtaattttcactgttgatcagctaatgaaatactccctcccttttatataagagaaaggctcttttgtatctaagaaaaaggagatagtactaaaattaattcaattgcagtaaacattagtgtccaaagtttctgagaaacaagtatataactactaatatgttgctgtttccagtgtgatatgttttcacacaagatgttccttctccaatcaaggattggttgtcaactattgatagagccccagaagctaataagatacagattacagagtggcatgtcaaaaggcagtataggtcccggatgcatcatgcatatagattgatgtgttgcagcggagtaagaatatcaggatcgaaatgatgtgtgacccgctagaaatcaaccaatggcttagatcagctgaaatccaccagattgatttggaggcaactccagggcatctgcacccaaactgatacagcgagatacacatacaaaaacacgcgagaaattccatccacgcatcaccaaaaaaaaaaaaaaagggcctcagattaataacgctccacgaatcgcgcaggtcgcaccaacatcaatcgcgtcaggaactcaagaaacacgaacagatctgctccgccattaaaacccctcctctctcaactcccaagcctcccaaccatcacatcgaacatcgaaacaacgaggcggaaatacaggaggagggaaacaccgcaccttgagacggaggcggaggaggagtacgacaacggattgattggacgatccttgcagcggcttgggggattttggatggatcgcggcgagaggtgaaacgaaatggggggaggaggaggcaacgacgaagaagcaggaacggcgaccgagtcggggaggagacgtcttgggaggaaaatgggccggattacttctggcccaacaccaaattttgggccaataataaggcctagtagtactatcaacagctgagggcgtgtttggttagctgcatttaagactatggctaataggtggacgattagctggtatagacgtggaagaggaaaatcagatgtgagagaaagaagctggctcctttacaatcgtccgcttggcatgagcgtctaggtgctttgacaacctagatccacgtcaagagatgggagatagagtgtacactaaacccacataatattaaaacaaaatattaatactagaacaagtgtgtagagcctgctataatataagatttagagccgatggtgggctcctatattattcttgatctaagggtggctcacacctatgtgtgacagttatttggttgtcagtatgaccgtcggggtctagttccagcattccattcatgcgaaacaaacacctgatccaaaatcgctagaaacacgaggaggtgagcttcgttcctcatgtaggttatgctcgtgcaggcaccaggtcggtgtaggaggtgagatagggtcacacattgagtcatctctctttctccaaatgctagtttgtgcctcccaatttgttgtcgcctccatcgtgccccctcaccagtggatccccttccccctcctctttggctatttgtagtatacggtgaaccacaacctcacaaccactagatctgatggtcgtaagttcagtactattggatctggtagtcccgacctcagtttggataaaacatatgagccaagctaaaggcattcgggtaaccaaacatactcttaaaatgtcatgaattttcatgtggggaataaattgattcatgtgaaatttgtattaagggatggttaggttctctattctataaagattcagcggcaccgttaccttttccctttaaggttgcgttcgtttgtgtcggttgggagtctatccctccggcacgaaaaacggaacagcttattatcgcataattaattaagtattagctaaaagtagctttaaaaatagattaatgtgattttataagcaattttcctatataattttttttcaaagaacacatcatttagtagtttgaaaagcgtgcacacgaaaaacgagggagagggattgaaaacctgcaatgccgaacacaacctaagaagggcttgatttctattagtagagaaaatgtggccaacatttgagcccgattttattagcattatcaaaaattgtgtttgactaaattttgatgaggtgtttagtttggtattaccaaactggatcaagaaccagaaaattgctcatgccatctctactagacgtctttttattgtgatgcttctaattaaactgatggatcctaaacctcttaaaccaaccgtgtcatgtgactaagtgacaactaacaaagatctctaaccagctaagttccacaaaaaaaaaaggtgatttttttatttgaaacgatacgcaaaaacaagaataagccttcagaaaaagaaagaaaaaatggagccgatttgcctgccaacagctgatccaagcctatcagagctgatcacacatgatgatcatgccacgattgacttgcaaatttaacggttatggattggtaggtgcgaggcatgaccggatcctgtctcattggcgtccatcatttcccaaaatcttatccagccaaatgtttctctcctctcctcttcatatcactgtatcaaaatgcatatatgattctaaatttctaatctctgtacctatcctaatccgacaggaaacagcttaattatcctacacttacatgcctgcaacaccacagaaaaaaaataggccaaaatgtattgaggggaagggcttagctggcctcttttctgtgccaagaaacaatgcatctctatctatagcttgcatatatcaacatatatattatttttatatggatcataatggaggtttctttttgtgttaaaaagttcagaaatgaggtgttcattgctgtgatggtttaagggtagattagtactagtggatacatcagtaagcaaatcagagaaggctgaccaagtttagacagattacagatggtagacacctgttatttctgcgtgatgaaatggcaacttgaattttttttattaaaaaatgaaatgaagagatacttcagaaaagttttgatgaagagcaccaggttaattctgatatattctgataacagaacgatagtgatgcctaattttccttgcgttgtgtttttaattagcttgcaagtgatgttattatctgatacacctccagccacaaatggatatttaatatcaaatggtaacacaagcaacctctagtgattggttgcagcttggtggaaaatttcatggtgtgtatagaccctagaagataaacaaaacttgttcataatacaaaattaagtcatcaggatcaggaagagatatccagagaaaaattcaaacacatagtgaattaagtggaatgggacagatcatcatccaccaagtgtaggaaatacgtttctttgagccatagaagataaggcactgaagaaagaggtcatactagttccatttgaaatgtctgcatgtgttgtgttatattgttttcttaactaacaagcttaggcaaaaacaatgagcaagcaatgacaaaaaaatccactggttttcttctttatccaatataaagatatgcagccctcctgaaagttctagacaaaaatgtgatgtaaaacttcatctgttaaagataaaattggatattttttaaataagaagatgatttgctgccatgtcagtaccacctaaaaagagccattctatgcaatgatccttaaaagtactaggactatactatacatctgatatgtaccatatcatctattacagagttaaccagcctattggcctgaaatctttcaataatatacctacccatttgagctgcaaagtttgtgttttacttgtttgcatgacaagtcaggtgtaagacggaaaaacttgaagcctgacagttaatatttatatgaaatcaccagtcattttcagggaaaaattatgcagacaccagcctcttaggaaaattatgcaggaaaattataatattttcgatgttagttcccgttgtatggaaaacaagatctaagtacagctagaacagtgcaactgcgcaagttgttttttttttcagcaaggcttgaatggctctcaagagaactaaaatataaaattggaagagggggaagaaggtgcagccaactaactaacttgtgatcatatttaagcacttgtcatgctaccctcacagaagatttagttcctcctctgcctcttctccatctacagaaaactacttgtgctaatcaagttttatcttgtttcttccccatctctttcttcttgttgttcttcagactgaacttagtctgaagattcagaaataaagtgtgattttcaaagctttgctagttgcaaacgagacactagctttggagtttggaggtaagctgctgtgctttccttttgccatatgcgattcaaaatatatgagtctgtagcacccaagctaatttttttcttcacattggtaatgaacattgtcattcatgatgtagggagatcttgcttgtggagaaactcacaaatggcgataaagatgaagggaatattcaaaggcctgaagataatctctcaaatgttcggtaatactcctatctttctttgtttccctatatctctgcctgcttacattacttaagcttgcattttgttgattctggtttataaatccagattcagattcaagaaaatgtagtaaaagcacaataagatagtactgtgtgtataaccgtgagaaatcacagaaagtgatcaatgtacaacaataagtttataacacatggtttctttttcttttgcagtgcataaggagcatgagatggaaattgggtaccctacagatgtaaagcatgtggctcacataggtttgggcaccagtgacacatctccaagctgggtaaacataccaatacttgacagccttttcatcagatgatcaactactgcattatgatttatgaatgttttctgtttatgagttttgcttcatattctagtatttctaattattggaaatgtacatttctcactttcagatgaacgaattcacgggaacagaagatttatcaaccggttctctgagcacaactgcaccatcaaggcagacttcttgggcctctttaggtatttaatgtcctctcatctttctatgtttatccttcaaaaataaagtcaatacaacatatataaaggttaatcaaacaaaagattctaaaatatgaagttccattggtgcttttgaatatgccacttgagccatgcctgatataaaacgtcacaatcatccatagtagtctaattggtcctgaatcttcagaactaatcatttattactatataaacgttggaaatcttcttgatctattttctaaggacaagtacttcagtagtggcacaccacttacaccattttctttttaggttgcttgcatgtttacaaggtgcaatgaacagatatacagaaaaatcatcaaacatggtatccaaacattcatgatgaccaaataatattttttatgcagattttgaacagccaagaagcatgctgccaattgagatcttgccggagaaatctggccaggaggcaccctcctgccctgacatcccaagaggcccaaggaaggtgagaaggaagaagaccagaacatcatcacctacctcatctgcaagatcatcgtcctcgaggtcaagaacctcgttcgcaaccgcatacgacgcattcaacgaatcgcaaagagggtttcgggttgcctgaaatttacagattgtgtttgaaactaccatgaattgtacattgtatgtcggtataggaagagaattgattgtgaattgtttgattctttctttttctttcttttcttttacagtcaagacatagttggaaatgcaaaggaaaatggattaacttaatgtttgaagttgtgtgcatctcaaattttatacttctgactaattcttcagattcttttaatgattggatggcagtcggcagatgttagacttcagtagtataatattttttccccacttcagattgtggattaaaaaaaaagttttctaacatttttcaataacatatcaatataagtaagcttgattcacatcatttttttctgaaacacatacagctgtgagggggctaataatgccattgatcacgacatgcaaggaccaagaacaattcgactaactttttttctacgccaagttgccaattgccaagacaaacgtgcaattgacatgatgcaacgtttcatcatgcctcagcactttgttcaaggactgtaataatgtgatacacagctgatctaatcatataaaaaaaacacttggaaatatcatcaatctttatatctcgtgattatgcactgcactctgctttccttgcatttgggcaaagcataacctgagcatcaagggcaagaaccttttgctacctatgcaaccttacaaaaaaaaagaaactttttgggagtaaattaatcccatttttaccctgacataactattcaggtcttttgcgttgatcaacttaacctgaccgtgagtgcaatgctaagagcaaagtcatggccctgcgttgaccgacgtatcacgctgtgccacgtgtactaactaaccacatgagagtgatttgacccaaacaatcactacattggaaaatgacttttttttttccatgtaccatggactgactcacaagccatgaatattccagtgtcacctggctagtcttgagctctgctgtgaatgtcaggtaggcaaccatggcattgcaacaagcacaagagacagacaagaacacaagatggaagtaaaggtgaggtgtcatatgctttggaagctaatctcaaggtgtccatggaaagcaaagtacaccacagcttgtaaagctcccagccattgaggcctacaaatacccggctacctagcttggcctcttctcatccaccacaagaagtgaaaagcttcactgagcttgatcaattactactagttaattacctatagctaagtagtaaaaaaaaaactagctggttttggtttttgttgcagtgatcaatggtgaaaggtactagtggttacagctatggccttgggcttgcctgctttgctcttgtggttgccatggctggagctactcagctcaaggtcggcggcggcaatggctggagcgtcccggccgccaatgcggagtcgtacaacgattgggccgagaagatgaggttccagatcggagacaccctaggtaatcaattgattaaattcgagttctttgcgacaaatattattccatgcatttgtgatgaagcttttgaggtactagctctgtttaatgttacgagtcgttttgactttttttttaaaaaaattacaacctctttagcttcatcaagtttacagaaaaatatattaatattttcaacatataacaaataaaaactattaaacatattcaatggtagagttaataagactaatttagtgttataaatctatattttttctataaatttaattaaactttcaataaactggactttagaaaaatcaaagcgacttataataaaggaaagtagcgcatgatcatgccggatcatcatctatggacaatggttgcagtgttcgtgtacccgaaggacaaggactcggtgttggtggtgaagccgcccgactacaacgcgtgcaacacgtcgtcgttcgaccaaaagttcgccgacgcaacacggtcttcacgctcgaccgcgccggcgccttcttcttcatcagcggcgtcgacgccaactgccgcgccggcgagaagctcatcgtcatggtcctcgccagccgcaacggcaccgccaccgccaccgcgccgtctccgcccccggcttcgtcgaccgcgccgccgcagacgtcgcctgcacccgccagcccgccgccgtcgtccccgtcacctccgcccgcttcaccgccgtctcccagctcgtcgggcgcggttgttcggagaacgccccggccgggttgttggcttccttccattcgaaggcaaggttggcttgcccaatcgggttggtccccgcgggcccggcaatggccaaacgccccaagcgcccaggggccaagaaacccaagcgcaagttgttcccgccggcccccgggaaagggcccggcgcacccccggttgcgggcatgggccttcccccccggcatcattggttacgccatgctcgcactctgaagtctgaccatgcaatcagtgcaaaagtgaagctgttgtaataacttgaattaatttggagggagatgatttgtgtactatacgtgtgtgtgtatgtacatcgtgtgtttgtattaattcgttttccaaaggatgaataagaacaaaatgatatcgagcatttgtgccaaaatttgatgtgttcaaatccaaatattaacccttgtttttttatttgaaattcgtcgccggctgaagtgcaggcaacacggcgcgtttcagccgacgggggcgggtacggggattcaatctccgatcccggataaatcgttgggctgggccggcccagttgtactttccagcccgtttgtgaaccgttagatggtcgaatccatgacctcatgcctaacaacaaactcttccagtttatgaaccgtcgttagatggtcgaacccatgacctcatgcctaacgacaaactcttttcagtttaaatgtcaaaaaacaaactcctttcagtttatgaaccgttagatcatgtggagattcgtgcaggagtctgcatatggctggggtcgacccacgacattatgcctaaagacaagctgcattaaccagtgagcctcgtgcggatttttctgttgattttatagcagttacatataggttagttatagtaacaatatactccctccgtttcgagaaatatttgacaccgttgactttttagcacatatttgaccattcgtcttattcaaaaaatttaagtaattattaattcttttcttatcatttgattcattgttaaatatatttttatgtaggcatataattttacatatttcacaaaagtttttgaataagacgaacggtcaaacatgtgctaaaaaatcagcggtgtcaaacattttgaaatggagggagtagttaaaacggacatacactccaattatactacagctacatttaactttgcatttgaaagttcttcataaaaaaattgttgaatgttgtacaggtactcccaattaaaaaatcatcaagaggtcctttgaaaagagtgatttaggttgtgttagagaggaggggttgggaacgccgaacaccacctctccagtatgcaaaacgaagcacacattagcatataattaactataagtattaattaaaaaacttaaaaatgaattaatatgattttttaaagaaacttttctatacatttttaacagtttgaaaagtttatgcgcgaaaaatgagagaggtgaagttgggaacattaacttaagaacataacttttctttttggggaatacagttaagaacacaacttatatgggaaataaatcagctcatgtaaaaatagtttcaaatttctatcctttcatccgaaaatataagcatttatatagtttttcacgtgggttaacgagaggagtgaaattaaacgagaatggccggttgagatggaaaagttggtagagaaattcaataactgatgactgtgaatgattgatacgatgtagtaggtgaagatcttataatctaggataaattttaaatgctacaaaccattgtatcttggaactgatgcaacgcaattgcacgccaactaacgagctgattttctaataaacaagtaaatcatccatcatcgttcacccgcatttcatctacttcaatctacattgttccacccaaattcaaacgtaacttatgatctctcaaatcaaacaggtattatagtttctggtgtttctctgctaataaatcaggatcagactaaaatgatctcacatctttaaaaaataaaataaaaaagagaggcctcctcctgctctctcccgacaaatgacattggctgtcaggcagcctgtgcccaaatcaagaatcatattccggtaaaattatccagcttagccccgagtattattctgtccaactttccaagctcgatcggcaaagcatcgattcgaaaggcgacgcagttgacgcgatcgacgggataaacacagcatgaaaagcgatcgagagcccccagcacatgcccctgcatgcctgcacgcccgagcaaaacgttagcttcagcaaggcaccgtgtggcctacagcttgtaaagcctctccccgatcgatacgcctacaaatacacgcgagaaacctgcaacctgacgaaaccatcaccaaaattcaggcatctatcgacagaagcaagatcaggttagtttgttcgttgtgcatggcagcaatggcgagcagctgcagtgtgcttgttgtggcctgcagcttcgctgtgcttcacgtcgtcgccatcgccggcgcgacgcagtacaaggtcggcggcgacggcggatggggcgtgcccggcgccggcgacgagccgtacaacacctgggccgagaagaccagcttccaggtcggcgaccagctttgtaagtatatttacagttagctgctttaagattcagccgttattatttttcgagtgcacggcagatacatactatatacacatagtgaggtgagaatcatcaactataatgtcatcatcattacagtcactagtatataggttctactcttttattgtcccacatgtcggtgtctataataataatgtcattatgatagagaatatgaactcataaggacagacccagccctcggcccctaggtcatggcccggaggcctatggctgaacacccatgtaccttttttttttttgcaccatgatgataaaaaattcagtacacgtgcaacattacagtcacacttttgagtctatagcatatgcgcactgacacataccacaacacacgtaacatcacacttacacaccatgaatgtaccgatcttattgcgacatgttaataagcattttttttaatgtgtatgctagtgttcgtgtacccgaaggacaaggactcggtgttggtggtggagccggcggactacaacgcgtgcaacacggcgtcgtacgacagcaagttcgccgacggcaacacggcggtcacgctcgaccgcgccggcgccttcttcttcatcagcggcgtcgacgccaactgccgcgccggcgagaagctcatcgtcatggtcgccaacgccaccgggagcagcgcttcgccgccgtcctcctcgtcgtcgccgtcgtctccctccggtggtggtggtggcggtggcgctccagccgggcaggcgccgccgggtgctccggccacgccggcggggacgaacagctcgccggctaacggcggggcggccggcggcggcgcgaagagtggcgctgggctcacggtggcggcgagcggcctcgccggctctctgatcgccgccattgcctgcgtcgcgattgctatctgaatatctgacactttgcaagagaagatgccgtttattcgtttattcagaaagtgaattcttctgttcgtttgatgtaaaggcaatgtaccttttagtttgtactacttgttattttcccttgtattgtatctttgttttttcagacaaaccattataaactgaagacatgcaattctaacatgggaggacctaaaaaaactgccacaagtttttggaataaaaaactttcggatataattaaagtgtaattacgttgtaagtacattataactacactataacttatataaaacttgcatttgcatttgcctatggtttggttagttagcattgagatatcttacacatgacacttgtgaaaatttccaatatctttgtccttggatagcggcagatgtaaaagaactaaacttctataagaagttaaataatgagaaactttacagaacattttcacagcatatatggtcatcgagcgcctattctagccccagaacaaaggtaggatgcacgagttttaggtagcttaggtaggatgacaaacacggctagcttaggtaggatgcacgagttttaggacctcagagagaatgaatcacctcctaatgctagcttaggaatgactagttctagtacttcatataaaatgaaaaggaaatgctattcttctgttgacagaaaatgcagtgccaaatggatcaaaattcaactttgcagtatatcgccagaggccacacccacatcgtaacatgtagaaagcatgcgcagatagcataagacaatccaaccatattataaggaaccacgaaggtacacatattgggtttgttaagcatgaaaactggaaatttccttgaaccaaaacatagcagccgaattaacttgacagtcaacaattcaggacactgagcaaaactaaatctctcttcaggaacattgggagctatgagactatccaaagaagagatgctccatggcgacaagttggctgacaatacatctacagcctccttcctctcctacctccctttctgcgggtgctgtccgtgggaaccggggtcacatcctctgcaaaaaggatcagacatacaatcatcacaatgtctaaggaggattgaagcataatgagcctgctacaaacactatccacagcatagatgaaacaaataactatctctatatccttaggttgtatgagtgaaactctgaatttaccaatgcgaccaatcttcatgccagagcgagcaagagccctaagagcagattgagcaccaggaccaggtgtctttgtcttgttgcctccagtggcacgaagcttgatgtgcagagcagtaataccaagctcctggaaatgttcaacagaattttaaaaatacttttaaaaagtcactcaagaactgtccatctgtccaattgagagataatgtttccatacaaaccttgcaacgctgtgcaacatcttgagaagcaagcatagctgcatatggtgatgactcatcacggtcagctttgaccttcatgccacctgcaagaattcagggaatggtcaatttacctcatcagtaattgcagctagagaaccaaatgaaataaataaacacaaatcataccagtaatgcgaacaagagtttcccttccagacaagtcagtgacatgctgcagaggaaaacattggtaagaaactgaataggtggttagactagattgaaggatatatataactggaaaaagaagtacttacaatgaaagtgtcattgaaggatgcgaagatgtgggcaactccgaacacatactctccttcacggacagtgggtccaagagtgacgttctcctccttgggctccctggtcttcctcttcgactggaggacgagtaacagttaagctatggaatgagaaggaaccagctacagctacataacaattacatttctacatgccaagttgtgacaaaactaatttatgccataacctgccatacaagtaggtgtgcacagtacactaagaaattttcatgcctctcatcaagtaaacacagagaccttcctacatcatccaaatgttcactacaaaacatacttggagtatctatcaaaaacagtgaaacacccttgcaacaattacatttctaaacatcatcaacacaaaccagaccttgttcaacacaaaactgcgaatcaaacgccacaccaatcatgtgctagggtcatacacgacccaaaattagaacagcaaatcagtgaaacacccttgcaacaactaaacaaccatttggccatcacatcccagaattgatacaaaccctgtaataataatctccctaacatgccagatgctctagtactaagttacagctctacaaagccaactcgcagaccgtgcgtgctacacaaacctagcatcaaagctgcaaatccgggcaggaatttgacccgagatggggaacagggggggactttggccttaccatggtgggacgaggcggcggagatcgaggcgagcgccggtttcctcctggtcgttgagatcacgagctcgccgccgccggagacacgagagaagagggaagggtggagcagcgagtgagctttatatatgggcgcggcggcgcgggggctagggtttgctgcggaagcagcggtgtccaactctcccgctgcaagtgggaccaggagtgttatgggctgggccaagatgttgtggacggcaattgacggcccaggttagcccatgctgtaggggcggatgggccaaacaagcagagaataattgggccggtcaatgtgtgcgctattttttgaacaaaaatttcatagagccacatctttacaccgataccaaaatttgaatctgaaacataattttgacgttgattttaaggtttttcatagtttttttaaccttgatgtttaagtcattaaaaataaatatgtaaatgtttaaccataatttttttatcagtaatgtaccgttgatgtatttactagcaattggccaaccatgcaacgatagcctcacgaatgattttagctgaatatgttatttacattctcagcaatcactataagatatacatatgtttaaccgtttgttttatttttttttctaaaaaagaacacgtagctatcattttgtctcattgcgagttgatttattattaaatatacttaaaacatgacctacattttttttcatatttacccaactatcgacgtacgtccaaaaggcaataatatcatctataaaaatcacttgtctcgctgttaaatagtcaccgtatatgtctgtgtcgtgtcgttgtcactgtgtggtgaatatatggtgatggatggaaaccaaaatgctctttcctcgtgtacgacggtgtacacgagtacgtcgccttcgtgcatgtgtgcccggcagttcacggcatcgcgtcgcaatcgcagccgtttgctccacaccacacaacacacattgtacggcgttgctccgtgcgtagcttaggtaacctaccctgggcggccggagcccgcctccaccgggcgccggacacgtcgccccggccggcgccgtcgccgtcgcggcgctcattaaaccgaaaaggcgccgccgcgcgccgcccactagctcgctggggagacgccgacgtgcgcgcgcgtgtcgcgcgctcacgcggcgcgggcgcgcgggcggcattaactccgccgttgaacgctagcgcgtcgcgtcgcggcatggcgcgccaacggacgccagccatgtgtgtgtcttgtccgcgtacgtgcgcgccgctggtgtcgcacagttgtgtgatccctatctcaccgtagcgtatgaactgtatgtacagtagctacctgctactagctctgtataaatacatgtactgcctcaagctgggcactgtaaaaccgtgcacacttaagcccacaaaaatcacaagctctcgcagtgtcactagccactagtgtgaggttacaaaccaaagtttttttttagttgtgtcatggcgaaggcgcaggcggcggcgaggatcatgacggaggtggcgccgccgcagctggtgtcggtgatgcggcggaggaagcaggtggcgaggagcctcgacacgatcgccgaggacgacagggagctgatgcaccaggtgccctacgccggcgacggccaccaccacggcgtcaagaagcaggctgcagcgaccagctcggcgagcaccttcgccacgccgacgttggccttcgagcggcagccaccgccggcgccggcgccggcgccggcgagcgggttcatgagggggctcagcaagtggttctccaacaacggcgtccacggccaggaggggtggccggagatcggccgcgaaggtcaccggcgagccatctattcacagcaggcgcacatacgtgggcgcgccacgggattgaattcaagttcattaactagctagtcgagtttagtacgtttatcaagatgagatgtacccaagtacccatatgcttagttatgatgaattacggcttaaaacaattttgtctccttgacaataataatatttgcaagacatagttgtcctctgaaacaaggtatgaactgttacgtaccaacaagtcagcatggtagagatgtgtactgtcaatctgtcacagcctagtatgtctctgtagtggtcaagggaacataaccaagggagatgcgtgccttttattttactatcacttggaacatgagcttccatgtacaatgttcagttcttaattacactgcactagcatctaatacgcacctatcgcgaaagaattttgctcacccagccgacctagtaacaacaccggagagacattatgttacactcaaatgccctaacgtgagcaactagcggtcgagcaccaatgcaaaactatgatgcatcggaagcgtctatgaagtgaggatattcgtatttaagttttttgtcctgaatcaaatgaaaaacatattgtaccactagtttgcatcatataattgtggattatcatcagctctcactcctgtttgaatctatctcctccatatgatatgtatgtacaggtatacaagagtaacaaactgttctctcttacatttactgctgataacctgcatagttcaaaatagaacaatcagtattatagtaaaaaatcatggcaaagtacagttaccacatacaatttgtttggcaatagaaggaaaaggatgcatacaccagtgatatgagggcttctgtagtatactaatgaacattgccgaatgggcaaatgccagagaaaccaagcttatgacttgaacaaatatcctctcatgctttctccaagcactggattgaagggctgtcaaagagtaaaccaagtcagaggccaaaataagttaaacattccattatccaaatgcattaaacgaaaacctgaagcaccagggaaaaaaaaaaggaaactacaggccaactgcagccgaatatgaaagatgctctcccataaaagctgcaaaaggtttattgcctgtagggatatttggaacttggaagcaaagaaatgggaaggtttttgagaatattactcctgaagaggaaggttggttcagaagtattaaacaggatattctcctgcatttgtgtaggatgaatgagtctcttagcccttcgattctttcctggttacagcagttgtagttttgttttgctttctttgttggtttgtaaatatttcctctactaggcaaggcctggtagtattttcctttaaaaaaaagctgtaaaagtaagagaaggcaccatctagctacagggagaacaacatgtagaacagactaatgaagagcaggaagctgcaattaaatctaaaagctaatgatgcagtttagacatcctggaaatttgggatgaaaacaaaaagaatggtagaaaacatttgacatgatagtggtaagattttcttaagcccctgccattaccctatagctgttgacttgttgtatacaaaattataaaacaaatgaagggctgaccttttgttgctcaaaacatgtagcagcaagctcttgttgatgtttctagctacaccactaaccacccacagaagattttatcttgttccgctgaacagtgccttttcgaattaaagggttttctattgaaaatacaatcaaactgccatccttggttcctgccaagaagcactcctctggagtcacaactagtgaagttatagtcttcccagctccctcatacctccatacaacatcaagagaatgcatagagcgaagaacaatttgtccatgatcaccagcacataccacaaactcaccacaacaacttagttccatgcaattgagacggccattggcttccgaagaagcaatatgttttccatttatggaatacatatgcaaggataggtcactgtcggagtaaaatactagtctgccatgctgcgatgctaccagtttcgacaagccagctcctgatggatgtcgaatggatcgaacatattttccctcacgcaatgtatgaaatatacatgttccatcttttgatccactgataacgatatctagttccgtactaacaaataagcatgtgataatatcatcatggccacataaaatatgataagggctttcgataataacatgatccttagtagacagatcataatttgcatttcttgattttttatcagctgattttcctcggaatgcatgccagatcataacagttgtgtcataacttccggttgcaattacacttccatctgatgaaactgcacagaagtgtgttgacagatgtcaagataaaagcgaaagaaatatcagagatacaaggtttcctgaccaaaataatatatcaaaaatgacaacatatacaattaataaacatcaaattaataattactagctgataacagtaaatatacatgatgctgccagttactaataaaatattatttagcaagctctgctatcatacttaggctgcgtttggttgcaggggttcccaacccctctccctcgtttttcgcgcgcacgcttttcaaactgctaacggtgcattttttgcgaaaagtttttgtacgaaagttgtttaaaaaaatcatattgatccatttttgaaaaaaaattagctaaaacttaattaatcacgcgctaaacgctgcttcattttgcgtgccgggccaaccctcactcctgaacacagccttaatttgctaacagaagttcactaaatagtgagaactacacaaagcaaaagaatggaggtgcaattgctagcacttactgtttagttactaatagtggtttaaggttggagcatgaagagtagatttaatataatatactggattataaatatttacctacctgccacacagctgacaacatctttatgctgccggacgctctgcacaattcttccatcaccaagggaaatgatctgaaaactattctcccaattaccacacagaattaaataattatcaccatgaatttgaactgctgttaggcattgccttccaaaatcaacgttttcggccagggaagtgctaattttacggggagaaattacatcagagccaattccaaagaaaggttcctacaagaatgctaccaattaatcaataagaggtcgatgacatctaagaagttctgccatcanatcttnggggggggggtgtcggcgctgacaataaaaaaagatttccttttacctcaacagcaggcttgccgcgctgtttataaccaaatatgaggtcaatccagtgatggagattagagcttacatattcactttcaagagcttcgcggttgatatgaatgaattcttctggacaaccctacacaaaagtattgcatactgatatattaccatatgagttataacttttcagctacagatcttagacaatgtattattgaacattttaactgaattgcattagtaaatactacattataaaatatttcttaggactatacttctattacttttacagatacatcaggttaaaatccttgtgctcgaagtttccacttgaatacaatgaaaggtattccccgcaacacacacacacaaagagagagagagagtacaacgagagttaaaaaccagctgatgtaattacgttatgaattgtgataagcataaaatctaccatgatacaatgttatttgaagcaaatggaacacgtttctgaccaaaatttttataactgaagtacaaaaaatttcaaaactatatgaagaccacaggatgcaactcaacagggacataaaccattcttatggatcaaccgtatgctagcagattatgaataaaaactataccggtgctcaatacaggatttttttctgttcctcacccaagaaaaactaataaatatcatgatttaatacatgagcatggatgcttagtacaatcatatgtggaaacagttcgttacctttgcccatggagggagaccaacattgcctaaaggttcaccatcctgctttacaccaaggtgataggaatttgaattttcaagaaactcgggcatataaaagaactcaggtataagctctttgacatcacttgtatttgataagcagttcctatatgtactttcaatgctctgaaaaagacgatctgcgtgatcaaactttccaccctgtacaaacatgtaaaacaacttttaagataacataattttcaagcttgtagaaagacttagaacaaagtaaaaacagtgcaatgtgccaatatatagtgctgagatcgggccagcaaataaagtaaagaaaaacctgcagattgcggtgcagagcagtaaaaggctcaagcctaagaaggtaataaagaacgattcccatgctagagtagtgagatccataataaaaactgcagaaagaaaagagacataagtttgttataaagaaggacgcaagaaaatgtacagtgtatgtttgatcaaagatcaaaccttggtatatcaggatcacagaaattaagatatctttcttcaaaaacctgcatattgaacatcatttattgaacactatcagagggaatgacaataggaagtcacagcaacccatagctcctcatcataccttaaagcgtttggcatccaaggcaccaacgggttttgacaggtcacggaaactggatgacttgttgaaatcaattttctctgacgaatagtcagacaatatccaagggaatataggatattgagttaagtcattgtaagatcgtccagcaagagtgttgagaatcattagatactcaaaattgctcatttctcttcttctccaactttccctagcactctcagccatttcaagggcaacctttctgtcaacaaaagaaataacactgtttttgtctttagtacttcctttggggaacaaagcatcatttctcagggacactaagagagacccaatgtttttagcatcattttgggaggaaaaattaagaaacacaagtgcattggcatcatcaaagaatatctccgttgcagtatattgtagtaggtaccgtgtccaatgaactgcttttatctggcaaacaaggacaaccgggaattaaatttggagtgacacatatcatgtgcttgtggatggttgtgctggtgcatgtgagagtaaatgatagaggacgtaccctgcttattttccaccttctatggtgtttgatgttgtttgatgtatttttcatcagagcatcaccagattcagttgcattgcctcgtcctccgtcaagactacccttcagtttttctgcaccccccaggtcgttcttggggtcagaatctttttcttgatatctgttgaaaacagatgttcctccagtgccctcaaccaaaaattcaaaagaaaaatgcagggctttttgtgtaatagtcaattgtccagcgagttttctctttggggttacaagaacacattgaactgatgacagaatctgggaaaatgagaaaataaggatcccagggaagaagctattaaaaacggtatgtcaattttgcatatacaaaattacagataaagcctacttactgcagcatagtcgtcatctccaccagtagacactggttctttcctattttgaacactagtagaataacctgaagaatctgcagcatcacttgagccctgggtctcagacagggtattctgggaaggctcactcatgtcattgttatcctcgcaaggttcagaactaacatcccctgtaattccacgaactcctttcagaagtaagtgcttcattttttctggaattttggcactaacagaggggttgacagacgaggcattgctttcattactaaatttggatggtggctgacaaaggcgttcatcaaacttatagttacgcttgagtttcagtcgtcgccgccatttatcttctgtcttgtcaagtttccagtacgtcacagtactatttggaaatgggttagcagaccatggtcctctttcctcactcaaagcacgaaaaatatgtatccatttgtcctgatatgcaacataggtcacttcagatgcactgaaaatatatatgtttggtaaaaaaaactctaacagcttactgcaattatttgctgatcctcatcaaatgcaagctggagagctgcttttctactgtcgtccacagaaatggcagcagacttagcaaactgtatgtcatcctcaaagctttgcagttgttctatatcttcaattaagctctcatcaattttggaatgaagttcctggagctgcctcaggcgatcagcctttgcatccttcatgtatttgacctcatcagcagcctgaaaagcaccaaacatattgttcagccgtagtgtcttttgtgcactgttcacaaaacagacccaaaaaataatagccttcagggttcagtagcaaaattttactcctggtaaaataaagaaaagaaatgtggggcacattcaagaatctgtgatatagtaacaatataagaaccatattgtaaacgttttcgaatttttgggaaagcacaaaaggtttgtaatgaaaaacattgacagatacaaaccgcagcaagaacccggtccttctgaacaaaattaagaacataaccagaatccttaagaacataaccagaatccttattgctatttacttcagtggaatcatctcttgccaacatattagtggcaagcagagacttcccttgtacgagaatttcaaaaatcaatggcgacataatatgagaacgggcaccatcatcaagccccccatactgggatctccccctaagtaaagacctgcagaaagaaaagaaaattactaaaacagccaattcacaaacaatgagcaaagtttgcataagtatagccataccaaattaataaatgcagtctatttttgcactgatcatcttctgaaataagattaggaagcaccaatgtgaattgcttaacatacttggataagttttccaagccagctttgcacagatacaaaattataagatggaagatgattcttgggaatctctcgcctcttaacatcatagctttgtcagcattcttgttcgcctttccacttagtgcagaaccaattcctccagttaccactacagcagccatctccgcggccgggatattcagtgattctaccagcccacgtgcccgttgtccaatagatgggacagcagcatttgaaccctttggagtcaatctattttgtcctctgccattcaaattgcaaataagagtccatatcttgtcgtaaaagctccaccaatcatcactcagtttatctccatcagtatatgtactattactccaaggaaagctgcaaaagtgcatatttacatatttgttgatggtaaatacaaattgctcagtaagttataatcttgcatataaccaaaggcaagcaggaaaatataagaaaatagaggctatcatggatgaagacaagctgcttaaactaatactaacatatctgactccaaacggaaacaaaaccaaacaaacttgagaaaagaagttggtgtcaaataatcggtattgaattatctaactaccaacaatatctttccatcagaaagaatactagaatacttaataatgtcaagtgaattagaacacattcctctctcacgcgtattctctctgagcctgggctttctttatgtgcccgtgttacagttggtatgtggcaatatttactgcaggagttactactatattaaccaactcaattacaaaataaaggagctatgacaacagataagacattgttggtatcgcgattaagtttcacacacaattagcatagtacctatgcatcataatggatgacaacaaaccttacctaaaataaaattagtaagttcctaaaatctaaaaattgtacacatggtcacataagatcaattaaccacctaagtatgcacatgtgaagacaatgccattgtccttaaaagaaaatctagcagacaacacacaaatgtctatgtccataaaatcaagaaggtcctaggtgtggtggggtgggtgtatagaactttactagaagtataggcaattctagcacctttaaatattcagaagagttcagtcatgagatgtattaccttgtaagttggccgctaccctcagcatttagtatttcaacaacagaggtgttaatgtcctctattagagagtcatcagatgaagattgtgcagataagccaggtgaaggaaactgttacaaaagagcagaatgagtgaaggcatacataaataaaccatatcttttcttgcttggcacattattcagatcattagcataccaatagtttaattccgatttgatcaacaaacaattcatggataagcttcagaagatacaatatattatcacggcaaggttgcaaaaaaagattttcttcagaagatgtctcaagcaagcttcccacaatgtcttcaaagatgtctcgtatcagacaggaattcggcaactgaccctgtattttggacaatctccataatcacactagggtgggaaaagggcactaaattattaacttgttacagcataaacaaggagattagctttctgacctgctcgattttcaagagaaggaaatttgttgtatcttccagctgatgccagccacctttcatagagcacaagcagtaggtgaggaccaatgaatacatgttcctcacaaggattaactcattggtttcataagtattatcctcagcttctgaacttgatttgtagtccctaaatacatcaagtttcacagatgtctcaagccaagagctccaaccgtactcctgacaaaatcattttattatgaatagataactagtttgtgtagacataagaaaaacggtaactagtaaataccacaagggcttcaacattagaagggtttgaatccagcaaatcaagaagatcactcaagatcttagtccgtgctaacgtgtcttgacaagattgcatatatttaaatatacagaccaaaatctgaggaacagcaaatggagacaagctcgctgaagagatggcactatcttttgacacttcagattgggaacgtttctgtaagacctgaatagaaaatatgatgcaagcatcagatgatccattaatcagttttggttagtatcaagaagcctgatataagaggataaatataagagtactaaatttataaacatgaagttcagcaagttacctgcttaggactggccccaccaagaaggacatcaaagagagtagcacgtaaatgatccgaaagtggaaatttgaaaagtctttcagatattgaatagaagaacagttgaggtgctgctgtcatgcctttccttagattttcagaaatagatctaggccgtcctacaggaaggccaaaaaattttggtccttttttctcagaaggaactccaaccagaagttctccaagaaactgaagtcccaagaggcgaattggctcgaactccctgaaaagcaagtgatttcatacataaatatttttacaaatctaataagaacagaaatactccactctgcatttcagaccgcgactaatatgcacaaacgaagaatgtgagcaaatgaaaacaaaatatggtccagtagacataactcaaatctttcgaaacaattagtcagcgaaattgggacaggtttctatttcaaacagaaaagtgcaaaatgcataacaatggtattacgtgtgataccttactgataagaacaaatagaggacaaaggcaaacatccatagagcagtacaggtgcaatttgatataagaaagtaactatacagtttacaccgtacgtagtataactcaggaaaatactcaaataggaacatggggtcatcttgacctgacccataggcccatgttcatttccatacaatagtctcaaatggaacatcaatttatacccatttcttctttataaaacaaaatatatttgtaacatgcattaaagcccgatggcagcagtgacaacctgacgtgtaaataactgaaagtgcattacctcttaagaagattaatgaagatgtaacagccaccaaggggattcactttctccaagaaagatgataggagtgaattatgtgatagagcacgaataatcatgtgaagtacatcttcaatacatgcaacatcttgacttctctcgaaaaaggacacaagtgtcgttatatcatgttgagaaacctttagcctgcaatagatgattgttgcattacaattaaacaagaaaaagatgagtaaaattgatagcatatgaaacacaagcaaaatactccttgaaaatgaaagcatctatgaatcaacagttggaagtgcttactttatactcatttctgccagactcaataggagcagacggatcttgcgaatttcttctatgtttggcctctctgcaatcacttttttggtaacaggatgcagagaagtcttagaagaccttaaatcagtcttttctgaataaaactggagtacaatgtcaatgatccttgggagcccacacaacattggcaaacatttcccatcgcattcaaaatattgtattagaagcaaataaagttctctctgcacttcatagcttgcatacgcccaaatatgtgggttcagataaatttgtgaaagagcatctttcaatagaacgtctgacatacctgaaaaggcagaaagttagtaatctatactttctaaacatgcagaaagacagatagaaagacagatagctcaccacagttcttcaaaacattaagcatgtacttcaacgacgaaagagtcttaaaatttagcagctgtggtgaaacagattgaaacaagaaccctaatatagagaatccagaaagaagatgcatttgttgctgatttgctacatttccatccaaaacagatgcaacaagctcaacaacttgacctgccaattcatcaccaatggcaggttctctactatgaattacagcatcgtcaaagtggatcagaagagggaaaaatacagagacaccaccaacacaataaattatttcctgcagcaagcgccgggagcataactttgtcccacccatgatagttgcctcaaacttactcttgtcaagaccatcaagtgcagcagatacattgaacaaagttctattgttactagcctggacagaaaaggacaagatattcatttatcttgttcaagaaactaactgaaaaaaaaaacaacactatgcttagagaccaatgtaaacctgtgcattcaagccaaaaatcatcttggatgaaatgccatcctttccatccagaatacccttgtacagagtgtcaacgttcataagcaagttttgatcaccaaggaaagagtacatgtaacttggtcctagattatatatgccttttatttgttccgaagaaagagcatcagaaaatgcatagactgggcccatttgaccaacaaaggcagaagtgctctcaaaaccaagggaagtaggttcttcaccaatgggcatcaaatctgtgccaatactgcagcgagtcattacttcattaacttttgcccacctaaaagcagaaaacgattcaacaaactgtaatcaggaaatcatagagaaaaactaaaacacatggaattaaatcctaatcaaaatatgagttcataagatacccagcgtgcttttttgcaattaagtcatgtttacagataagattcatttgttaggaaaagagaaatgatatttcttgttggagttggtcggtcagagatttgttaggagtcactggctgagatcctacaggtagtctacaatgttactaagttgtagactatcaagttgagtcttgaagacctaatcaggccatgattaattgatttccaagtacaactactcttatatggatggactctcaactttggatgggccaccgtcactaaactctaatggttcatatgctttatgtcccgctccttgtttcattctgtataagatgtatgtgtttggttttgtttgaaattgaaaacattgcatggcatgttcaaacactttttagtcatggttggttgaaacttgagagaagtcgacagatctgttaatttggcaactcaacattatgactcaatcacaatggtgatatatggctttttctttgaaggcaaacaaggaatgggatcaattccctcatccctctcttctctgaatctctcatccttagtcctccaatatctcttaggaatggagcctaagctgcatggggaaaaactggcaaaatgaagtgcaggctcctctcggctattacttcatccataggccgtaactttttttttttgacgattaaacagcaggagaggctcctactgcgctatattaaaaaaaaaagggggaaagtatgtacaaggagagcatatacaaaggaaagagagcaagaaaaagaaacaaaataaaattccaaatcctccaaattagataaggctttcagaaaactgaacaaggaattgaatagtatcggaaatcctgtagcatgattaaaagtttgaaatagaaaattctgacgaatcacatccggtataccaaacaaatgaagaatctactcacctgcatttttgattagatatctggccaccatcaacatagcatctcagctggcttccagtagagaatgctctccctactgaatgagtaacagaaaggaatatccattgctttgttgggaggcttagaggcgacaaaacacactgatgtttttgactgatagactgcatagggtaaggatagggaggtcaaattaacatatattacttccgtcccaaaataagttcatttttcacccgccacacacataccaatacaaaagcaaaaggatagaatacccctactttataaaatcccaatacaactatccatcactttacccaatacaattattccctacttttacaaacttcgatgcaatgattactctaaaaatgaacttagtttgggacaaatggaagaagctaaaaatgaacttaatatgggacggaggaagtagaaaccaaaatcgaacaaaaaaaatgataaatgaaatcaagtgctgcatccagttcatggcatgtaagcatagctgtgtaaaacgggaacttattaaaaaaagactacaaaattctaattgtctttctattgtccactaaataatgattatcgacagcacatcacctaataataagagcagagcacctaacagtaagggcaaacaggaacgcatggccataatctaataagtttaagaatggtttaacttcaagcattagctgcaagacattgtaagatattaatcagtgaaacttgggacatttcatcaaattgtttgcaattcttaacaaaatttcacatggaaatgtaagtcagtcagtatgttgcattcccaaaattatgttgctagcttcgctagtgccaaataaccatcttgacaaattaatcttttaatcatttgtgctataattttctcattcggttaggtagtacatactccctctgtcccgaaaaaaacgaatctaggattggatgtgacatattctaggataacgaatctggacagagatatgtccagattcgtagtactaggatgtgtcacatccagtactaggttggttttttatgagacggagagagtagtagtcaatgaaaaagaatatttaatgacttgtaagtgttcttttttctgaaaattactaaaatgagctgatggctccaaccaccattacctcaaatattagagcatctttcccaagcatagccaaacatccttttccactttccgtgaaaaaggagaaaagccccatcatgctattctcaaggaaactttccacccttaaccagcagcaaaaggataagcccttattgtaaggccattgaacaggtgattttatttcaatgccctggtaaatggaaaaacaagtaggatatcagataatcaccagataaacatttcctaatggaggaaacaatagaggtacttgtcctgcagagtctatttgagacaatgagaacgactagtgtaaccttgttcctaaaaaaacttgcaacaaaatggaaaatagagaaatgaaatgaaaaacagatcatttaaagagttacaaactcaaaaattatgcccagtcaaaaaaaaatgaaaatagtactaaacatgaaaataaaaactcacagagtcatgaccactaaattcaaagaaagcttcaggtcccttttccttgagcatgtgactaagacttgtcaaaagcaatgaattacgcttctgcttgacaccaatcttctcatcacgcaggagggcaaacatttttcgtatatctttcccgcaaatactgtgcccaccaataatctgaatcaactcggcaatttttatgacagtatcatcagtttcctctactgaaaaccaatcaagaagaaaactaagaaatcctgctttgaaacaagaacttctatttgtaatggatcccttgagcaactgttgtaggaccacaagcccataatgctggagtgcagtgctgctctgccaattagaaatcgccaatgttgcgtatcaccaaaacatggatgtccaaccacaaatatgtgcacacatcacagggagtgcgaccaagagagagacgtaccttttgtaaaacatttaaaaatagtatgatcacatcttcattctgagagaaaaaaaagaaaggttacatcagataacagaaccaaatagaaatgtgggtacaatagagtgaatcacttgattaagcaagaatagcattgcttcaaagatcatgaagattacttgcctttattgtggtttcttcgtttttatcaaatgtcccatcaacaagcatgccaagtatggcatccaagagtttctgactaggtaaccatttacagaagtccaacagcaagctttgcagtgtttgataacccacgccaaccagcattctaaaggaagcctggataagaaaagacagagttttagatgcacataaaaaaaagatgatcagaggagaaacgaatataaagtccaaataatgcttgccagaaatccaggtgacagacaggacggcaaatccagaaacaaatgatactttggttctatattttcgcaatgaaaagagcatacaactactggaaaacaattctgatatttaacttgctagatgctctggtttcacaagaatatgcaggttccacaacaaatgtgaccttggagattgagttgaaaaccctaaacgggagtgaacaaagaaacagcagtactaatggttacatctcgaaatgactcaaaaccaatactggcagcagtctaatggttccaaaaaaattttctcagacacggaggagagctgcctatcattatattaagaagaagaaaggagagggtaataacccttacaacacacacataaaccttacatgagacaaaaagaccaaaacacacacataaaccttaatggttccaaaatagtacaaaatgtaaaagtgtagagaaatatttgattacctttgacacatcattttcagcaagtaatacagtcaacgtctgaaggacattaaggactaattgttcaccaactgcttcatcaaaagtcccattcagtaaggatacaatatgcaggaagcactccccattgcggaacagattttgataatactagaaaaaggtatgagtgaaaagatgcatttgtcagggatgatgtgatattaatgaaaaggacaaaagaacattatttaatgggaataatcccatcttacaaaaagaataccatgcgatctatcataatgatctctctcatgttaactaatagatcaatagacaattctgcgaagtcctccttttcttttgcacgagtgaaagcctccaaatattttgaacatagctgcaactttgctgtatgatcttgtgctgatgctgaaggtaactgattgtgagaaaaggagatagttttagttccaaagaaatcatatcacaagcaacagaaggagagacaaggagcacggcaataccctaaataagtcaagaacttgctccaatacattttttcggaggttttcttcttggaataaatcaaataaacactcaatacaattggcattatgtaaaactagaatctttccaagctcagatattgtggtgtattccttgaaaagattgaaagccaattccacacatgcaatagtacttttaatcttctcatctgaagaagacatctgaacattttctgattgaaaaacatttccacttaagccatctccgggatgggaaagcttccttagatgttgtgcttgaagacatgcaaccttcaggactctggtaagcgcgtccaatgatttaaaggaggatatagtctgttcagtggcaagttgcaggataacatgaaaactcttaagaatagttccagctaatccaggatcataagtgcaacgttcaagcacatctaataacgctgagcactctggctacaaacaaaagtaaattattttaataaggtgaataaaaatagaatggcaaaattcaaattatgaacaatgcgcaacatcttaggtgacgcagcagaaatttaggataccagattgtttgtgttctcatttattgttgcggcaaactccaagaaggaaatagcttctgcttgaagaatgttgacatcagcttgattaaggcctttagaaccagctgattcagtagcatcaataaaatgattgttttgtgtgtcacaaacaatatgatgaatatactccatagatgatccaaagtaaaaaaatttatctgaaaatatcagactccataaaccctcagcgcgaaaagatttgagcagagctggtactgaaatgagaaccttcctgaatgtgcaaagaatataatgctgtagggtatttgccaaaatcctggagaatttagtcaatacaaacaaaaaaagtcagcaaaagaaatttagaaatgaatgatggcattaaaatacataaacatgcaattacttgaaaaaaattacaaaacatgatacttccacacacagattcattgcactcatgaaacaagacggtagccttgcaatcatcaaattaacaaattgtacatgattagatagatattaggatcaacaccattttagacaattgttcacatgttgtatctagcagaatattttaattatcatccattgagttttgcagtactggctatacatcggaaagactaatatattatatgaagtcccctgtaccatctagatattcaggaaacattgaaagcaaagtccacaatcaattcatctagtctaatcaagaaagatggacagcaacattaaggaaatgagaacctaccttatatggttgggcaattcagattcactagcacaagctttgatgcatggaaaaactgttgaaagaacctttataatccatcttgcacattgctcacagtatgccactgagatggacagagaaacttggctatcaactgcaccagaagagttccttatctcgttaggaggaagaagaaaagaacaaagtgctatgctcagctttacagaatactcagtccattcagttgtatcaagaatatcaataggacttgcaaaagattctgatgtaagcgatatcccagtgctttcttcaagcttacagttctgcactcgagagtcaagtgccttttgttgatgaaacccctgaagcataaatgcaggccaacagatgctgtttgcaaacttatgtatccgtccattttcacataagaactgtaaattgttgacattaccaaaactgaataggaagtcaaggatccatagagccaaactatgcaatagcatatggagtctaacttaaacagactattaaattctggataagtaggtattagtgatatattcatttatttgcagccagaatattcaaggtgcaagagtatatcatcgctccaagaagacagaatccagaaaaaaatgtccagtcatgtatataggtgtgttatagacatgaaacagttaaagtccacctgtaacaactagtttgtacttaatatattgttaataaattatgaaagctaaaaatattttttatggtttcagaatacatcgtatattcaattaatgttcagaggtatttctagtcttttttagaaaaaatggatactgcaagaatccagaaataagacgtttcattgactgagagtaacaaaggtgtacaggaaaattcatgcattctcttactaaaaaatatatgtgcatcaggatacactgcctccctcagaatttccagcgataatatctggagctgtagaattccactcctgtgtaagacatgttatggtcaaatcacacaaattatatatagaaagcacacaaacctcctgcattcctgcacctaaggtttagtattgccacagttgaagcacttacctttcatcactggggacaaaagaatactttgagactgacaatttgcttgatggtaatcccagtccatctaatagaacctccagtcctccaatgcttctgaaatgattctgtgcacgtgcatgttgagagattgttgatctcagagcatgcaaagttataaagtgaagtagcacgtcagtccactgctctttcaaattcaatcttcggatgacccttaagagttctgcaagaacaattccagatcagtaagataataacagtgcaaaacatgaactaaccaatttaacatcataaatcctgaagaattaattgtgttatttttctccttttgcaataccacaggatgcataaagaactaaactatatctagacaagtacaattttggagaatgctatgacaatccatgtcttatgtttcttaggctgtgttctttccccctctttcccaactcacctctctcattttccacgcacacgcttcccaaactactagacgatatgttttttgtaaaagtttttatagaaaagtttctttaaaaaatcatatcgatccattttttaaaaatattagcaaagttataaagtgcttcaacactccaaaagctttggtgtctcgcatgggcttctgcactccaaaagcttctcagtggatcagcaaactcgggcagctagcacttcccagtgtgggctgggttgtgtgcgtgtgtgtctcggtgggagggccttggtctctcctttgttttcttctccttaatgaaatgaaacgcagttctcttgcgttttcgagaaaaaaaaattagctaatactacctccgtcccaaaatgtagctaatttctacagtaacttgtcccaaaatgaagctatttctccacctaccctctcctctcaaccaatcacaaccatgctcttcaccaactttctcttctccaccaatcacaacccttctccaatcatctctacctactttcttaatatccgtgtctaccaatgcttacattctgggacagaggaagtactcaattaaccatgcgctaatgagtcgctccattttgcgtgcatgggagattagctcccaacaccatctaaagaacacagccttagtggagggagcataaatccaacacaggaatgatacaaaataaaatgtgttttgtctcatcaccctgaatcgtgcaaaacatttttattgccatcatgaaaattcagttactgaaagttttgctctatttaaaaaatagcaaggtagcatgaataaatataactatatatgtggagtatttactaagcatttgactccataaatgaaagtaaatataactatatatgtggagtatttactaagcatttgactccataaattatatttcattcatttgatttgagactgcgcaaaaataatttactgcagcaaagattatgcagcgtaatcatctagcttcagcatacttgttccatttcttattactggcactcttaaccaaatcatgcacactaacttagaaaggaagcaatggtttgaaggttggaccaaaataataccataagcacaaacagtatgtataaaatgtaaagtagaagatggtggatgaagtttgcaagtgtaaatttggaataacatctcaggacttttaaaggtccaagtagttggggataatatattggtaaaaatgcagagctgtttctctacattcagtgctggaccacaagctagcaagattccttccaaaaacacatcacactaatgcatcagcaaggtttacgccctctcttatcacccttttggccccaaattacattgagcatgccaggatcattcatctcatgtcgtaatctcttccactctttggtttcagaccagaacatacaggtcattgtcaacttgtctctgaatctagaaccaaactatttgtgtaaactggagttatggagtatggatcatgcttactataagagtttatcaataagctagttagcattacagattaagttcaattgtcctaagcaagtgtcaaaaaagaacaatgttatcagatgtatacaaacattgagaaaacaatcctacctactaaccaattgacgcctccagcttccataactgcaacaatggccttttgctgccagttggtatcatgaacagcgctttttgcagatattggagtaactgtggccaaaaactcatttgatagggttttcccagtagtattgacaaattgcgttaacctagtagcagttggctccaagttcatgaagtttgaaattattgtaacaatgtgtacaagtatcttttgcatcatcttcatgttatctatggctttgtttgacagctgttcatctgcggcaagcaaactggtcaaagtcttgagctttacaactgcagctgaatacacaagagaaaaaacgtcagttaagaatagattcatcacaaaagaaaccataccagtattaccacggacatcacaacctaagctacaacagtgaaaatggtatgaaacaaaaaaggggaaatgagcgaaattacttctagaaaggtaaaacactactaaagaaagtattgtacctttcagaagagcagtgaccttctgcacacctccataataactaaatactctacagttatgcactgagcgagtaacaatggtcaagcattccaaaatattcaatccctcagagcttaacatcaggtctgacgattgttctgaaatgttaggagaggattccgaacagctgctgcctactaatacgagaaaaacaagtcatatatcaattattgctggctcactctagttgcaatactttacaaccactgaacaaatcaactactatcatgcatagcctgattgctcatttttcctttagcaggtactatgaatctatgatcttgctttccgagaagacatgtaactgattttacatcagtgtaaatttaaaactgtcatagcatttagatatgacttctgcaattttgataagtcaaatctggcaaaagcatgtttcaaatctttcgtatgcaaagcacctcttcaagcagatgtttcgaatctttcagtatgcaaagctgttatgactgacatattaatggcatcttaaaatgatatggaattaatggtggggtgcaaactacaaaagttgtatgctatgatatataaaaagcagaaatgaaaccatgaaaaggagggaatgcatcatcaagaaaggcatcatggtgttcatcagatccacttactctcagtaatgaaagaagttatttgagaaacctcctgcacaagaataaggatgatctcagaaggatgccctctggagcatcctaaaaccgtatcatctgatattggttcttgatcaactgattgctccgtgtattgcggttcccactctttgaatgcttgtacgaaatgcatgataaatatttgcaaggattccttcttttcagcctatggaattgttggcaacagaaatgaggaagcatgatcacaaacttttggggaaaaaagtacagtttatgccataaaaaatactacagaatgaaataatgccatactacagcataaaaatgtgacattgtttccttaaactaagctatatgtagtctaaattagtcgatacattcataatcttggtcatcgtatctcatagacaggagcgttgatgaggaaactagtcaaagtaatcaatcaaatcattcctcaacttcaacaaagccatctcataagtcataagtaaaaagtgtaaaacaaatatctgttattggcatatcatgtcatgcaaaaatcaggaaattatgttgtaatgttaatgcacatgtgcttgatacaagctgtttttgacatcatgatcaaaggaaatagccgaagaaaaggttggtggcaaaccagcatgcaagattactcaccttgtcaatggcattctcatatttctgccaaagcatgtttaagactccttcaacaccactatcactggaagcagatataaacattgttagaacttacaagagaatcagccttagcagattgtcccctaacaactataaaaactgatgttacatttgattaagatgtaatgttaacatgattgacaaataagtatctacagaacttagttgcctatcaacattataaaatcatcatttactcttttttaacaaaaaaaatcagtatattaagtgcaaaaccagggtaatcaactctagtacctaattttggcacagattttgtgtgtctatagtggaatatcacacacgagctacttatactgttcagtgatgtaactatgcgtatgcggactactgaaatggaaaaggataactaaaacaaccaacgtaccaacaacatacctcttatcaattatccgagttaacagttagcgtgcacagttacttaaccaaataagcagcaaaatctaccgcacggaagcaagcttgagaatgcagcattggttcgtactcggtatccagtagagcgcacgcaccaacacattgagctacacaagcaagtcgcattccgcagagcgagcggtttcctgaggatttgagtcggctaggttacctgaagcggaccctgggggacggcgcggcggggagcctgtctggagcggaggaggaggagccaccggcgccggcgccgccgtcgacgacgccgtcgtcgacccctacaaccccgccgccgccgccgccaacccccgacgaggccgccgccgacttgcggaggagatcggcgacgcccttcacgatgttcatcgcccccgatccgaggcggctagcagcagcgcatcaccgcgcggcggcgggcgccccccgcgggggaaggcgacgaggccaccacggggattcgattcgaatccaatccccctctcctcgcgggcggtgacgcaggtggtggggagggggagggggaaggggagatcgcgtgaggaaggggagcaccggaattttggaaatgctcgtggttttcagcgtgtgggaggcgtgagagcgtgagcgcgacgaggagactagggagagggatctagaatttctctgggggagaagtcaatgggaattgcgatgttggtgctggcttttgtgtcctctggtgcgcggagtcctgcagcggcacacataatacgaatactagcgctacgtggtactattacacttagtagaatggatgaaggttcttatggaaattaaccaacttgaatatcaatagcagtggtaaagatgtagtataacagtatatagcatacctgtagcagataatatttcatacaagcggatagtctttttaatagttctttaataaatatagaatattggacaacaattcatgtccgatcgatccatacatgtaataaatataaagttgagagatgatttctagagttttagaaacaaaatgtgagtactcttaacacttctcaggtaacacaatactcaacacatctggtgtaaaaactctccgtagtcatagttgaggacctccgacacactctttgtcttcctggcgagatagaacactgagtaggatatggcggcactcatgaccatgtgactcttgctcttgaagaacctctccgtgcgaacgaaactccgaccatccgctgggttgttgatatggtcaattaccttgaaagtcgccgcaacttcttgtaacccgggaaccagtcccaaagactccactagaacgctctttcccgaagtgttcaacgtcttcttctccccttcaagctttatacctcttctgatcatggatttgataacagagacgtcttgacgaattcttgagatgtttgatgccatcttattctccacatggcgaggacttgccatggtgcccctggtaagaaaacccttatatgaagcaattaattaatattatatgtttaaacggtagttaaatggtgcccctaactatatgtttaaaaagaccttatatgttacataaagccatgaagtattcaagacaaaggagaatatgagactaaaaactttcacaggcaaagcttgaatcagaacacacaagtcatgaagactacaggaggaacaaaagtttattgtatagattgcaaaaaacaatggaatccttaagtttaaatagctgcatttgtattgacatttatgtaatgatttcaagctgactacacggtactttgtagctagcctaacaggtaatacaccctgtagataatacgattgcaaaacatcttttatttatacgatgtgcaattatattctctagcaaggaccctacagatcgagctgttccaaccagaaatgatttgttattctaatagagaagacgagaattagtctactgctacctctttaaaaaaagatcaatcacgtaaaattaatgttactatcattaaacaaactatcataatatgtatttctttttatttaaaatatattatttttatagatattgttggttaaaatagtatttcgaagattatatcgaagatcaaaaaatacttatattttgtaaggggagtattgcattacagatctactccctttgtcttaaaaaaactatttctatatttgaatctggatatgttcagatttaaatgtagaaatgttttttttcttttttttaacggtgggagtacttagcataggagaggtaaacaaacaaaactactgtagtacagtaatacacagagggcggcatcagtgttatttctggattaggcgattagcaccagctttgaagcaaaaaggcaaaaattttaccgcatcaaattaaagcacggtcacacagacctcaccatcagacctccacgacgaagccaaactgattgatatatagaagcttccataaagaaaagaggaaaaaaagcgaaccttctagaatccactagaaggcgatcgaattactacccagcacacaaattggcagtctccgcacgaatacccgcgcgcgcgcacgaaacacaacatgtatatgtaatgagaataaacaggagaaataaccagctaattaaggagaaacatatataaggttgcagcacatcgaatcgtaacgagatcacaccgcttggaacatgatcagaggctcacgaaagtcccaaccttttgaagcgactcccctccaggaaaagcatcccgatcacattccagaaccttctacccgctagctttcacgccatgcgctggtgtcgcaaaatcacagcttaagcccccccaaaaccccaagaacactcccccctacccccaccccaccccaccccaccccacccaaagaaagaaagaaagaaagaaagaaaaccagcaagcacgacatgcaagaagccgaactctggtgtggatccgagctgcggatgagtattttggggcaggtgagggagatcggaggacggaaaccctaacctttgcttcgaactcgaacaaaccaatacggggaagagacgcggcgccgaggcggaatggttggggagggaaggggagaaaacgaaagaaaggtgatgctgaggtgcgcttgctactgcgctgcggtgctcatatgcgagatgcctctgccacttatcgggttaacgggtcgtatatggtaatatccatcaccctcagagtatctgcttgatccccttaaaaagaattctcagttcatatcaatattacatcctttccccgttttaagtgaagttgtgtatttccgtctctaacatttgatcgtttgtcttatttaaaaaaattaaaaaagttagccgcacataaagtatttattattcatattttatcatgtgcaggctcatcctgctaacttggtgtgccgctggcaggacagcagatccacaacacttataattactagaaaataagcacgctcgttggcacgttattttcatagcccgtgtgtagtcttaatgttgaaattttaccgaaccatatcagagtcgatgtgactctaatgttataaaatttgattattaaaggtatagttggtcaaaattagcaccttaaagtaaaaaatgtttttttatcaagataaggagtattattaatggtatattatatttacatgtgttttatgatagtttaaaatatacatttctcaatacctattttttagaaaaaataattttagttcatttgtttgtgttctcaaataattatcacgaactcagtttcatttatcatccattagctatatatgtgttcatagttttctttttttcttcgcaacataaataaatctggtctcttctttgggatataatgcgtgcactaaattattacaatcgcaacatacagttattttcatgccctttctaaaaaaatattacccccatcctaaaataagtgcagccatggatatccgtacctaatgtttgaccatccgtcttatttgaaaattttaaaaatatttagtcatacataaagtactattcatgttttatcatctaatagcaatgaaaatactaataaaaaaattttcaaataagacgaacggtgaaacattgaccgtgaatagtgcaaaactgtacttattttgggacggagggagtatattttcatgcctccccccaacattgaaaaaaaactattatcgtatatataaattttattcgatgttcttcaacaattgtacatatataagttaaattttcaatgagcagctcacataagctagcttaatagctacgatacgttgtactcccttcgtttaaatatttggcgccgttgactttttaaaatatgtttaaccgttcatcttattaaaaacttttgtgaaatatataaaactatatgtatacataaaagtatatttaacaatgaatcaaatgataggaaaacaaattaataattacttaaatttttttaataatacgaacggtactctgttaatggacggtactcagttctgtccatcagaattaatcttttgagtaactctgtttcaaaaagatgacgcacaccgtgagcaaccacaaccaggcacttatccatcattaggactgtttttttcgaacgattctccccagaaacaacgcaaagtatagagcatgaaaaaaaattacaactctgggagatcgtaaacaggaaaagaagaaaaaatagcaccgcccacacaccgatagctctagcttacaaacccgggagaaggctagcatcgtaccgaccgctgctaagccaacaaaggaattcaagtgagatcgtctaaaatccaatcctaacaactgacaccaaactctactctagccacatcttcgagattgagggagagagtgagagagaagaatggaatggctctccacccaggccctctgacgtggccatcttgcataagctacggcgccgacacaagaggacataagtctaaagtgagcttgcaccggttgtttgtgaggttttgataaagggcctaccaagatgacgtctctagggagaggagcgaaagaagcaccgccgccgccgttcgtcaaggtctcaaagagaaacgagactgggttttcaccctacacccgctagaagagatgggacgacacgacaacaccctaaagaggagaagtgacacccgaaaagccgtcgttgccggcctaaccaaaacggtgctaggttttcacccgtcgcccaccgcctgcctatccatagcagatacacctttgctccatcatcgtctaaacctctgtcggcgtccctcgcatgccaccacatgggcaccctcatcgtgcgctccacgccgactgctccacgccggcctccagcatgtcgcgttgcgccagcttaccgccaccgccagctatgtgttctcatgttgtgtcggcctcacgccacctccacgcagcactcgccggccacgagcctccaccaagcgctgatggcgccatcactgccagccgccggcaccgcccttccactgacgtcggtgtcgtccatgcacagtagcctgctccaccacacccccattgccggccgccagcgtcaccgcgctggcctcccgccgtgtcgctccgctccgtccactagctcttgccgcaccacacgtcgtcgccgcccacgccggctgctccccgcccagatccgtagggtgttgggtctggctacgctgcctaggaggggggatccggtcggggcagtgccggatccactgccccataccggagaagccgccacctcccacccgacgcgctctgctccgcctcccacatcaaggaggagcttcgccggctcggtttcccttgccaccaccttctcagtcgggctcgcggtttctagcggcagcaaggcgtcgagataggtggagagggtggcggcgcgagcagctaggatttcatccccaagctacccgcatgagagtgacgaggggtttgttagattgatatttttaggacactgcgaaccttgaacaggcaccacatggcaattcttttacccactccctgagaacgcaaaaagctcacctagaaaacacagatacagtacagatgttcgctattaccaaagatcgttactaattttgacacgaggaatcttgggggataaaatctatataccctaactctcttctcaagcatataaacgatttcaagtatatcggctttgattcaccaataaattctcgctgctttatatataaaatgtatttggtacatcataagtttgacgtagatagataaaagagttgaggtaattggttcaaagtaacacaaagataaaattattggattcaaaatgagtccaaagcgaaacaccgataataaaagatagccaaaagtaaaactttataaattttaaattctgtaaaatacttattcatatcatggttgcgtattttcactcttgctgcaacgatctttgcttgcaagggaaaagagacagcaaatgcgcctctgcctcgattcgatcgtatgcctgtttgccaagaggacgtcaaggcggggtgttgacgggatggaacaacgaactagcattgccaacgtacgaagaaacaagtccagctgtcatttcaatggctgaaccaggtgctcgtaataaccaaatgctgataagctgatgtcctgatgggttagtaacaattagtctttttttttttgctcggtgttctaaaaaaacaatcattcacgattaggacaaattattaaaaaaatcgcacgagttatactacctatgtggccctgttaagaaatataaggcgcagtttgactatttagttttaagctttgatcaataatttgtataacaatatttaggttttgttggattattcatgttcgaaagtactttctactccctccgtttcacgatgtaagtcattctagtatatctagattcattaatatcaatataaatgtgaaaaatagatgtgaaaaatagagaatgacttacattgtgaaacggagaaattatataactaagaattcgtaactgtaagagaaatttgtttttggcagtcaaatacgccttatatttctgggcggaggtaaggagatcagtacttatttacgtgcacgcctaattaagcaaactgcttagcggttaagttggggcaatatgtgcccgttaggggagtgaacccgttggtgcaacacgtacgtgcattgccgttttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgatcttcttgcagtagcactcgaatcaacggtaattcaaccgtc

SEQ ID NO: 49214 - DNA, 1133 bp, Oryza sativa
  unsure (1)..(1133): unsure at all n locations
taaccttttaataccgtcattatatattgctgggtgaaccaggtaaataacataagcggccagttactaataaatattatttagcaagctctgctatcatacttaggctgcgtttggttgcaggggttcccaacccctcttcctcgtttttcgcgcgcacgcttttcaaactgctaacggtgcattttttgcgaaaagtttttgtacgaaagttgtttaaaaaaatcatattgatccatttttgaaaaaaaattagctaaaacttaattaatcacgcgctaaacgctgcttcattttgcgtgccgggccaaccctcactcctgaacacagccttaatttgctaacagaagttcactaaatagtgagaactacacaaagcaaaagaatggaggtgcaattgctagcacttactgtttagttactaatagtggtttaaggttggagcatgaagagtagatttaatataatatactggattataaatatttacctacctgccacacagctgacaacatctttatgctgccggacgctctgcacaattcttccatcaccaagggaaatgatctgaaaactattctcccaattaccacacagaattaaataattatcaccatgaatttgaactgctgttaggcattgccttccaaaatcaacgttttcggccagggaagtgctaattttacggggagaaattacatcagagccaattccaaagaaaggttcctacaagaataaaacaaattaatgaataaaaactaaatgttatcaaaaaagtactgctatctttgattgtcattaggaagataccagtgatccagaaaacgtgaagtttccaccagactgcaattgtgtagttagccaaagctttactgacagtacaagtccttcgttcatcacaacaatgtttgagtccaacaagctaacaaacaatacaggtgatgaggagctactagagctagggacaacagaagtcactgttatcgattgtggggcaaaatatagtgggtgagcaattggtataggggggcctcttcttgggtgtttcttccggaaaatttgaataggtgtttgtccaaaatttgcaatttggtnnnnnnnnnnnnnnnnnnnnnnnnnnnnnnnnnnnnnnn

SEQ ID NO: 49215 - DNA, 40169 bp, Oryza sativa
  unsure (1)..(40169): unsure at all n locations
ccgcgtgggnnnnnnnnnnnnnnnnnnnnnnnnnnnnnnnncataaaaatgtgatttcttactgcagattctagctattcacgatctcctagcaggaagaggtacatatttcatttcatcatatgagcatgatcttttgaagttaaattctaaatatgctgtgagtgcatgttaaagccctgatcaaagttcaatttatggtgtctttgcttatctttatcatcgatttattagtatattgccttgtcgtgtttctattggtcttgcattttagtttttcatcattgttaatcaccatttgatatgcttgagttaagatccacacaagctacaattttagttctgtagttttatattaatggtgctgtaaactatcatcaacatatttgttccattataatgctaaaattatcttgctcagaatggtaaggttttgtattcttcctgcagattgtacctggtgatacttactatctatcactcaaattatttgttttgttttcatagtcataagcatgttttcctaaaggtcatgcaagcacttgtataagctgtattttgcgatcaaagtagaacttgatatttgaacactggcatttccgttggaattgtggttgggtttactagatttattctagatgccttgaacatgttgagtcgtgctgaactggtaatttacttttccacaatctatcctttatttccagtgagaggaggcatgaaaagaagactgacgatggagaaaccaactcatctaggagtttaagtctctctgataacaacgatgaaaagaaaaaggacaaattctcaagtggtgatgagaaagaagaccacgaaaagcaggtatgagaaaaatgtaatcaaattcatggcttatacaagcacatttggcacaatcttcattgcataattatgaatattgtgcagctgaaacaaatacggctggatatggaggctttgcgtgacgataaaactcagatggaggtcagtttctatttgtctcgctatatttgttacaatatggcacatgctaccatgttaacattttgactgccactttttattcactcataaaaaggagttggtggttgtgatgataggttccaccatcccatgccattttaaaagatcttttgtggatgaatctaccttagtgtgtgtgtgtgaattgtaggatcttttgtaaaggattacatcttctgcacatgtagacatgcataagatgatcgattgacgcaagtcatatattctattttaaatttgttactaatttgtcatatgtagacatgtatttttataaaaaagttcaaaactaatggcttatttatctgtggtatgctgcaatgaatgagcttatgagcactatgctagtaatgtgtaaattgagaaatggtaatgcatggatttcatcaagtgttcaaagcgtaggtgacttttcactagtccagtactgctgtgccaactatcaactaatagtgtttgcatgtagaacttagtatgtgggtattgtttatcatctttaatttcagacatattctccattctgttcatgtttggcacagagattgcacatcttccaatcatttaatagtagtcatgcttgacgaattggttggcagtgcgtctttccatgaataaccccaagagtaccctctagtcttgtgtccactttggaccttcattgacttattgtacttgagtttatttatttttgtcttcctgtcatgttatattttccgactgagctttggagcgggtcagcactcagcaggcacattattatatggtgcttgcgctcttgtttcaaatgctttctattttatggctgtgctaatatttcaaattttcaatggtgctgcaagaatttgatttcacattgtttttagcatctcgtgaacacagtacttgctaactactactttagaaaagactcctgcttttttttttgtttcatggaatgatattacaaaacatcctacttggccatgtctctcttttagacttttagaaaaagtcaagctcttagaaatgttacataaataaatgtacactaatttataaatggttccttataatttgaaaaaagtttgcattaaagacaccatttaataatattcctacttcatcactgttatgagcatgggccaggccgatgcagcagtttaggcacgataaattaggaataagtcatataatggtaggagattatctagttaggaaagagatgaagtttattatctagttgggattgatttctatgatactatagactatccttggatgtcaagcctgtcctccctatatataaagggaccccatgtactctatcattaatcaatcaatgaatctctaaagttagccctaatcctcagagcctcttttagctgagcagggagaagccttgccgctgctattagtgagcgagtgccctatcactgggtcttcggacccttaccctagctactccataacagtcactacccattgcttgtacttagttccattcacgtctataatgttagatcatgctgaatctttgctccaaactcttaactctagtcaacgcacttacctatttgtaggtcattttggatgagaagatagatgaagtgcgcaagatctctagcaaagttaatgatcttgaggtgcagcttagaagggagaaagatgaatgccataggtacttaagcaatgtttccacatgacaatggcacattatcttgacagtattatccaatagttctatattgtttttctatacctttgtaggatgacctcaaagatgaagaagtttattaaagctcatgctcggtttttgaaggcacaagaagaagtgaaaaggtgctttatgttttcatcatgtttggccttgtaatgctagtacacaccagattactcctttttgcataactatcaatcaataagtgttcaccaattggagttatgcaggtcacaagctcgtttcgagaggcttggtgatttgcttgcttcagatattttgaagcgtggtgctaatgaagaggggtccagtgtcaatgaagacctaaacgaaaggagtcctaatactgcagcaactaaaaagagatcaatcccatactcaacaagtgaagaagcgaaagctggtatgtagcttagtttctcgggacactctgattgccaggttgtgatttgtacaatatggatcttggtgttatgcagcatccaactttccccttctgttaaactgatatatgtacctctttatggagtaaccagtcgatcctagtatgaagtagttcaaatgttcctttatttaatattaagcattaaaattgatgtgcttagttttcttacagtagcactgaaggatgcctagtttcttttataattggattttaattctttctgcaaattgctgaagaagtgtcttaattatgtacttaaacctaattgcttgtctcctcagtgaagaagagaagagagcgagactctgatacaatgactaggtcagataaatataggtcagatgttacagattttgataaaacaagtaaggggactgaggcaaccaagtctttatatttgaagaagaaattatgggaagatgaaaaaagtaagctaggagccaacattttcacagaaaaggtgcaccatttctcccgcccgctctcaattttatgatgaactacatatcatacttagtacactcagtccagtgctttgtttaaacattatcacatattgctagcctatgcatttgattgcactgtatatatctctactagtgtaaaagcagagttgtccttccttcccctcttcccacctaccgcgtacagcgagagagtgaaaaaccgaaaggccaaacttattacttgtctaaacaaaaagcctagttgatatttggaaagttcggtcattgccagaccttgtattgaaactgataggcttccttgatcatcaggtcctaaagcccttcttggctatgttggcatctgtatttatctttgtttgattgtgcttatcacaggcaaatattttgttaacttgcaggtcaaaggttctcccgtcagacatgttttgccctccactggcatggctgctcatgctattgatgatctcaacgaagctattgaactggaggacagacatgaatccatagacgcattactagaaaatgatgctgatgacaaaactagatcacctgctattcccctgcagccaccaccagtggtacagaatgcttatgagcaggtgattaaattttcacctttccaaaaaaaaatattggacctgcttacatgcacggtcagcggcatggaactggacagtgcattttgtttataaaaaatcgttgtactaaaaaagctccttttttttccctgtgcatttgctaatttgctgaaaaagcaaactcataatttgtttcatcttttcccagtatgagggtgatgacgaggaagtcgatgtggaataagtggatggcctcgtttctagacaagaggcctctgatgaagcaatggcgagattagcatcttccccagctccttataattagtactattagcatcttggtgtacaaagtgctatctatttgacattgggaattcagcttatatttatcaagaatccttttgtagtaacatccttggcgctgagacagccttagtcaactatgtggagcagccgtataaatactccatagagtgtctggtttggctaagctaatgacgtatggtatgtgcgctccttctgccctggggattgcgacgccagatgtgtctaccttctttatcgctgcattcagttaagaagaagaaatgccaaagatgaacatttcatggtcatctggctagtcgagctgagcgtgtaaactgggtaaagcaagatatcctgaattgaattcctgatgcctttgtacagcctccccaagacccgaaaaagctagggtttgctgcttgcctggtgctgcggagcgggcatgagcgccagctttctccctcgctgttaagggtgtaataaggggttaatttgtgaacccgcttataaatcaaaatcttctcatggctggtcgtcctcgctctcctgtcgtcggcttctcctccatcgccgatgatcatcactctatcatcagctctatcgtcaattcgtctcctgtgtttcggcctggccagattaacctaagcagaaagagcagtagttttatcagttggttatattgacccaagccagaaatagcagtagttttatcggttggttttataagtcgtaacaatatgtatctcacgacttaaaaaaataatatataaaaatatcatgttggaaatatcctaaaattaactttataatttaaaatcgactcaaatatctaaattttaagtttatcatacccgggaggttatcctcgtcgagagaaaccgacccggttgattttcctgtgtctatatatatcgaccgagttgaagcctcaagaggaggaaaggatcgaccccgacccgacccgaagttccgaccccaaccagagagaggcgcgcgcgtgcgggtgcggtgcggtgcggatcggatcggattgggccgagttcccgaccccacaccacacaccccctcctctccccgtccgagagggctccggcctctcctccctcccgcgatccccttcccctccgcctctagccgccgcgccgcgcctcgccgcgcctccagccatcgccgtcgaccgcgcgcgcgcgcgagaggttcgtctccgtcctcctccatcccatctctctccccttccatggatatttccttcctcttctctcgggtttcttctcttctacttgatgagattttgtatgcatgtatgtatgtgtgtgcgtggggggattggattgattggatttggagcgcgccttagaaattcgaggggtttcctgcgctctgtttgctttgctccctagatttgccactccgatttcaaactcttcgagtaccaaccaacccttgcggtatttttgctcttcgaatgaggttatgagatctcatgagccacttagttttcagacatgcagatgcgcgcatgtcgcctccatgttgccggcgtaccatctgttttttttttcttctgttatttttttcgtttcataagattaccatgtgctagtaattactgtgagtgattttatcagagacccactaattttttatgccttaatttgttttctctcattttttgcagagcggctgtacgcgattcacatgtgcggtaatttacctgcctactgccgccaaccagaagtggaatataccctatcctaattttctttcttcggatgaaaggtctgccagtctgcgtcagctatggcacagagttcgtcccggcttcaccgcctgctcacattgctagacagtatcctttctgcaagactatggttcgctatgcttgcagttttacagatgatcacacgctatgctaggttatactctgtaccgattctctgataaactaagcaaattgcctcatgaaatgtgcaaattagctgggctaaaacgtacagtctatgcttttgcagtcgaacatatatcatttgatatcccctttggtttatctatctattgtgcaaagtttcctttaacacaactagctggttccacgcaagcgacaaggttcgctgctgcacggcaaattggagaaattgccaagtcccacccccaggagctaaatgtcttactcaaaaaggtataccaacaattccaccacctgctagttttgtggatccttctacctgaaaatgtttgcttaatataatatgtgtaagctatgatgtgtgatgtgcgaaatgcccaacttttagtttcttcaattcatgcttcgcttgcttggtagcacaaaaatgaaccctgcagttttatgttatgctgaattttcagtggtgttgaagttatagattttccttttctcggacatgcaggatatctgcattatcattatattaagaaggaaaagggtaaaagaaccctgattacaaaacacccacacaccccagctctcaggctacatgcctgtccgtgctaacaaggaccacacgcagaaaagaaaacagcgaccaaaactgcccctcttcaacctgaaactaaacacgaggctgtagacagttaagaaggatagccctctagcctcagccaaacaccaaaaccgcccctcctcttcagcaagcaggatggcactagccaagtttggagcagcactattgagggcacatcggtttcgatgcttncaaagcgtccaagcaccaagaatgactagagaattaaggccctgttgcactggaccgttgtttgcctcgttggtcctgttccaccaaaataccctgaccaaagcgctgtcggagtgagaaccaaaatttcctcgcgaagacacaactagtgagtagatagatgattatttcatcagctnggtcgcaatgagggcgttgaagttatagattaaatatcaaactttgagggatatatgattttgtgtgatgtctgttgtaagatgcaatgccctcccatgcattgattgatggatgtttgttctatgagaagtaactattactgccttcattatctattatatcaaggtagtaacatgctcatccactggagaacaagcttgttttctttttacacatgttctgcggagaatggctggctgatatttatgcttttatgttatggttttaggtttctccatatttacgtagtaagaattgggacacaagggtcgcagcagcccatgcgattggtgccatagcagagaacgtcaaacacacatcggtgaaagacttgttcgcatctgcagaagcagaaaaacatgcttctgggttgtctggaattggtgatgttgggtcaacgttgcggcatgctgatactactgcaacatctgagcttgcttttggaaggtttgttgagaattctttgaaactttcctagtgcttagtagaccttcccgctcttcttttttgcctaattggaaatggacaaactaattccgtttaacttctttttacagcttcgatataaacagggtgttggaatttggatctcctttattggcatcaggtggacaggtgtattttcttcttaccattattttgccttgtcatatttaatgaatacaattaaaatactgtggtttttttttcagggcaatgttattttcagattcaatccatttttttcttttctgatagtgtcatgcatccatctattgtttgtttttctttgccatatgtcaacttcttgagggctttctatttttcttactaggaacatagtgaatcgaaagcacttgacacttagaagtaaaatagatcaagcctcttccattgcactgaattttcgtttttgacataaaactgcattgaatattgtaatgtataggttacttactttgctgctaactcgaggaaaagaattttagtggataatgtttaaatctaggaacatattctgaagctcctcaatataattatttctcaaattctggagatacacacaaaataacctcgaatttctttgtctataccaagatttttttaaaatttttgttttaaggtgtacttggcaattccattccatttcttatttgtttatggtttcatggtatgcaacatgtgaaagctaatggggattattgcttttgtgcttgctactaggaatatgacattgcaaatgataacggcaaaaatccagcagagcgtttagctcgccaaaagcaaaatctccggcgtcgtttaggttatacttctctcttacatcttattgttgctactttttaattttcactttatggcactcaccgcaccactgccacaaggttctttctatagtgaagactgcacctgtattctgcaaagtatcgttgtactctgatatatctttgaactttttgttgttgtgttggatttctcattcctttcatgtttctgttctagtgcaggtctggatgtatgtgagcagttcatggatttcaatgatgttatcaaagacgaggaccttcttgcccaaaagaattattggggtgcaaatatgcaaaacaatggattctattcatttaatactggtcagaatattcagcacttggttgcatctatggttcccaggtatcccaaacattccaattttcgctccaggcgattaagcgccagggagctcaatatgctgaagcgtaaagcaaaaagcaatgcaaaagatcatacaaaggctgtacccgaggatgatgacgttgtgccaaaaagttctggaccgtctaacggggcctcttctgatcaagttggttcacacaacacatgttctgtcaattgtactatatttttctaagattttagtatcctcccgcacaattttttatttttctggggtcatttatgagatggtcattaattccacattcttaaattatcgggagccttggtagaggttgtaaaactttgtttctgattgttctcaattgctagcacaaactatcatgtctgaatatgtggcgcagtgcaagtaagttaagtgcatttgtgggtgtgtgttcttccatgcatcatgcatgtgtggtttgttgacttgttattgttggcattcctgtttggcaatttacgcagttgcactggagcattctgttgggatggctttgtcttcaatctgtgatgatctaatcaccccacttacattttttcaggatacagttgatgcaatcacagatgaggacaatctggagtacagtgagaatgggagatggccttttcaacagtttgtagatcaacttattcatgacatgtttgaccctagtaagttcattatctgtcttgtctctgaaatttgtcccattcttatctcgcttacaatctttttactgagtgttgtattgtagtttgggaagttcgccatggcaccattatggctttgagggaaattttgacgcatcaaggtgcttgtgctggagtatattttcctgatctgaactcacctttcgctgaccttgatgataaaaacaatttggactccctgaaaagagcacatggtattgatcttaatgaagacattgattcgggacagctcgagccagttttgaaaagacaaaagaaagaggagtctaatccagaggttatggacattcagttggataaggagccaagtaacggtgattattccaaaacagaggcaagtctgagtactgagcctactgtatctagtggtgaaccaaatcttgctcatgcaaaggttgaatcacccttccaggttgatggttcagctaacccatctaaggtggatccatattgtacaccacctcacgaaacactcaactccatgcccaaactgagttctacccatctccctgaaaattcaaaatttataaagctgatgaaactagcgaactactcagcggtaaaaaattgggaatttcttcaagactgtgcaattcgtttcctttgtgtactttcattggaccggtatgtatctctggacttatatactttttgtgtgtatttggttgtcttggctattagtcttattatttttttttgcctttgttcttcctgtagctttggtgattatgtatctgatcaagtggttgctcctgttcgtgaaacttgtgctcaagctcttggtgcagttctgaagtacatgcatccgactctagtatgccatacactgaatattttgctgcaaatgcaggtgtgtcctgtagtaattatttgtcttgctgttgtcaacttcaaaacagtacattctctgttgtcatcatcatcaccatttccgtccttttctttgttctttcagcgcaggcaggagtgggaagttcgtcatgggagtctccttggaattaagtatttagttgctgttcgtcaggtgattgctaatgagaaaaactataacctaataggctaattcaatcgtctttgtgcatatatgaccagaggggcagtagtagttggcttgctaccaagtcaagttttgcttttcatatctctacactagaggaacttaggagttctgagaaacatcctcttctgtttactaatatttgtttttgacgcctaatttatgtgtaaaattgctataatattgtttccttccccaccaggaaatgcttaaagacttgcttaattatgttcttcatgcctgtaaagctggtctggaggatccagatgatgatgtccgggctgtggctgcagaggctctgatcccagctgctgcttctttagttagactaaatgatcaaatgctacattcaattgtgatgttgctttgggatatattgcttgaccttgatgatctaagcccttctacaagcaggtatgttcaatcatgctttcctcatttagtaaacacattgtttgcgtaatgttgaacactgagcccatgttatacattatatggtccatctacttccgatttctaatcttattttgaatccagtcacctgttcccagataaggaatttaaaatgttggatagttgttcgttgctcttttattccgtttaaagttgactgtactcatgccacaataaatattctgtatttctcatgtccaaatttcatttttgtttcagtgtgatgaatttgttagctgagatatattctcaaccagagatggttccaaagatgcttggcacaacagccataggtggagacaacgaatttgatctaaacagtgtaactctggttgccggtgaagaaaaaatgggttctaatgataatccttatgtcttagccgctctgacaccccgattgtggccttttatgagacatagtattacatcagtccggcgttctgctgtacgaacattggtaagaattacatggaatttgagatccactgtagtttgattgtgctgcagtatcaggtgcccattcgagttgagtatgagttatataaatgagaaacagaattgtaatgaaaaatatctgcaataatttaccgggtgaaatagcagttttgagccatcttgtgtatgttttctacattgttttgccaagaaaaaccaacctatccttgggattttgccaatctggagttggatattccactctgttcccatgtgcaattggtttttgctgtaagcttctgaatgccatttgttatgctttcctagttaaaaaccgtgaagttcaaactttttgtaggagaggcttctcgaggttgggaacaccaggaattcagctaaactatggcttgcatctatattaggtgatgcgctgcaagttgtcttccagaatcttcttttggagtcaaatgatgagattattcgatcttctgaaagggcttggaaacttttacttcaggttactgatgttctggctttccgggtgttgtgaatttactcaattcatagaaatttaatgatcatgtctattacaggattatagtaacaaacaaaaatatttctatgcttgtagtgccctacggaggaccttgagtctgctgcaagttcatattttagtaattgggtgcaacttgccactactccatatggcacagcattggattctgcaaaaatgtttttgccagttgcacttccacgaggaagtcgttcaagagctgctgcaaagatcaaatctgcaaggttagaacatgaaaatacgagaatgatatcttttggttctaccggagagaacacttcacaggaaaagcattctgaagcttccttgagtgtttcaaaaataattgtggggtctgattcggacaaatctgttactcatacgcgagtgctgacgtcaatggcccttggtctgtttgcctctaagttgccagaggggtcgtggcaagttgttcttggtccactagcaagcgatctcatgtctctctcaggagtccagagacaggtaagaaaaaaccttatgttttagtgcataaaagcattcaattcaactacttgttttgcactcataattttctatcgctccaggtggcttctatggttattgtttcttggtttaaagacctcagaaaaagtgatcctgctgcggtgggtacattgctagctttcttatcctccctgaaagggtggatgttggacttactggcttgctctgacccttcatttcctacaaaagattctccgcttccatatgctgagcttgcaagaacatacaggaagatgcgcaatgaagccaataatttgttccagtcaatagaatcttgtgctcttcttaaagagtatacaagcaacttaaactttgaagctgacatgctgagtgttgatgatgctattaacttcacttcaaagcttttgttaccatctgaacctgattttagtttggacagtgataaaattgtcttgaacaatatagagtcagcaaaacaaggtctattgtctacgtcaggctacttgaaatgtgttcaggtatgtgaaatttctaattagggtgtcttcagatttatattaatgtgttagaattacttgttgcatctgtctagttctgattttttttatcctttttattagcaatatcataaaataggtttccttgtttgatgatgttctgcagaataatttgcatgtgacagtttcctctttagtggcctctgctgtagtctggatggcagggctgcctagtaagttgaacccagtcattttgcctttaatggctgctgtaaaaagggaacaggtacgacatagtattcttatgctcttaaattttgtcttagatgtaagctcaaatggttccatatcatttaggaggaaatacttcaggacaaagctgcagatgcacttgctgagctcatttttagttgtgttggccgcaaacctggcccaaacgacaaactaacaaagaacctctgcacgttaacatgcactgatgcaagtgagacacctcaagctgcagttataaactcaattcaggttattgaggaccaaaacttgctgtcgattggtaagcgttttagcaatcacaaatccaggggccagatgacttccggtggtgaatcgaagtcggagggttttataagccggcgtggatcggagttggcttttaagcatctttgtgagaaatttggagcatccttatttgaaaagcttcccaagttatgggattgccttacggagtttcttaaacccgtcaagactggagatgatcttatgaaagaagatccaagtattgcgcagttaggaagatcttgtgaggacaaggaaccgcagtcccttataaataatatccaggtttgttttataaattaatttgaattcaattggttcccttttgttttggcataaaactgctacatgatgttggattagaccatcatgtcatatcaatatgaatcaatatatctttggttacttgctactatttagtataaactggtttggttccattttcatctcttgccatatttctaatgccatttctgctcctcctcacaggttgttcgttcggttacacctcatttggctgagcccttgaggcctcaattgctaagtctccttccctgtattcttggttgtgtgcgccatcctcatgtcgctgtcaggttagctgctgcaaggtgcatcacatcaatggcaaaatcattgactgctaatgtaatggtaattgtgatagaaaatgtcataccgatgttgtcagattcatcttctgtctgtgcaaggcaaggagctgggatgcttttgagccttcttgttcagggtttggctgtggagttggttccttatgctcctttccttgttgttcctcttctaaggtgtatgagtgatcctgatggttctgttagacagactgtaactcacagttttgctgctctggttcctttgttgccattagcaaaaggttctttgttaccggatggactgagtgaacgcttatctagcagtgcagaagatgcgcagtttctagagcagctcctcgacaactcccaaattgatgattacaagctcagcattgatctcagtgttgaactgcgaaggtctgtaactatcttaaaagctcctttattggaatgtggcttgacgacgttattctacttagtttgagatagtgtattgagtgctattgtggataccatacataataatacttgttataatgattattatttgatgttcttttaacaaaatgttgtggatcgctacaggtaccagcaagaaggaattaactggctagcattccttagacggttcaagttacatggaattttatgtgatgacatgggtcttggcaaaacactccaggcgtctgctattgtagcagctgatattgctgagtcacgtgcacggaatgatgagcaagatccgaaatctttgattatctgcccttctacattagtagcacactgggaatatgaaatagagaagtacatagacagctctatcatgaaacctcttcagtacatcggttcatcacaagataggattatcctccgttctcagtttgataagttcaacgtaatcataacgtcatatgatattatacgcaaggatattgattttcttgagaatgtcttttggaactattgtgtgctggatgaggggcacataataaagaactcaagatctaaaataacatctgctgtgaaacaattgaaagcacaacaccgtcttatcctcagcggtactccaattcaggtaaaatttcattcatgaatcttgttggtatgcttttcgtctagctgttgcggttcgctttacattgcactttttatttcattgttcatgttctttgtagataattccatcgatccagtactgaaattggtattactatttatttgacacattccactataattgcagaataatgtattggagctctggtctctatttgactttcttatgcctggatttcttgggacagaaaaacaggtaaatgtgctatgaattcaactttacttacagaactgaaagctaagaatttggtcgttgacatgaaccatgccttttttgttcaagaacttagtttagtttttaacatgttcctgatttactcttacgctagcttccaagcttattagttagttcaggaataatatatggatctatggacttgctagttagttccaagcttattattagttagtttagtttttttgttattcactgtggacttgctcagagcgacaggtgatatatggatctgccttatctgggccgttacactttcttacatatgatgcttgcaaatgatatctatgtttagttgtgttataggtgctaggctgcttgataaatcattagtagtttgatgacatgcatctgtagaaaaagacattggtgactatattgtattaatgtaagtggacatatatggctgtgttcggatgagggggttcccaaccccctctccctcgcattccgtgcgcacgcttttcaaactactaaacggtgtgttttttgcgaaaagtttatatacgaaagttgtttaaaaaaaatcaaattgatccatttttgaaaaaaaatagctaatacttaattaatcacgtgctaatggactgctctgttttccgtgcggggagatgggttcccaaccccacattacaaacacacccatagaatgttttaaccaaccaaagatgaaattgtttctgctttcatgaaggggtggatttttactagtcctgactcttgataattaccttggtctattctgatatgaagtatttgtgctgaaattaaatacaatgttaattatgcagttccaagctacatatggaaaaccattgctagcagcaaaagatccaaaatgttcagcaaaggatgctgaagctggcattcttgctatggaggcactgcataaacaggtttttatcttctgtagtagacttgaagtctttaaaaataactgggggttttgagtcttgtgacctttgttgacaagtaaaagtcattttgctatactaggtcatgccgtttctacttagaagaacaaaggatgaagttttatctgatcttcctgagaagattatccaggatagatattgcaatctcagtctattgcagctcaaactttatgacaaattctccaactccaatgccaaacaagagatttccactatagtaaaagaaaatgaattagatcaatccacttctcaaccaaaggcaactcgtcatgtgtttcaggtactgcagttagacaaacattttagctttctcattctgcatttcttatgtggtatcgtgtttgcgttttaattgaatatgcttttgtaatgcaggcactgcaatatctattaaaactttgtagccatcctttacttgtaactggggaaagcccacctgattatcttgtggaccttctaaaggaaatcggtatgggaactggtgatgagcttcatgacctacaccattcccctaaacttgttgctctccaagagatacttcaggagtgtggtatagggtcagaaatatcaagccctgatgcttctgcagctattgggcaacacagagttttgatttttgctcaacacaaggtactgagtctgttctcttattgagactatgtatccctgtttcttttggtatattttcatccttgtcatgtttataaacattcttttctccaggctttgcttgacattattgagaaggacctgtttcaatcccatatgagaaggtgagttttatatattgtgatgtacatcagcttcatgaagaattcatcatgccagtgtgttgtctgtgttgcaacagatttgaaaaaaatatatcatgagttctaaactgaaaaattatatatatatatttatatattttgaaaaatcatataatattcaatcaaacatcaatcaacaaaaaactcaatccatatgcacaaaagacatttatccggtcctagaagatacggtgagatcgcagtttcaccaccaccaccagtagcagattcttttatatagtagagattaatattagctgatgcaaattattttaagcatcttgctttatgttgttttatcttgtgttttattatgcttggatatttgtactttctagagtactgcagtgctgttttatctttgagtaactgtaaatataaggttgtcgttggcctagttgataactgactaaaaatacacacttctgtttctcagtttcctgcctgtgctcatctaatcagcaaacttttgatattcattcagcgttacatatttacggttggacggctctgttgaaccagagaagcgatttgaaattgtgaaggcattcaactcagatccaaccattgatgtgctcctattaacaactcatggtaggtttggagaatgccatatggatcagggatttactcctagatatatatactagaaaagctatatctgattctttcctgttgcagtcggtgggcttggattgaatttgacatctgctgacacattggtctttatggaacatgattggaacccaatgaaggatcttcaggtttgcttttgcatattttatcaacgataaggctaccattaaatttcctccaccattttcaagctatcctctgtgaaacaaacgaacaatactcccctcttacaggcaatggacagagcacaccgtctgggtcaaaggaaagtggtaaacgtgcaccgtctcatcatgcgcggtaccctggaagagaaggtgatgagtcttcaaaggttcaaggtgtcggtggccaatgcggtcatcaatgctgagaacgccagcctgaagacaatgaacactgaccaactgcttgatctgtttgcttcgacgcctgcttccagaaaagtaaatcccttgtgaccatatatctcgtatagaaaaaacttttgtaatttttattctttatttgggtttatgatcctttgtctatggccatacgcaggcgtctgtactcccaagcagttcgggtggtgatcagagtaaagattccaaggggaaatctggtgggaagggtttgaagtccattctgaatggtctggacgagctatgggatcagtctcagtatgcagacgagtacgatctcaaccagttcttggcgaagctcaacggctgaacacacgatcaccggtcctgtacagtgtaaagcgaattggggcgtgtgatgaacaggttggcagattttgttggcaaccacaggagtcagaaatttttttgttgtttcatacggaagaagggaaaaaaaaaggaagatcgcaagatctagagcaatgtggctaacatataggtgcttgagatggtgatctcaaatttttgtcttttgagcttttggttaggagggtttagagagagatagagctagtcttgagaggagttgtatatactatctgctcattataataattaatcaaaggctgcagctccttgtaaattttgccttgagttgcttactgtttctaccttttacttggcctagtaactgagctatccagtggtgtagtaagcctgcctactgggaacgcggatcatttttgtctcgctaacatgtgaaagtaatagtaagatcgggtaaaaacggaaaaggggtgatacattcttgcctatcaatccttgctcgtctgaatcccgttttggccgctaaggaagttcccaaaaatttttcctgttcattgtctgaatcccgttttggccgctaaggccgttttggacaaatgtatagagcacaaaatatatattaaaaaaactaattgtacagttatggagaaatcgtgagcttaatcagttcatgattagccataagtaatacagtaacccacatatactaatgacgggttaattacttaatttggctcaaaagattcgtctcgcggtttccaagcgagtcatgaaattatttttttcattcgtgtccgaaaaccccttccaatatttagtcaaacatctgatgtgatacctaatttttttttcgtgaactaaacggtccctaaaaggaagtcatctcagccaatgtgaaactgatgacctttcattcccttctattctttcatcgttgtaattgtgacatgttagactataactttcatcagttagaaattgatcccttggtctccctttattattattttttgttcgacccttgcttaggccatgtttagtttcaaaggttttcttcaaacttttaacttttccatcacatcagaactttcctacacacataaactttcaacttttccattacatcgttccaatttcaaccaaacttctaattttgatgtgaactaaacacaaccttagatgcatatcttttcaatgtcctttgtttctacatagcctacatagtaagggtagaagcggtgtggaaattttctaaccataccgatacagtttccctaaaatattacatagtcatgctgtagcagcactcggaatatatatgatctagttagactagttcttctctcaactttctcagtctcccctttatttttcacacgcacgtttcccaaactactaaacgatatgattatttttttttgaaaattttctataggaaatttgatttaaaaatcatattaatccatttttatttttaaacttaatacttaattaatcaagggggtcaatccactgtttcatttttcgcatagggaggagttcccaactactccctccgtccctaaatatttgacgccgttgattttttttaatatgtttgacggtttgtcttgtcaaaaaatttaagtaattattaattcttttcctatcatttgattcattgttaaatatactactattactcaagtttttgaataatattcacaaaagtttttgaataagacaaacggtcaaacatgtttaaaaaagtcaacggcatcaaatatttaggaactaaaagagtactacaaacgaacgaagcctaggcttctccatataaggctgtgtttagttcacagcaaaattaaaagtttggttaaaattgaaacgatatgacggaaaagttggaagtttgtgtgtgtaggaaagttttgatgtgatgaaaaagttggaagtttgaagaaaaactttggaactaaaccaggcctaaatgaacattcgatggctcctctagaaacattcttgatcttagcattcagtttggaagatgaaatggcattcacacgagcattgcagattttcatggtccatctggctagcagagaccagagcgtcgtctgcaaatgcatgatctgagcaaacctttgcagtctttgctgcgttgcgttgacggtcagtcaacccacacacacacgcatcatgcaacacattgacagattggccttaacttcactcggtaatttatttcatcgctgtaactatggcatgttagactacaactttcatccgttagagcaggtacaatagcaggctgtaaacatattttaataagataaaagatgagagagaatagcagtgggctatagatctatagccagctgcagcgtggactccaagacacaatgtgtgtatgacaggtggtaccatatattaatagtatagtaaacaactatcgtataaattacctattatattggctataaataaattaaagttagtagtgggttatactattaaacttgctcttagaaattgatcccctggcctccctttatattagttgcattcctttgaatgttccacacttgtttagcgaattaaatttaaaaatatactgttaatttatttttttttctcgaaattttcaggatatatttttttaacagaaatatatcgtcgttctgtcacaaacattacacgaacatgacgacgcgggcgagacggcgctacctcacacgatgaaatagctagaccgagcagtaccagcgagcgagaccgaatggctggccgattcaaactgtttaattatctgatattaattaatcgctaattagaatgattaatcacttgttattattaattaattgctaattgggtaagtctctaattatgcggcagctcactgggcaagccgttcgctctctgctcattcattgtgcgagattgcttggtctcgttgtttcgtcacgtgagaccgcgcgatacgctatggttgcgcacagtcaccgtgcaagaccgtccgcgtcatcacacctcacgttgtttgagatcgacagtttatttctattaaaaaaataaatcaacagtatatttttaaatcaaatctaattacttgtttagctgtatatcttttcaaaatcgattatccctacatagcatatgtagtaggggtaaaaacggtgtcgaaattttccaaccgtaccaataccatttctaagaaatattacatggggtgtgttatgttgggcttttcaacctgcttttacttttgcttttgcaaaagttaaaagccaactaaagggctcaaaaatcataagtacttttgctccaaagctgcttttagtgcagtacaaatctaaaagcacccctacccctgctttcattggcttttgagtaaaaaaaaattacccgcctctctcattataaagaaaacggttcgacaaaaataaaaattaattacacagattacgtgtaaattacaagacgaatcttttaagcttaattgcttcatgatttgacaatgtggtgctacagtaaacatttgctaatgatggattaattaggcttgataaattcgtctcgtagtttacatgcggattctgtaatttgtttggttattaaactatatttaatactttaaatgtgtatatgtatatttgatgtgacacagtaaaaaactttacccataaatctaaacacagtcttaatattctacgcgtgtcacagtgtgaaattttttgttatgaactaaacagtttggaagatgaaatggcattcgcacgagcgttgcagattttcatggtacatctggctagcagagaccagagcgtggtctgtaagccagacagcccatatgcatgatctgagcaaaccttgcagtcgttgctgcgttgcgttgacggtcagtcaacccacagacacacgcatcatgcaacgccattgtcagattggccttaacttcactcggtaaggcctggtttaggccatgtttagttccaaaaactttttttcaaaaacatcacatcgaatctttggacatatgtataataaaaaactaattgcacagttatggaggaaatcacgagacaaattttatgagcctaattagtccatgattagccataaatgctataataactcacatgtgctaatgatggattaattaggctcaaaagattcgtcatgcggtttccaggcgagttatgaaattagttttttcattcgtgtcccaaaaccccttccaacatctggtcaaacgtccgatgtgacaccaaaaaattttcttttcgcgaactaaacatacccttaagtttcccaaatttttttccaaaaaacatcacatcgaatctttggacacatgcatgaaacattaaatatagattaagaaaaactaattgcacagttagaggaaaatcgcgagacgaatcttttgagcttaattagttcataattagccataagtgctacagtaactcacatatgctaatgacagattaattaggctcaaaagatttgtctcgcggttttcaggctagttatgaaattcgttttttcattcgcgtccgaaaaccccttcccacatccgattaaatattcgatgtgatacccaaaaattttcttttcgcgaactaaacaggccctaactcgactcattcactcgcgaactaaataggccctaacttgactcattaaggctgtgtttagatccaaagtttagatccaaacttcagttcttttccatcacatcaacatgtcatacacacacaacttttcagtcacatcatcttcaatttcaaccaaaatccaaactttgccctgaactaaacacagcctcactcactctagtcccagtcaatctaggtggctagctgacagcaaaaaattttcgccatgtcacatcgaacgtttgaacatctgcatgaagtattaaatataggttaaaaaatcacatattgcgactaatttgtgagacgaatcttttaagcctaattgctccatgatttgataacgtggtgctacagtagacatttgctaatgatggattaattaggcttaataaattcgtctatctgtttactgacggattctgtaatttgtttacctgaatacctcatatgacaccccgccaaaactttaccccctcgatctaaacacccctgaatttgctatactagtatataatattctccagccggatccttcctctcggacgcagcaatggcaatgacgatgctcttcagtctgctgttttgcacagctaaggctactgatgattcaggagcagaaactgaagcagaagcactcctccgatggaagtccactttgatcgacgccaccaactcgttgtcgtcatggtcgattgccaactccacctgctcttggttcggtgtcacctgtgacgccgccggccatgtcactgagctcgaccttcttggtgccgacatcaatggtacgcttgacgctctctactctgctgcattcgaaaacctcaccaccatcgacctcagccacaataatcttgatggtgccattccagcaaatatttgtatgttgcgcaccctcaccattctggatttgagcagcaactatcttgttggtgttatcccgataaatatttccatgttgattgctctcaccgttctagatttgagcggcaataatcttgctggtgccatcccggcaaatatttccatgttgcacaccctcaccattctggatttgagcagcaactatcttgttggtgttatcccgataaatatttccatgttgattgctctcaccgttctagatttgagcggcaataatcttgctggtgccatcccggcaaatatttccatgttgcacaccctcacctttctggatttgagcagcaacaatcttactggtgcaattccctaccaactcagcaagctccctaggctcgcccacttaggtcttggagataaccacttgacaaatccagaatatgccatgttcttcacacccatgccttttttggaattcctatctctatcgagaccttttacagtgtttacattcctaaaatggcatagatctaacggttcacgatgaaaggtaccttatgaaaggtatcagaggtagaaaggtactaagtattaaaaggtaattgataacagggcaattatgtctaacaacgtatggacgtaccgaaaggtacggtgtaagtggatttgaaggtaccacaaggtaccacgtaagtagtttttaaaggtaacgtaaaatatgatttatgtggtggggacaaaaattacattctcttctattcggtttccaatcttcggtcgttctgtttgcgtcggtttccaaactttggtccgatttacgtggtacatatcatattcgcatgatcttgataattatttccagatagtcattaatttacatagcaatttggtgatccatcgtttgatgaatgtaatcaaagatcgaaaggacaacaaattgagaagatttacgcacctaacaagaacaaaacaagttcaatgaggaagatttgcgaaaaaaaactaaacaaatcgtctgacagatcgggaccgtgcggccgcttctagctccggcgaacatagacagtcttggaccacttcttcagggtcctcttcttccacggcccctccctccaaccaccgcctccggccacacgtccaccgccggccctcaattctcctcctttcaacttatcgaagaacacgtaaaccttacgtacgaacagaacgtatctaagaatgatgcaacgcaacatgctacaagctaattccttcgataccttctcatacctttttatatgtgtaaaagacacatttgtcattctaatatcatcatatttacattaatgccacctattacaatattttctttccataccttgcccctcgcagatcaacggctcacgtcgccccacctcctttacctcgcaaacatcgtaaaatccctcatctctatcttacaattatctcaacggtacttttccagaattcatcctcaatagcaatagtttgaggatggagcacctcgatttatcgtataatgccttctcatggtccataccagattcactaccaaatttgagggttctagaactgtcgaacaatggattccatgggaccataccacattcactctcaagactacaaaagctccaagacctatatctgtacagaaacaacctcaccggaggaatcccagaggagcttgggaacctaaccaatcttgaggccctgtacctgtccagaaaccggttagttggaagtttgcctccctcttttgccaggatgcaacaattatcattttttgcgatagacagtaactacatcaatggtagtatcccgttggagatattttcaaattgtacttggctcaactggtttgatgtttccaacaacatgttaactggaagcatcccaccactaatcagcaactggacaaatctacactacttggccctctttaacaacacatttaccggtgcaatcccatgggagataggaaacttagcacaagtatatttagaggtggacatgtcacaaaatctatttactggaaagataccattaaatatctgcaatgcaactttggaataccttgcgatcagtgacaaccatctagaaggcgagctccctggatgcctgtggggtttgaaaggtctcgtttacatggatttgtcaagaaacactttttctgggaaaattgcaccctcagacactcctaacaatgattccgacctactcgccctggacctgtcaaacaataacttttcgggttatttcccagtcgtactgaggaatctcagcagactagaatttttgaatcttggatataataggatttctggtgagattccttcgtggataggggaaagtttttctcatctgatgattctacagctaaggtcaaacatgttccatggaagtattccttggcagctatcacaactccccaaactacaattgcttgatctagctgaaaataattttacaggctccataccaggtagtttcgccaacttatcatgtttgcactcagaaactagatgtgtgtgtagcttaattggagtatacctcgatctagatagtagacactacattgatattgattggaagggaagggagcatccatttaaagacataagtctacttgcaacaggtattgatttatcaaacaattctctctctggtgagatcccttcagaattgacaaatcttagaggtattcagtccttaaatatttctagaaattttctacaaggaaatatcccaaatggaattggcaatctaacacatttagagtctcttgacctctcttggaataaactctcaggccatattcctcatagcatatcaaacttaatgagtctcgaatggcttaatctctcgaacaaccttctatcgggagagatacctacaggtaatcaactcagaacacttgatgacccatcgatttatgccaacaacctggggctttgtggatttcctttgaaaatttcatgctcaaaccattcaagttctacgactacactagaaggggcaaaagaacaccaccaagaactggaaactctatggctgtactgctcagtaactgcaggagctgtctttggtgtttggctgtggtttggagcactgtttttctgtaatgcctggaggcttgctttcttctgtcgcatcgatgccatgcagcagaaacttatgtaaaacatagctcatctgagtaatatgctctgcttctcattgagtccacctgagcgtgtgtattagtgtcacattatgtcagcactgcactaagatctaaggttcagtaggtattatccctttatttcagccatcgatgagatgtaatttgctgttgccagatttagcttgttgttgttgtcatgatgaactcttgttataagcttttagtgtaagtcgggtagcatccttggtcagaaaagaaaatttacatgttttgatgatgagaccaatttcctacatggttgtgtttgaagatgcaagtagcatgtaatcaaggaagttccaaataaagtagaatacatcatggctgtcttttgatgtatttgcaagctttgttattacctttggatgcatacagacttcatttgacgctaatttggagaattttgtcttattttctgttcaaactgtaagctgtatgtattctgttttttttttctcatcagctataaattactgcagtacacttctaagcaaaagaacacagctttgccggttgcagcaacaatactgaacacaacaagaacacgcgtggcaaaatttctattactagaatttcaccaaattccgacaaaaaaggtggagaaatcataagaacaaaatcacgctatccactgaaaatttccaggaagaattgcaaatcaactccccttgtgatcagtggccgctgttcacgacagcgcagttcctcctgatctccccctccgatccggtcttgacctgcaccgcgcccagcgtcgccatcgaccggccgaacacctggaagaacacctccggcgggctcgccacgacgccggcgatgtccgcccgccccgccacgtcggtggcgagcgcggcgttggaccggagcaggccgcggtgttagagtatatgatagttaaagttatattaggatatgattggtttgtttggattccttccatatctataatacttccttatttcttcctcctatatatattggatcccctgagactcaatacaatatgtcccacgttacgcagtatacctctcctatactatacaacatagtatcagagcgggtgatctaaggccaatgccgctcacgcttccgctcgtcccccccgaagggtttcgatctcccgggggcggccacccgtttcctttttttttcgctcgtcgagtcttcgcggcctgcctccccagaggagtcaatctccgggctgcggccgcggcctgtccgtcgtcatcttcgcgtcagcaggccctccgtcaccgtcccccgcgccctcagattcgtctacaccgccagcgtgtacgtcgccgggtcacccctccaccggcgcgctgctcccaacggcgccacccccgtgccggtggctcccgacgccaccagcctcctcgactccgccgcgaccacgtggtgaccaccgcgccaacggccgacctcagctccgccctgccggcatctggaggacgccagcagggcctgcgcctcaccattgccggccgccaccaagctccggctgcgtcggctcccggtccctgccggtcaagcacgccgccctccccgcgccacgtctccaggaacaaccggtctcctctcattcccttccaatggtctgtctgcacgtgtcacatgtgtgggtggataagttttggggggatagctggctactggtacggctgaggcaaaaggttagctggactttggcctatgtaccggaccatcgagcaacaggggatgctaccgtactgttgctgcttgtatttttttttcgcccacaagagacaattctttttagcctctaagagacaaaaagaagagcctaacaaggaccttgagataacagcccattcatagaacgggtttgcgtcgcccaccgcctcgtcgacatctacgcgtctccgatatcggtatcgactctgcttcgactttatcgttccgcctcgcgcatcttcggcttgatcacccgttcaagcgcccggctacaacgacttctacaaccgatcggcatcaagcacgcgtctacactatcaaacttcgggttgccgctgcatcgccctcttgggctgcagtgtcgccgcccatggtccacctccactggttgttggaacactgagaggcaacacctccactgcctcgcccgcgcggtattggcaacaccggcgcgcgtgttcgtcccgagttgtccccgggtctggcaaatccggcatgacgtctcgtctttcacggttcgactacatcggctcttcggcatcatcttcctcaacgactgccgcgattgtgtcaccgtcttcgtctcccgcgcatcctcgcgcaccttggtccacgatgcccctcccgtgcgtccacgaccactctacgacggcccatgcgcgctccgcggctcggctacctcgacatctatttttcgaccacagcactcttgccggtttcttctccagtctaagtgtccgcactgctcacgcttggactgcggggggatgttagaatatatggtagttagagttatattaggataggattggtttgtttggattccttccataagtgtaatccttccttatttctttcccatgtactcctgtatatatcggccctctgaggctcaatacaatatgtcccatgttacgcagtatacctttcctatactattcaacacgtggtgcctgagcaccgtgcggtagtagccgaggtcgaacgtcaggtggctgccggggtccatctccaccacgccgtcgccggctgtcctgcacttgcgctcacgcaggttggcggcgtccagcggcggcgggtcggtgctgttgctgttggcattgccagcgccgccgccgccatagaggcggtcggcgaaggatggtgtgcgcacctgcgcgatcggatgcaatttttcagaaatcattttacatccaagaattcattgtgataatgtcacacatgtgtcctcattcttgcacaaaaacaagcttgaatttttatgatgttggcttgctgtagatcgccattttcgggacatgaatcgagcatccaaacgattgggttgaaatgcaatttttttaatgaaaaaatcaacgtaatttttcccctgttgattgtcaacaaagaatctataaaattttctcaagacatgcatgagagagtctgcagctaatttcaaattttcggttgatttgatgctctaacatatgagattatataaagctaatttttgttcagtttattataccagtcataaatcataacagtataaaattgactatagtcaccaattatagtgaccctccccaactattgaaaccagggtaatttaactcacaatacagtattgatagtggtatttactaacgtgacttctacgtggcatcccaaacatcaaataaatttaaaaactaagtagggctcgcctgcaaccccccccctcccctcccctcccttctacccctctactaacctctgtccacctctctctccccatttcttcttcttggcctaacagcagcagggtgccgagacgacgacggggagcagcgggatgatggcgaggctctcctttctctcccaccccggtcccttctgtccaggcgctagtggaggagtggccggccgagtgagatgcggggtggcagtaggcagcgagcccgggtggtcctcatcatcctggccgggtcgcctgagttcgagttcttggatggtggggaagaacccctcctcgttccagtccctagaattcgagttcaagttctagatagtgggaaagaacactgcgagatgaccacagcatgcctgctgtcaccgtcgtgcgggtatcacggcccgattggctccgcaaagccattgcgtgggtgtcacgggagcacgaatgagccgctgtggcacgtcatcctctctcccctctccctcgtacatctccacctctttcctcatatatctccacctcttccctcactcttcttgtgggctctggcggtgtgacgaccagcaagaccatgggcagtgcctagcggaagatgaaccaaagatggcagcgaccatcgcaagtctcaacttaagagtgatgagcatgctctccctcctcccgaccacgcgccaaccatgacgctgccgccatcaccgccaccgcgccgcgccgtgctgctcgaccattatcctcctagttgtgcgtgcacccttatatctcccctcccttcccactcggggattctctctcactttcatctagtgcgtgacggagcgctggcggtacaccagtcccccagccccttctctagcgtcggtggcacactagtcccccaacctcctctttggcgccggtggctacctccggcccgggcccttgccactgctccctccctcgccactgccgatgggggggggaatggagatagatattagatagggagggggatagtgagtatgacaagtgggtgatatattttctttttaaaaaaaatattttttttaaaaaaaaatctctagtcacttacatatggaccttcaatttctactttgtgactatgctaccatatcaacacagagttgaccaagtcaacgagcaatgtcagcgaaaaccgttgagaaagtcaaattgtaccggtttaaataactagaggtccaaggtattcaagatcactaattagcgatcgatcgccccagacgatcatttttcttttcatcactttcccttttttacaccatatagtttttcttttggtaagtttatatacttaaagtttctacatctaaagtttacgcacctaaattttaaacacccaattcaaatttaaattcggatttaaatttgtagagcgaatatttataagtcaaaagtttatatagccgatttaaattcaaattcggattcaaataatttatatatagaatatttctatacataaagtttatgcgtgcaaagtttacggtataacctaaagtttatccgtttgtagagcgaatgtttataagtcaaaagtttatatacctgattcaaattcaaattcggattcaaatattatatatatagaatatttatatacataaagttttatgcgtgcaaagttttacggtataaagtctatgcacatgaatgagagtattagatgaaatttatgatgaaaggagggaagggagaggagtataaggggttgatctcccgcccatttggggctcggtattgaggttgtggagtacgattaagattggagccgtatttgagggagtcaatgtggacttattgcaagccagaaagccgacgtttccgcggagttctcaattgggcccacaacggcccatataacttggtccggaacgggattgcatggtaggagcggcccacgttgtgtgtgacgacgccgactccctcgacaggccgccgcagcgtggcttgccactacccccgcgcttcgctgtgtccgcttttccagcacagatcaaatggccgccacctccggcgagctcctcacccacgcaaccatggtgctctcgctctctccgattctccagcacaaaccgacggcgagcttgcctccttatcctccgatgtcggatttaagcaaaggcgagataaggatctgccatctccttataataaatagtactattagcatccatttgatattggcaattcggctttgtgtataacatcattggtgatgtggaatggtgacgctgtcagtcagtcagtcaaagtaatcaaccgcgtggggtgcttttatctcgtgaatctttcctttccaagatgggtggtgagctgcgcaatagattagagagttgggtgcccattatcattatattgtcattataaattcatccatcctgcaaagtttttcttgacgccgagcatgtcaatgggcaaaccaatcctcactcagtctcggtctcttcgcccgggtgaccgatagtggcatgttaatgcagctttagcttccaactttcagttagaaattgatcccacggcctcccttcaattttactttttttctttttgtttaacacttgtttagcttgcatatgttttttaaatatttcgtcagtacatagtcatcctgtagcaacacccagaatatgtgtacaaagtgctacctacggagtatttgacactgggaattcaacttattatcaacaattcttatctatactaacatccttggtgatgagacagtcaagtcatcaactatgtggactgtggagtgtctttattctgtgaattttcccccagccatataaacattccatggtctggtatgtccctcatggtccatctgtctagccgagcccggagctttactgaggccgtttttagttccttttttattttttttaaagtatacagacacacatttgaattattaaacatagactaataacaaaacaaattacagattccacctataaactgcgagacgaatctattaagcctaattaatccgtcattggaaaatgtttactgtagcaccacattatcaaatcatggcgtaattatgctcaaaagattcgtctcgcaatttacatgcaaaccgtgtaattagttttttttccacatttaatgcttcatgcatatgtccaaatatttaatgtggtgaaatttttgaaagtttgaaaggaactaaacacggcctgagtcatctgtacgcctgccagcccatatgcatgatctgagcaaccttgcaggctctgctgcgttgatggtcagtcaacttcactcaacaagtcactcactccagtcccagtcaatctaggtggcttacagtatttgaatgaatttgctatactattatataggagtattctccaaccgatccttcctctcggacgcagcaatggcaatggcaatgacgatgctctttagaatctgagtctttctgctgctgttttgcacagctaaggctactgatgattcaggagcagaaactgaagcagaagcactcctccgatggaagtccactttgatcgacgccaccaactcgttgtcgtcatggtcgattgccaactccacctgctcttggttcggtgtcacctgtgacgccgccggccatgtcactgagctcgaccttcttggtgccgacatcaatggtacgcttgacgctctctactctgctgcattcgaaaacctcaccaccatcgacctcagccacaataatcttgatggtgccattccagcaaatatttctatgttgcacaccctcaccgttctagatttgagcgtcaataatcttactggtacgatcccctaccaactcagcaagctccctagactcgcccacttaaatcttggagataaccacttgaccaatccggaatatgccatgttcttcacacccatgccctgtttggaattcctatctctatttcacaatcatctcaatggtacttttccagaattcatcctcaatagcactagtttgaggatggagcacctcgatttatcgggtaatgctttctcagggcccataccagattcactaccagagattgctccaaatttgaggcatctagatctgtcgtacaatggattccatgggtccataccacattcactctcaaggctgcaaaagctccgagaactatatctgcacagaaacaacctcacccgagcaatcccagaggagcttgggaacctaaccaatcttgaggagctggtcctgtcaagcaaccggttagttggaagtttgccaccatcttttgccaggatgcaacaattatcattttttgcgatagacaataactacatcaatggtagtatcccgttggagatgttttcaaactgcactcagctcatgatttttgatgtttccaacaacatgttaactggaagcatcccatcactgatcagcaactggacacacctacagtacttgttcctcttcaacaacacatttaccggtgcaatcccaagggagataggaaacttagcacaattactttcagtggacatgtcacaaaatctctttaccggaaagataccattaaatatctgcaatgcatctttgctataccttgtaatcagtcacaactatctggaaggtgagctccctgaatgcttgtggaatttgaaagatctcggatacatggatttgtcaagcaacgctttttctggagaagttacaacctcaagtaactatgaatcctccctaaaatcactgtacctgtcaaataataacttatcgggtcgttttccaacggtattgaagaacctcaaaaacctaactgtgttggatcttgtgcataataagatttctggtgtgattccttcatggattggggaaagcaatcctttgctgaggattctccgattacgatcaaacttgttccatggaagtattccttgtcaactgtcaaaactctcccaactccaactgcttgatctggctgaaaataattttacaggtcctgtaccaagtagtttcgccaacttatcctccatgcagcctgaaacaagagacaaattctcctccggtgaaacatattacattaacattatttggaagggaatggagtacacttttcaggaaagagatgattgtgttattggtattgatctttcaagcaattctctctctggtgagatcccttcagagttgacaaatcttagaggccttcagttcttaaatatgtcaagaaatgttctatatggtggcatcccaaatgacattggccatctacatgttgtagagtctcttgacctctcttgcaatagactcttgggtcctattcctcctagcatatcaaacttgacgggcctcagcaagcttaatctctcgaacaaccttctatcaggagagatacctataggtaatcaactccaaacactggatgacccatcgatttatgccaacaacctgaggctttgtggatttcctttgaaaattccatgctcaaaccattcaaattctacgagtacactagaaggggcaaaagaacatcaccaagaactggaaactctatggctgtactgctcagtaactgcaggagctgtctttggtgtttggctgtggtttggagcactgtttttctgtaatgcatggaggcttgctttcttcagtctcatcgatgccatgcagcagaaacttatgcaaacataactcatctgagtaatatgctctgcttctcaagttctcattgagtccacctgagcgtgtgtattagtgtcacattatgtcagcactgcaccaagatctaaggttcagtaggtattatccctttatttcagccatcgatgagatgtaattttctgttgccagatttggcttgttgttcttgtgatgatgaactcttgttactagcttttagtgtaagtcgggtagcatccttggtcagaaaaaaagaacatgttttggtgatgagaccaatttcctacatggttgtgtttgagatgaaagtagcatgtaagccaggaagttccaaataaagtagcatacatcatggctgtcttttgatgtatttgcaagctttgttattacctgtgcatgcatacagacttcatttgacgctaattcggagaattttgtcttattttctgttcatactgtaaactgtatgtattctgttttttttttctcatcagctataaattactacagcacacttcaaagcaaaagaacacagctttgccggttgcagcaacgacactgaacacaacaagaacacgcgcagcaaaatttctactagaatttcaccaaattcaaatgacaaaagtgaagaaatcgtaagaacaaaatcacgctatcccaggaagaattgcaaatcaactccccttttgatcagtggccgctgttcacgacagcgcagttcctcctgatctccccatcggagccggtcttgacctgcaccgcgcccagcgtcgccatcgaccggccgaacacctggaagaacacctccggcgggctcgccacggcgccggcgatgtcggcccgcgccgccgcgtcggtgactagcgcggcgtcggaccggagcaggccgcggtgcttgagcaccgcgcggtagtagccgagatcgaacgtcaggtggctgccggggtccatctccaccacgccgtcgccggccgtcctgcacttgcgctcacgcaggttggcggcgtaggcggcgtccagcggcggcgggtcggtgttgttgccgttggcattgccggcgccgccgccgccgttgtagaggcggtcggcgaaggacgagcagtgggcgatgccgatggtgtgcgcgcctgcgcgatcggatgcaatttttcagaaatcattttacacccaagaattcattgtgataatgtcacacatgtgtccttaactcctcattcttgcacaaaatcatgcttgaatttttatgatgttggcttgctgtagatcgccattttctggacatgaatcgagcatccaaattttcggttgatttgatgctaacttacgagattatataaatctatttatttcagtttatttacattggtcataaatcataactgtagaaattatgacattgctgaacaagttaagtcagttcaatggtagataaaattgactagtcatcaacacgaactgacagatagaaagcaactattattcgtgctccttttgcatgcagacatgcagatgcctagtcagcaaacaaaggattggaaattcagacacaaagctttcctctctgaaattaatcttacagcttctacattatgtctcccaccgacagtgcagattaattacatgctaatagtgtagtttggatctgattaactagagtaatctgtttagtttagctgataactgagattaattacatgctaacagtgtaatttggacctggttaactagagtaatccaagttgtttagtttgtgcagataagtggtactaagtatcctcggtttcataatataagttgtttcgaattttttttgtcaaatttcttgaaaatttgatcaaatctctacaattataaaaattaaagatatttccgcgatctgttatctgtgtttgagtcggttttaattttatattttgattttaatctataactctatctcttgtctactattataaaaattgaagatgtttttaccggtactttggtacgtcatctttgtatgagtcgatttttaagttcgtttgcttttggaaatacagatccgtatttgagtcaggttttaagttcgttcgcttttggaaatacagtcatataagaaatctcaataaaaaactcacatgctaacttggcatgattttctagaaaaatatatatccaagcgaattctcacggtgaatttcagagtgaacaataataagattaaaatagacttcacccattacaacgcacgggcattttttctagtttataaaaaaaatataacactcataacaccaaattaatttcattacatctaacatttaacatattttgataatttctttgttataggttaaaaatattgctatgtttttcaaacctaaataagtttggcttagaaaataatcaaaatgacttataatatgatgaaacgaggatagtaattaataatgtgaattaatgaattcgttcataatcgtcacgtacctgacagccagacaaggtcacgcacgctgaggcccttggtggcgaacaagccggcgagctccgggaagctcatcgccggcgaggggatctccgcgagcgcctcctgcatgctcgacaccgtgccatccctcctccccgtcggcacgcgccacgacggccctccctgcagagcatgttcagcatcgtcaggctccggccagtgcgcgcggcgcgcggcgaccgtggcgagcgctcgagagcttacgatggcggcgacggcgtcgcgggcggcgagcgcgagaacgtcggcgcagaagacgacgcccgggcaggccgcctccacgaggcccttgacgcggtcgatgaggtcgaaccctcgcagcgtctggttcggcgccgcgtccttctccgccgcgccgccattgccggtcgagttgaggaggatggacgcgtcgcagccctttttgacaaacgcacaacacattccatcaaacacattgcagacattgcacgcgcatcaatggcggccgcacggcgcggcgcggcgcacgtaccctgacgaagcagtcgtggtagtgcagccgaaggagcgcgacggcgacggtgggtacncggccgacgtgctgccggacgtactccccgacgatccgctccgccgcggggcagctctcgtcgtagaaccccatcctgagctgcgcgcgcgcgccgccgatcacgccggcgccgaggacgacgatgaccgccactccgagccggatcaccgccattggcacgccgcccgcgcgtcgcctcctcgtgctcgccattgccgcccactcgactactcaactcaacttaactcaactcaaaacttgtgaagtgaaccgcttatatacactagtatttatagtcctgagcttacttaacagacatttcttcagagagtgagattacttcaaacttagttcgaaatctattttttgagagaaaaatgcagtataaaaagctgatggactacttgcagacgaagccgaatccaccntgaaaattcaaagccgg

SEQ ID NO: 49216 - DNA, 1167 bp, Oryza sativa
  unsure (1)..(1167): unsure at all n locations
nggcctgggacatttttggaatggaaaggtattgtcattgctgataggttgccggttgggaatttttagtgcccccacggcaacaggggtgatcgggattgtttaatcatgcattcctggtcacaattcgcaatcacattcatgtggaataaaattgatgaacacgctttgctgagaaaaaggaagaagagtgaactaatacgtttttcaatttcggtgtatacattataagctttatattaccaaggggcaagggaaagtttagtaaattatcgcgtatggcacagccacggatcaaaaacaatgtgagctcaaatgctatgtctcggaaacatgtccacctctccatcttctatttgtgttccaatgcttatgtcaatcaatcagattttggtgatgcacgcatcagagagaatttttcccctagccgtgattttcctttctttctaacggttttgaaattgcaagtattggagtatatcatcattctactattatcttccaatgctacgaaatagagaaatcaagcagcgaagaaacaaaaagatgttacatgagatgacaaattaaagcccaattacctcgaatcatatatcaaattgaatgtcgcaaagatttcaacacacgcctacagcgttctgaaaagaaagcccaaatgctcatagtggctccaaatataaatcaggacagcatagtccttccagcatcacttccctccagaataatcttttatatcccataggccattgcaaagctcattaagataaaagtaaatgacgatttaataagaatatgcagcattttcaaacttgcaactcagataaaacatcaacaggaatgagatgcaaatgagcaaattgagcacatatttaggttcaaatccaacttattcataaagcatactgctgtcccacaggaaactgtttcataaaactaacatatcatacggactcgatggtccattaaaccagacacaagtagacatcagccccacaaatatttgatgaacataggctcgggccgaccaggcacatcggcagctccaccaaactggctgataactgaccaccccgaaggcggagcaccaggtggagggtgcactccttctggatgttgtnnnnnnnnnnnnnnnnnnnnnnngcacatcaacggaaactcaaccagggg

SEQ ID NO: 49217 - DNA, 10251 bp, Oryza sativa
  unsure (1)..(10251): unsure at all n locations
cgcgagtgagacntcacattgttacagtagctcatcatcgagaaaatttcacaaaactgcttaggctgtgttcttcccccattttcccaacccacctctcttgttttccgtacgtatgcttttcaaactgctaaacggtgtggtttatataaaaactttatgtatgaaagttgtttaaaaaaatcatattaatctatttaaaaaaatagttaatacttaattgatcatgcaataaaatgaactttgttttgcgtgccgaggaggaggggttcccaaccccctcctccgaacacagccttatttggtaacggatttgctaaaataactactcccaaaacttccaaatttgtgaccatcggatcgtcctacgatttgtgcatgaaggaaaaaaaatttcacacatatcacacgtaagatcccaatattagctaactaaaccatagttgaatgcaagttttatataagttgttatatctgaaagtttttgactcaaaaaatttgtggcaattctttagatactccctttggcaaacaccatcactttgtataactttagctggctatttttcataaaattgtaactttagcaacggaatttatcatataactactaatttatcccctatgtgtgtaagactaaatatagcaaatacacccgccagttctaataccccgcacacacctatgcaagtcaaaacattttgctctaacacccacaattgtcatgggtacaagatttcctccgtacctggatccaccaccgattggaatgggaaatggtaagagactgatgtgaaggagactagagatgtgatgagagtgtgactcctcaatcccgttttccctaccccctataaccgcatgagccccgctacctcccttgtcttgtcttggtcgcatagcaactcacgagcataatgagtcatgagtggttctagccgccaccacgagcactgccttttacttgcggtttgtgtggcaatggagaatattggtaggattgataggtggttaggtgagatgatttcatactaagatttggtcttaggccactgtaattttttttcgctagatctacgagtgttttttacccatggtagacgggacgggtgctcatagaatggacccaaactcatctacctgatgggatatagttttgcccaacactatacacatgattataagaactggactatataaagctactaaaagagtaaaaacctaccatggtcacgggaccacatttctagtatgacatatacccaatttataatggacagtgtatgtggacttaaacttgtcacacaaattaagttgtatctttctttttgataaaaccatacactaatattgcaattctttaaaatacgtggataacattgtagcaaagtgatagattgataaaatagatccagttttctgaaatataccatatcctactaattattttttcgtctttagggtgctgaaggttttggtttccatcacacggttgaaaatgttttggctttcaaaaaatgaaaagaaaaggtttgactttaaaaataaaataaaaatatctgggaaatgacacatgtggggaggggtcgggatatgaatactcttaccaaagaaaatagaatctaacgataggctgagttcagaacttcagatttgatactgaatgttatagcataatagcatgtatgaagtttcaaatctatctatgtgaatgtgattatgtatgaacaatgcctctgcaaatgggactttttacatggtctcgggcgaaaaaatataaaatatctaacataatgtatgtatcttagtatctaagattgtatctatcttcaatcattagagtctgagctatcaaaatgatgatccaaaacagcaggaaactgttgctcctgaggatttgactgggatgatgggttattagagttgccattggcttgagatttatttgttgccttcttttgtgaagcaccaacctccttgcatgccttatctagcatcaccagaaaatctcttacaatgacgaacaggcgaaaaccgtcatctttctcatcatttccatggaaatatcgaatcgttctcttcactaacatcctcaatctcttgtcttctttcaggagaaaattggtctcagtctctgcatgttctatgaaactttctaacgagcggtggaatccactgttctcttctagcgatgccatgtcggagttcaggaattctttggctctcaataattcgtgtcgcagatttgccacacttgtagacaaagcatcagcatccagtgctgctactctcttgacattgtccagctcattactaagccctgatacaatcttaaggccaaggttggagtagtaattgccatcctcctgtagagattcattggaattgtcatccgaagtactaggaaatggtggacttcttccattttccatggcgagtcttgcttcgcgaacaccttcagatcgaatgatctcttgaacaacaaagtgcagcaatgtggtcttcccatcagctcccttgacatctgataacttaagaagagtgtcaagtttgaacgcgttagcaccaccacggaacgtcccatcattcaaacgatttccagttttgagaatggcttctagtagtttcagaaaaaggcggtgcttgagttcaccgcaagcagcctggcacaaacagataaaaaactgaacacttggagaaaaaaggttggaatacttcgcagatttaatacagaagtcaactactttcagatggattacctccaattggaggaatgattcccttagacttgaagcatcttcctgcaaagaggacatgaaaagcaaagctctaatcctctcgaaagcaaaaggaatatcaattagtgccttcatcacttgttctgctaggcctagctgcgagcagtccccattataaagcctgagtttctgttcctcctcatcagtcggtttcatcctcaagattgtctcaagaagtaatctaggaagttcattcccttcataacataatgtgacagaagacaatgtcagaagtatattgaagtgaaccagcacagcatcaactttgtgtgtactacttagacctcaacagctacatctagtgaacaagagaacatatgatatagtaaatgaccaatgcatacacaatatgaaacatgttttcactgtgattgcctgatatgaaatgagatgggccacaatcacaaagacagacaagaaactaaaagaggatggccacaaatacatgtgcttagaaatgcacagtatatagtttaataagtaaacttgctatagttgcagtcgaattcttgtatcagttaaatagaatgcaacgagcattccattttttcaaaaggctcatttataagtgcaatgttatctttggcggtgcaaacatattgtatttacagcgataatggaaactttaggagctttttttttttttggcaaatgggtaagtaggctgcatgtaaatatatgcaatagttcaactaccttcaaccagagcatcatgaatttcctctgccctcacattcattgccttaaaaacaactgccagattgcatgatttcttaacatcaagaagagaaacatgctgaggtgaaggatctgcaatggaaatttccttgtccttgacattgttttggttgccagcaccataaccaaacaattcttctatcatctcctcgttcacactgcagaatgcagtcgtcagttgcaagcctaaatgaacttagaatacatgccattgctaaatttaaaaacttactgaaaagaaccaaatttgatgtcatgccaggccattgactgatcaggattagcaagaactttatcccaatagaaaggccggagcttggctcttggagcattcacctcagtttcagacgattcactggccagctcgcttgcagatgactcttcagaacgacttgactctgtaggtgacagcttaggaaatcttgccatggtggctttaggaggtgcaggtggtggagcacccttcttgataggtggaggcggaggaggtggacgcggaggaggtggagggggaggtggaggtgtaggtgaagaaggtgggggtggctgaggcatcagtttaggggcatcacttgtggcattgttctcctgtgttcctccagttactagtgtaggtgttgtggcatcacttgaggttttaaaacaacatggaaagcacttgctcatgcttacaccagcattggatggcctaaccccatgatcatccttatgaagcgggctggcaggaacatgcacatcaggtgacgaacctgccattcaaatgatagatgatatactaccataccaataataatctaccatgttgatagaagggatgtatcctcaccaggcaagttagagaactgcaagtgaagaagaggatggtcatctcgttgctcgccaaccgagaccttgcttttgttgcatccacagcagtagaaacatagaaatgcagctaggaatgagagtgcggctgttggaagaacagcgatcaagactactttcatgtagtcatgatactcctctgaaggtgaaactggaggtgccactccctgatgcttgtgtgcagatttactgggataatatgggctgggaggttccatgttcagagagttggaaggtgtaagtggtgcctccgccacagagaggggagagtgaacttcaccgccagaggacatggatggtgcgaaagctggagccatggaaggagcatctccgatcagtttatctaccaaacgccgtctcggatagaagtttgaaccgaccaatgatttctggctctcaagatagttgctcagtgcaacactgaatatttgtggaacacccaggctgaagcagtttgcacggatacattcataagtaaaagaagatttctcaggtggaagaagagccataagttccatgaacagtgttgccttcagttcatcttccgtggaatgactcgataactcatcccaggcaaatgattccccaaagccaaatgtatcctctgggctaactatgtcttgtaagcaaactgaccatattttgtctacctgcatcacagtaaggattatttgttaatgcatcaagctatctgttaaattgttctcatataatatatatgaactaagtaaaatttactgctcatcctgattgactaaagtgagcacaataaagatcaagaaacaatcagtcatatttctgttataacgaaatatactaaacataacaacggtaaataacaaaaaaggcctgaatgcctcactttcaagaagacaaaatggaagtcatattcgaagttcttggcagataacaagtccaaatcaagcaaagtaaactagagctattgaatcgattacttctatctagcatgcaaaggagaaggtttatggacgccttacgagatccccactgagaaccaacgaagaggcagctggtccagaagaaagatggcgccgccatccatagaacttccccaacttctcctcccctcctcctcctcctcttgacgacttcaccaatgcagatgccgccacaagcagcaacagaaacaccactctcttcatagccatcttcccccctatttccctcgaaaaaggaccatctttttttttgccttcaaagatgaagaaatctttggggctgtgcaaaatgagatttgctccaagaaatggccgcggagaaggatgtgtatctagaaagagctcagtgctatcttagcttctccttctccaggagtcaaatcctattgcttcgtttaccactattcattaatcagaaaggcaataaaagaatcgaagtcgtagatactcttactttgaaagtcacacgagttaggccacactgatggctcaggagtcggcaaaggagaagaggaggtggtgactgaagcaagtgcacctgcgtctgcctgcaaagatggaatttttttatgctgagagtgaggtctccctctatctatgcccattattagtactcctattttttaattaattctttagtaggatcggatttagatttcaatgcgattattaaccatttccattcgtgtcgccatgattaataatctcttttctttttgttttcttggtcttgccaaatgcataggaaaaaaagattcggcaaaattccaagtcgacgcagtagaagcagtggcttcgcttggagaggagaaagcaaaagaaaagacgtggcctttatctgttcggcgaaggcgcactcgagccaaaaaaaaaaacaaagaaaaagcgtagaaaatgcggtgctcttgaggtttcgcgccgaacttcactgcacccgtcaccgcgcggccgccggagacgaccttcttcttcgccgncgncagcctcgccgccgctgcacaccgacttgtgggccacgaggagaaagcccaccttgtcaattgggcccacgtgggctacggcccacccaccaggctcgtggcgggggcggggcccaccgggcggcatgacacgttgcgctgctgtgagctgagctgagctgccggcgacgacgacctcctcctccgccgccgttgcctccgccggcctcgccacggccacacactgacttttgtgccacgaggagaaagcccaccttgccgccggtgggcctcacgtgggctacggcccaccaaccaggcccgtggcggcggtggggcccaccgggcggcacgacgcgttgcgctgctgtgagctgagctgccatgcgaacgtggactgtgctctggaggcatcagagaatgtggctgcgacgcggagcggagatgccactcctctactaaaataacccaaaaaaggtaattaaaaaataattaaaatactaatagaactgtgcttgcaaagaggtcaaagcccagggcggctgcgctgtggctacgccggcttggattggagcagacttcacctgagtattcgggatccccgcctctcctccgcggccagttcatctcgatcaggttggtagtattagccttggtgattgcttggttgtttttcatgtggccgcaaagagatccgctgctgatgcggtgcttatgcggtttattggtttggttaggttaatcatggctatgatctctgcggttaaggcctaataggggtaaattgtttgcttgtttgattggtttatggctggatttgtagctctgtgtcacggtgaggtagggtttggggagctgggtgttcgccctagtatgacgggttctaccagggattgataaatgaatggattctgcaggtttttctttgttgattcctttataggagtagcctagattcctagaacaccagatcaatcgtcgtgtgatcgaccttcttgggatgaatcactgcttagtttcgtagtccttgtcattttggagtatgttttgtttggtgtgattttatgtttcttaccaggaatgcttggtgggtattcaaagtatagtgaaatggggaatcctgaattttttttactaaattcgtaatgctatcctaaatttgggaatgtgcctgtaaataacttttattactccttaatataaagatacgctccttgcatatataaaaaaagaaatgtgaatgcgcatttacagtgaattattgttttcaatttaggttacctttggacgattggatctacatttgcgttatatgtttgccctgattcggtttgttcattttctgttttgttttcaacaggtaacactagaagatatttgtccttgaaaaagccaaattatgtgctagtgcaccggaaagctttgctccaactgtcccgttgagttcaaataagagcagtgcctgcatgctgttataatgatttttttctgtaccctggtttctgaaccactgaagatcggggcattatatcttttatggacacgaccttggtggtgatagtgttcatttagtcatttataagctctcccttttgaaatatattgttctataagtagtgcctagaggattttcttgatatagattgctacaatggatgagagaaggacaatttcagagcgatatccttagacatctatagtgaaagaagaattgcttagtgaagaattctttatccacaatatatacatacatacaataatgaaaacatcagatacatagtatgacgtttacataggttaatagtacatactctaatgactatcaagtcttacaactttataatataagggagtttgtacttatctacttattacaaccaatattgttttgacaaactataggatatcaatataatgtcttaaacacactgagattaaagcagctttatctctaagtgggacgcactgagattacaataaatctctaagtgggtccgttgagcagtattcgatgagcatatcatctattgcagaaagcgcagtggtatcctctgggagaagaacgagggtgttctctggttcaataggagcctagtgagaactttcaacctcaggtctttcttttgtaagattgaagtgagcttcaaatcttagttcctcagaagactttttctcctttagggatttctgatacaggagaacaagatgtttttgagatgcggcaatctttagtgacatgatagtcagatacacacctgttgcaatgcatgttgctattgccacgaggttgtggtgccttacccttcctatttcctttctgtcgaccattggatttgcgcctgttgttgcgtttgcgttttccagtcagattcgtaggggtattcgaggaatttcccttaaatccttttagtgcgatactattggttcaatatcttgtcctctggaaacatagttgatagagttttctctatcttctctgcttccgttggctcttatcgcaaaatatcaacttggagcaaatgttatgtacaacatgattgtattcggccacagtttaaaatcctgtaggcgtaaatgaatccactcataattagcctctggccaaatgagttccttttgctgatcataacgctctattagagctttccataggttgagagggctcgtctccaacatgtactcatatttgagatctttatagatatagaacctcagaaggaaaaaggtaatatatagttttctgttctcaactggtggatcccaatcattgggttcttaatctgtatgtgaaatcccactagaagaaaaatttattttgatatcagaagcccaaattgggtagttactcccatcgagggcgagttcggtgaactctatagttgccgtgtccctataatcatgattaacactattaatttacagaggtaaattaataaaaacatgatattgaggttgtaatctcaatgcgaaatgtaaaacttcatatcttgtaatgtttcgaaaagatgtaggttatagacctgacaatttgagttaggatttgaaattaggtggcacaatgtggataatctccaagtaattaaacagtggagtagatctcttaatagtgggcaagttatacttgctgcctaaaacatggtctccaggcaaatatattctggtgaatataccgcagccaatgtttaggactccactaccttgtgttcaatcaaatttcaaataatctcatttttcaaaacatatgctcggaaaataacacatgtgggtaatcatcatgagatgtaaacctctgtgagatgagcgagatgctcgctgcctaggttataaccagtgcggccaatttgtagggctccatcgggtaatcatctcaaaatgtagaccacttgatgatgagcaagatactcgctgcctaaattatggtcgtgatgaccaaagtataggactccatctacatgtgattaatttccgagtcaaaatgtgaagtggaacatgcattaaatcctccattaatcatgttgcacataattaagagaatttgctaaatcaaagtacaaaatttatagaattttataaattaatgaagcgagaaagtagagtgtgtcttgaaataatatgcaaaaggcatgttattaagacaacaaataaatttagtgaaacggggtatttgaataaacatctatgttaattaacacataacatcagtgatctataggaccattacataataatgtgaacaactgatgaactggttctattaaatgcataaaacatagggactaaagggtaatggctgctaaaaataaaaatttaaaacaaaaaaaggggaaattggtggggccccctctctctttcaaggggggcgccatattgattatttttcctggcagggaagcaatccccccattctatttataaaaccttggttgggggaca

SEQ ID NO: 49218 - DNA, 32591 bp, Oryza sativa
  unsure (1)..(32591): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnacaccgaacagtactaggcgggcccatttggccggcaagcaaaaaaggtggggaaggggcggggttagggttagaatcctaaccgccccagcgagatttccgccgccgccgccgccgtgcatatcgccgccgccaactgccgttggtccgccgtggggtgcgccgccgacgccgccgtgggtgcgccgccgttggggggcgccgccggttccaccgccgcctcccgcacccaccgccgccaccttctccttttgttacgccgccgccgccagcctccgccatccgccgcccaccaccgccagttgggccacgaggagaaagcccaccttgccgccggtgggcccacgtgggctacggcccaccaaccaggcccgtggcggctgtggggcccaccgggcggcgtgatgacgcgttgcgctgcttagagctgagctgccgtgcgaacgtggactgtgctctggaggcatcagagcatgtggctgcgacgcggagcggagatgccactcctctactaaaataaccaaaaaaaggtaattaaaaattaattaaaatattaataggctgtgcttgcaaataggtcaaagcgcagggcggctgcgctgtggctgcgccggcttggattggagcagacttcacctgagtattcgggatccccgcctctcctccgcggccagttcatctcaggttggtagtatcagccttggtgattgcttggttgtttttgatgtggccgcaaagagatctgcagctgatgttgtgctccctgcggtttcttggtttggttaggttatttgtggttgtgatctctgcggctaaggcctgagaagggtaaattgcttgttagtttgattggtttatggctggatttgtagctctgtgtcccggtgaggtagggtttggggagctgggtgttcgccctagtatgatggattgctctgctaccggggattgatgaatgaatggattctgcaggtttttatttgttgattcctttatcggagtagcctgaagtcctagaacactagatcaatcgtcgtgtgatctacctttttaggatgaatcactgcttagtttgtagtacttgtcattttgtcgttttggagtatgttttgtttggtgtgattttaggtttcttacaaggaatgcttggtgggtattcaaaatcatagtgaaatggggaatcctgcaatttttttactaaattcgtaatgctatcctaactttgggaatgtgcctataaataattttactctttaatacaaagatgcgctccttgcgtataaaaaaaagggaatgtgaatgcgcatttacagtgaattattgttttcaatttgatttacctttggatgattggatctacattcacattatatgtttgccctgattcagtttgttcgttctccgttttgttttcaacaggtgacactagaagatatttgtccttgaaaaggccgaattgtgtgctagtgcaccggaaagctttgcaccaactgtccggttgagttcaaataagagcagtgcctgcatgctgttataatgattttttctgtaccctggtctctgaaccactgaagatcgtggcattatatctttgatggacacgaccttggtggtgatagtgttcatttagtcatttataagccctcccttttgaaatatattgttctataagtagtgcctagaggattttcttgaaatagattgctacaatggatgacaggaggacaattttgatggatcgctatgaaataggtaggcagttaggacagggaaattttgccaaggtatattatgctcggaatctcacaagcggacaggccgttgcaataaagatgattgataaggagaaggtaacaagggttgggctaatggtgcagataaagagggagatttcaataatgagattagtaaagcatccaaacattcttcagctttttgaggtgatggcaagcaagagcaaaatttactttgttttggagtatgctaaaggcggtgaacttttcaagaaaatatccaagggaaagttcagtgaagatgttgcgaggcggtatttccatcagttgatcagtggtatagactactgccacagccggggtgtttatcaccgtgatttgaagccagaaaacctacttctagatgagaatgagagcttaaaagtctcggattttggtttaagtgccctttctgagtccaagagacatgatggcctccttcataccacctgtggaactccagcttatgttgctcctgaagttcttagtaggagaggctacgacggtgcgaaggctgatatatggtcttgtggagtaattctgtttgtgcttgtatctggctaccttcctttccatgacacaaatcttatagagatgtatagaaagattgccaaagctgaatacaaatgccctcgttccttttctgctgagttgaaggatctgctatataagatacttgatccagatccaagtactagaatttctatcccgaagataaagagaagcgcttggtacagaaaatccagtgatgtaaatgcactgaagagcaaacatgaaacaggagacaaggtgtataagggtgaagccacaacctctgacacaacagaatgcagtatttttgagggaaatcgtgcgtcatcaagagacaaagtgtacactaatggtgaagccacaacctctgactcaccagaatgtagtaattccgatggaaagcaagcttcattaagcctcccgaacttgaacgcgtttgacatcatttctctgtctaccgggtttgacttatccaatttgtttgaagaaagatatggccggagggaagagagatttaccactaggcaaccggcggcagctatatttgctaagctaaatgaattggccagacgcttcaagctcaaaattaagaaaaaagaaaatggggttctgaggttggtagcaccaaaggaaggaataaaaggattacttgagcttgatgctgaggtttttgagcttgctccatctttccatttagttgaatttaaaaagtccaatggggacactatagaatatcaaaagctcatgaaggaagatataaggcctgcacttaaggatatagtttgggcatggcaaggaggtcagcaccagcaacctgagcaatctatgcaaggaatgcaaggagagcagcagccgtcacgtttaccatcacagcagccacagggctaattaatccgctacattgccgacaaaagccaggacaggctgccaacgcagttgccgcctgtaaaacatgtgaccagttgcaaataccacgaccaggtttacaatacaacttcagctgcagagcttgttccatcagaggccagagtcacaacttgttcacatacattggatcgttgttcaggtttaccctgttctagtttctccatttcgtaccatttggcttaatttttttgttccctagcttctttacatttcagtatttcttctgataattgtatattccatttttactaaggatacaaagtatatatgagtcaattttggaacatgtatatatgagtcaagcaactgtgcactacaggagtttgtttcagtgtaaccaacgatgttggccagtccaaatgtaaatttttgcatgcaaccgataccatatttgtagattgttgatggcgaaggcggcctaggaagtagataattattgtaatgtgattaaccttttgtcatcaagacctcttcacatacaaacaaatatctgggcaaattctgggtaccaaatctcactaggattcagcatcatagtctaattcttcatgtttatcattcatgcataattttaggatctaagtgacagtgtatgttcatatatgtgccaaacagtgaaacaggatcatcttctggtgcatcaaaaggaatttctttgctatgtgaggtgttcaaatgatgcaccattagcttctggccatctataacttacctttcaactaacagtcctttttccccctttttgagggcaactcgcagtcttttttttagatgaactagcagcctttttagttttagttactttctttggctgtgctgggtgctgctgacacttccatgccagagatatcaattgtcaataataacgtttgagaattttcttttccccttctggattcgttctgatattgggactatttgtaagtacttgaaacatcctgattacaatgggcacgatttgtatttggaccatagtatacagataatctgaaactttaaaactagtatattgttcagaagcctactttagcatacggctgtttttatttgttgaaaggaaattcgtgtaaattctcaacagataagtacaagctcaccaattctgcatcttccatgccctggtggcaatagcgagatgtttgcacattcaaatttggagttgtagttatttatcatttctgtgtactggacccaagactgaggtatactgcaaatccgcagttctgaaatctgtagagctaacttttctgtgggaagaaaagaaaagaaggtctttggagctaattcctcctggatgaggaagatttgtactacacgcgaagcaaaataatctcactggcacatgattaattaaatattaactattataaatttgaaaaatagatttatttccttttattaaacttctatatagaatttgaaatttggagtcgaactactttttagtttgataactttatagaaagatatagcagcattttcaacacaaaacaaatacacaataaaaatgtattcaattgtggatttgatgaaactaattcggtgtggttagatgctgctatatagtactccctccgtttcaggttataaaacgttttgactttggtcaaagtcaaactatttcaaatttaactaagtttatatataaatataataatatttataatactaaattagtttcatcaaatcaataattgaatatatttttcataataaatttgtcttgggttgaaaatattagtactacttttctctacaaacttgatcaaagttaaagtggtttgactttgaccaaagtcaaaacgtcttctagaagagactatatattttgtgatcgtggtcaaatttgaagaagtttagcctatacaaacccgaaacttcaatgcagcgagtaccacattattctgtactcctactatcgtattcatagttttacgtgttcgtttgcgacactgcttgacaaagtattagtactaggctactagcactatcaaagagattattgataaagattagttagcgcatgtaaaacggaagcatgattagttaagttccaattactacaaatttgacagatgaatatatttgatattttaaaacaacgtatatatggaaagttatcgtacaaaatacattgtttagtagtttaaaaagcttgctaacagaaaccgagataaaatcatctttaatcagaaaaggacaggcactcatattctgacttgcaaattgtaatgcagtacagtttgtagttgtactgctctatagtctgtacttgccgtgtccgcccaggttcaggacggtcacggtcatgctgtactgcctgcctaaaacttcatcgttgtattggtcaaatcatctccacaactctgaattattggagagaagcgtatgcatgattcttttgttctgaaaaatgctgcactcataagaaaaatcccatttttctgtcaagtattacatgtatgtggaattttagagagctcatctaaagtctgaactctgaattagtagtacgtactacctgatcgatcaggacgtgacaaagtacaacacatagaaattagtacaatccgaggatgctgctgcatcccatggtagtacaagcaacaccgttaggcacggtgcagatgcagtagtacaaaaggaggaggtgacctgtctgaaaagcaacacacacacacacaaatgcagtgcagatgcagctacacacgcacaagcatggaagctgcctagccaagtgatgcatcctgttcctgggattagagatttagagctaggaatattggcagattcatgatgagatcgatgggtgatggaagagaagggaaggcattattgagtgcagcgttgatgaacctgccggccggctaaattaattagcaagaaagtctgaaactggctcaaaggttcaccagcactgcacccaatcacgcctttgctctctctgaggggaaattaattagtttgtgctagttcatcagatgcacacacaatccatatccatatccataaatcttatagtactattagttttcaattctcattgtagattcgacaaagttcatatgagaaccaggggatggatgcagggatgcatttggtaagttagctctcttcactctcacaagatgcgttcttgtcccaggtttgtagctttatcacatcccttcttgtcttcaaatactgtcatctcgatttggtaattagacatgacaaaactgaaattaaggcgctcttgacttgattagtactcctttcatctcaaaacataaacataagacgtaactattttttcagatgtcttataatacaagcatgtatatatccatgcaattaactaacatattctctttctctttaatttggttttttaagtccagtctcaagatctcaagatggtactgatttttttttccaaaattagtaaatgagaaaatggagggctacaaggactccagtctactctcgtacgaagttgattttattttcggaacagagggaataggaggctagctagatctccatgcataaggatgaagatacatgtaagcggcagaacattttcacaaacgggtcgaatctgcactaaactggacatgcagatcacagagacggaagatggagcacataagccagcgatcgatcgagatgccacacagcttaaagaagagagaagagcactacactgcacagagatcagaggaagacgacgagacgagtggcatatgttcttcaggaagatgtgagatgagtatatataatataaatcagttggggccccagcagacgaggtggtggaccttgcgcagcctcacgtcggcggcctcctccgccggcggccgcgcggcggcggcggcggtgttgaaaaggggggaacgcagcctgggcgagaaggcggcggcgcggaggtaaagggagcggagggcgtagtcccagcggcagaggcccgcctggtccttgagcgcctcgacggcgcccatgctcgccgccaccaccagcgacggcgccgccgccttcgccccgcagatcgccatcccgagttcccgacccggttactccgcctccgcctccgctcggtcacagtgcgcggcgcttgcgcttgctagtgatgcgaaggtggtgaaggcgtggtggtcaggggagacgccatgtttttatacgcgagatgagcggaaagcggcgaaacggggagcgcgtcgccgccggttttggacgctcactctgtttccaaggatgctgggcggtgcgagcctcactgcgaggacacggggattattgtttgttttcgtctgtccagaaatataaacaatttttaaataattgaaatatattttaatattgcgaataagaacagtatcctatatatatatatatctatataggtcatcccactaactacaattaaaactaatttccttctccaggagtgatccacatcacctctattccacctgaccgttggattgcagatagattccacctagccgctagattgcaaatgagggtgtaaagagcgatagtgggatgcacctcttcgttttttttttaattccgatcatcatgcacgacagtaattaacaaaggggcctattcaacagttaaaccgtttgttcctgacgggtcatcttctgattgaaaccaaaacgttggatattcattcattggctcacgcagcaggccttccatcttccactgcacttgcactgcatatattccatcctctagctaaatgaattaggtgaatactcggcctttattcctgattcctctgaaaacaccatcgcagtggattgacatgctgaccacaagccctcctgtccagagtccagttgctatacttgatcgttgcgatcaatccttcattccgttagccatgctgctgcgtttattttgccgctatatatatgctcatgctccagcggatcaacatttcttttagcaatttgttgttacttattcccttaatttgttttgtataatatgagtggaagggagtgccagttgagtttccctccaattaatggtaccaatatcgaagccatacgtttgaaaaatattatttgcaggctatgaacttggtacggttgaagattatttttatttgtacaaatattcctcacgcgcagtgataaattgggttaggtttttccttttaaggtgattatatttcatccaaaattttgacatttgtaattgcttaaatttccccagcaacgcgcggggtgacctctagtactacctccgtcccaaaataagtgcagtcatgagttttcactcttaactttgatcatccgtcttatttaaattttttttataattagcatttttattgctatgagatgataaaacatgaatagtactttgctcgtgacttatgtttttaattttttttcaaaattttttcaaataagacgaacgatcaaaattggacgcggaaaaccatagctgcacttattttgggacggatggagtattataatgtgttccgttttttaaagttattatattttagaatggaggaagtaacctgtttcagatttattatcattaaatcacgttctatattgcaacattttagaatgaagaaagtagaatttatttcacatatatgatgtgaaaatttcatcctcggtatttttttttgattgaacgaataaggtctaatgtaaactaataccatatccttacgttacaataagatgtagaataatatttttcactcctttgagtgtgccggttctttttttatggataataggagaggttaaagtagtaaagataatcgtgaaaaattataatagagttttacgtaaatatactatcatgtactattccaccaagaattatatttaaacataatctaggtaaacgaaaaagacaaatgttttagtttttaacgtgagttgagttcagcatatgtggctaggctaaatttgtttttctttcttantcttttgcagtagacgagtagtagagtgcttccaaaacaaagttcaaaaagtatcagggcatatggtgtgaatgtagattgtgtggtattttatgttctcaatttgtttttaccacagttatgtgagggtacgtagaaaaatgcagtttcagtgtagaaccattttgattttttgtaggatacttggtgattgagaatttgtaggatatattattttttaaaaaaaagatatttagcgatattgtttaggctatagctccacagcatgacttttaacctaaagactctcgtgagttcagaatctaaaagctgcgttcgggacatcggtttgatcttagccaacacttgaaacgagacaaattattagcgtatcattaattaattattaattattataaacttgaaattagataatttgtttttcaaaaaacttatatataaaaaactaatgtttcggacattcacaccttctattatctgtgccttgtctaaatctccatgaagatactgtggaatagaatatgatacatcaattagttgtccgaatccaactcattttcatccttgactcacatcctaattatgtttcggcaatgctctttttttttaatttgaagttgataattcatatttttttaacatgtataatcatagcgtcattcactatttcactgataaaaatcttctctatcatcatttatcttctcgatatgtgtttataggtggcttatagcattgtacctgctctaagcggttgtatactccgttcaagcttgtcgctggtcactagctagccatgttataggttaaaaaatctagattaatttcgttttaaaaataaaaatactaagattaattaactcaaattaactgttgtttcacaggccaatttgttgtccttcaaccttattatcccgagccatgcaatcaaatagtggaagtatagtagtttgtaggtgaacggtccaaatcgtatttatagctatgtaatctcacacgtatccctctctttaatacgatattgtgtatatctgagacgtaccataaatcaaacctcaacatttaaaatcactaatatatatacaaaacactaatatgcagtcatttttcagataaattttactaaattaataaaaaaaagactaggaaaaaagtttgtgtgttgcaatggggaaaggcaattttagttgtatatattaaaccgctcacatggatgactataacgaatatgttaataccacgataaaattatgttgtatagagtactaagtttttttctagcctagttaagtcatataatattattttcttgtattatataatttacatcgaatctttagcaagttaccaattttagtttggaattcatcttaaaattgaatgatacacattttttccgatcgtcacaatccgtttttgttcgtcgtcgtccttgtgtaccccgcgacgcctttatccatagtccgtgccaatgcaaataattcgctcgctttgactcccttcctatctatatggcaaagttggctatttcttacctactcaagaagatacttactcgagaaaatagccgactagccaactatgccgtatagaaagcaggggagtcaaacggaacgaattgcacgggaatggggtttggcagtacttcgtaagtatgtacttttcttttacacgcataaatatgtacttacgtacaggattgggattaagaaggtgggattagccggttgtttcctagatacataatctagtggtaactataggtccaccggtttaagtgaaaaccaatggttaatatttgtttttttcccttagaagttataaaatttctctaattattagatctacaagctattttttttcaaaacatacatgtgtcctgaattgtggtaatttagccgtctactctggcaaagttatcttgaattttttagactaattggatgatgtacacacagctatagtgttggttcattttctgtttttcataatcttaaattattgatttaatcatgagaaatacaattattgaaataaattagaaattaaatttgtagtttagcagctatggttattgctgagccaactacaccataaaaaggagaggagactttttaaaaataaatagagagaaaaaagaggagagaagtctagggacgaataggaggggatcgttggtggttcctaagtactactctcttcttcttcttcttcaaaacgtactattctttttaaaaatcacgaatattacggaagaacctaatattaaatagttagaatgagcgaggctttgaacccaggtcgaatattatagaaggacctaataatatcaaataattagaagatgtgaggctttgaactcaggtcgaatattagggaaggacataatgtcaaataattagaatgggtaaggcttcgaatctaggtcgtctagtccaccaccttgtgaaactagtcggaaaacccttgagcgtttctctacttttcttttacgcacgtacgtacttacacacatataggttaggaaggcggtattacctgaatggtagtgatatgcatccaggtttggcggttcttatacgtacttttcttcttctcctcttgatttcttcttctttttagcgaattacactttggatcatcttttatttttaaaattttattttgaactattatttactcagtctttttaatttggattagataagtttttctttgttacattttggaccatccgaaaccacttcttcaatacggagcacatcaacaatctcaagcacattggctctaacaggccagtgaactctcctacatataaccagatcctgttaatttatccagaaaagaggctacatgcaccctcggtcaaagttttgaagggcatttagactgttttgtcaaccaaataaacaagttgttgctttgacgtttaggatgacattttgtcaaacactataaacaacaattatatgttttaaaaagtttgtaagtatagtaggtttacggcaatactaatggtcaagatcttacgaaaagtttgattagcctttatcttacaagttaaatccttatgaccggaagcatacataccattactcctactacttaattctactaatttctattgacttgtctaactcaattatttacaccagcttactgctcatagcctcacattgtcaccgcaggcatagagcaaaggacgagactacaaggtactccagctcccacagctgtttccagtgcttagtgcgtcctggctgggacttgtgtcgggagatggattttcatcctccaagtagcggtggtcagaaaaagaccgaaccaaaaagaccgagaccgaaaaattcaatcctagaaagtgaaaaaccgaattttatttggtcaattcggttagtctcaccgaatagaccaaaaagactgaattaacaaaaaaaaaagtataaatgtaacatacaatcactatgttcaataggattaaactctatttttcgcatcctacttcttctaggcatacaacctaataagagtatttactcataagtgcttacattttttctgtgatttttgtattgaaaatttccattgcttctttgcgtatatgaaagtgttgttgaatttgggtcaggaccgagaccgagactgaatttgtcggtcctgatatttttgcattgaaatttgatctttactttttaaagaccaaagaccgagaccgaaattttcggtcagaccgaatgtccacccctactccaaacatctgcttgtttattgtatctcatcaaaatggacactgaaaaatttaagaaaaaaattataaaataaattaatatgggatatatcgtctcacaaaatgcaattttaaatttcacttcttcaagttataactaaaagaacatattaaattcaaacgagttaacgtaaattcacaattatatttgtgtttttttattataacttatagaagttgaatttaaacggatatatcttgtatgaatctaacttgttatttttctaactatttatgtgacatataacaaacaatggaacaaaaaccctaccacaacaaaaaccctgttcagggagcttaaatctactgtttgatagccagcttagtttgatagtcagcttcttataacctgaagaaacttggtttttcagcttaatacagtttctattttatttttttagattttacaattatatattaccagaatctgaatccaaataataatgcggactatttgggatagctaaagaatccgagagaacctgcagctggttaaaaacttctcttaacatgccctttaccggaagaacgagcccaaatccaaccactggttcattccggattggtcgagagaccccgtttttcaaacacgcgcattactccacgcccctttcccgacaccgaccgcccgcctcgccgcattcacgacctcccctcccctcccctggccgccgtggaaaattatacacccccgcgcgcaccggcgatcgcgatcgctgtacgcactgatcgccaagcgcgtggtgatcccgcgccgaggcgttgggtgcgggataaaaatcccgtctttgggtatctctcggccactcgattttggaggggttcatcaatcatggtggctgatatttattgctgactattattgcccctgttgattgcagtttgcaggaggtgactcaggactgggcttttcacactagccattttctgaaaacatattttataaataaatccttaaaaaacttaggccctttttagctctcaaaacaaaaaatttcacccatcacattgaatatttagatatatgcatgaattattaaatgtggataaaaactaaccaattacacagtttacgtgtaaattacgagacgaatcttttaaacctaattgcgccatgatttgacaatgtggtgctacagtaaatatttgctaatgatgaattaattagacttaaagaattcatctcgcagttttctgacgaaatctgtaatttgttttattattaaactatgtttcatactttaaatatgtgtccgtatatccaatataccaaccaaatctaaaatttttcccaaactaaccaaggacttaatctcttcgttacatattataaaaatgtagaactagagctatgagtctctccgagagagcggaaaggagtctattctaactatatagtactagtatctcatctttagattgttatattcaaacctgtagctcggtgacagaatatttcatctgttacatgatatagcaatcttgtatcatacttcctccgtcccaaaatgtaagtatttttgaggttagcacgggtattaagaaagtatgtgagaataattgaagaaggtgtgtgattggttgaaaagagaaagtaggtgaaaaagaatggttgtgattggttgagaggggaaggtaggtataaaaatagcttcattttgggacaaagtactgtgctagaaatagctacattttagaatgaaggtagtattggatatattttagttgtaagatatctgtccaaactcgtcatgatgctggaatgtgtcatattcagtaccatattatatttctggatggaaagattaagttttttttaaagatctatttataaaataaatgttcataaaaggctaaaatgtaaaattgtgtgtgactcatgaccaggagtagtgcagtggcagtataagaggctaggtgaggtggctgggagagagaagagaccggactgaggatgagcagcacgagctagatagcatagcaagaagggccaaggagaaagcggtggttgattcgccatgagcagcgggcgcgagagcaggtgggagctcccggcgacaatgcgtgcgctggcgcgcgacgccggccagcagctgcgggtaccccgcgcggccgcgaccgcggccacgccggcggcaacggcggggcggcgcacggcggacgtcggcggcaagacggacaaggtgatgcacctgctgctttgggggcccaagtgatcgatcgatgggcctccgccgcgccggccggccgccgccggcgggtcatcgtctcatctccgaccagatcacggctgtacaatatatatgtactagtactagctggctgattgctcgcttgctccgttctctttaatttcttatggtgtttttggtccagtatccatgcactgatgatgcttgtttgccgggtcagtctacaggggtttccaccgtttttctgtacatacgaatcaagtggttttcctcgtgaaaatcacatgcgttctaatcggtcctttttttatggagcaaaacttatgtatcatcaatcatgtactactaccttgtaaacttttgccttgagtttggggcaagtaatgatcagatcgtgtaagactgccacttttaattttgggtaatttttgtttggttgctaagattcacagaatcacaaataaccgcagacacggacgattctaggcttctaaacggtacattagttgatgtgaccatggctaccatggatgtgaccatggctaccacggatgcaaccattgctcacatcatggatgaacaagaagatatcgagatcaagtactccaagtgctggaatccgattcggccacctactacactgctgacttcaaacggccaccgaatctgcatacgacctccgttttcggcccgtgagtacttgatggaaagctctcggagccctctttctaacggatccagcctcttctctgaattctatctcgtgtggccagaatcacaggaacaaggtgttgcatcacctataatgggcctatgggcttgtaacttcatttgggaccccggcccaggtggggcccatgtggggtgcgccctaagctggtggagcacgaccctaggcacccctaggtcgtcctcccacccctatatatagctagttaccccttcagggtttctcgggttttgttagattaaagtttagccattgctacttgcttgcagcgcgcgtgtcggatagaccgtccgtctgcttgttcttcggaaccccaacttatcattcgtatttaactcctatttgcaattcagattgcttttatcttgttcttgcttgtttcttcgatttgcttgtaggaataaggttgatttgcaccggcaagatcaacaactcacggagaggtgtatcgatcgctaaggcgcaacgcaacgtcttgtacggttgtagtcgggtcgtcaacgtttcttccaaatcgtagttttcatcaactcaccgaaagatcgggccaacaacagccttgagtgtcgagaggaactcagggttcatcattagtactcctccattctaaagtaaacgaatctaatactagatctaataaacaaatctagtcctaaatctgaatgaaaataaatgaacctaatactagatctaataaacgaatctagtcctaaatctgaatgaagagagtatatgttgatttttgtaaaaactttcttcatcggtaatttttgtgaaaagaaatgtatacggttaaatatttaatttactcagctatgtcttgaaataattattataaactcagtttcacttataataattcatcctgcatcagctacaaacatgcctaccagtgagctgatttacgcacagttgtgtttgcgatggacatatgtgctccttattatacctcgagcatatgcaaacccttttttttcttcttttacagtcggattttttcggccctgttatttgtggcagatttttacttgcaaaagggaaaaggggctaagcaaaagcgaaaaggcggggatggtaaatatcttgggcttgggccgatttgtgatagcaggaacagctacataacgaatcatggaggcaatatctcatctcaccatctcctactctgagaggccaaagcccacagaaacaatgaaaagcaccaaaaaaaaagtaaaagaaaagaaaaggcctgactatacttaaataaattaatttgggagtacctatacatctttcgaaagatttttataatcgtatcacacatatttttaatctttggattaaaatccgatagatataataaaagcaaaaagcaattaagaaacactataatggacactaaattaccatatcctcaagaaaaagaccaaatccaatacaaaatttaaaatttacatgcgaagattcaaaaattacagtgtaacttataaaagttacattgtaagtttcataaattacactataacttacaagaaaatgcactgtaaatttgagtgagaaaatcgagtgagagataagaaaaaatctttcgagtgagatatagcaaaatcgaattaatttaggtccaatatttgcagtgtgaaaaagcaacatttttgtaattatttctatatttttttaatttaaatatattctttattcttacagctaaattaatcatccaatagaaattatgggctgagaaaattgggccagacaaggtctccatgggaaaaattgcagtgtgaaaaagcaacatttttgtaattatttatatatatttttaatttaaatctattctttattcttacagctaaattaatcatccaatagaaattatgggctgagaaaattgggccagacaaggtctccatgggaaaataaacttgtcatcaataaactgcggacaagctcaattgagagtactgatttatggaccaaagccccaaggaaaacaaacttgtcatcaattcttcatttacaaattaaaacaagctgacatcaaagtgacaaacttacatggaaaacaacaaacaaaatggtacacttacaacgacatgctatgatcagtcctactccctctgtcaaaaaaataaaaaaagacaaaccctaagtttccgtgtccaatgtttgactgtccgtcttatatgaaatttttttatgattagtattttcattgttgttagatgataaaacatgattaatactttatgcgtgacttacctttttatttttttcataattttttcaaataagacggacggccaaatgctggacacggaaactcagggtttgcctttttttttaagatagagagagtacataccagtagtacaaacaacatcagaatcggcaacaagtttaattaccaactaatcaatgagtgaacccatgctgcacccctagctatgaaaagtactccatctgtaaaaaaaacccaacctagtatctagatacaacataatctagataggccgcctgtccaaattcattatagattatgtcctatccaaatactatgatgagctttttgatgaagagagtatgtgtattcttctatcataatcaggcaattaatcaattagcttaactgaaatgatagatcaatcaatcaacattgttcatgttagctaagcttttattctcttctctttttcgcgaacgcgtaaaagctttgcacgtcagtatattagtagagaactctagctcatctctagggctatcctcttcctcatctcggcgccgccgcggtcgggggagtcgacgatgaacttgcgccagaaccagtgcttcctccagacgtgcgccacctcttcgagcggcacgcacttggtctccgggaggagggtggcgatgaagacggtcatgaggaggacccaggcgccgaagaagtagaagaggccgaagcggaggtggcagaggagggtgaggaagatctggctgatgaacgccgtgaagaacatgttcaccgccaccgtcacgctctgcgccgccgacctcaccgccagcgggtacacctcgctcgggatcagccaccccatcggcccccacgaccacgcgaacccggccacgtacacgcacacgaacagaacgatgcacatcgcgtactgctccgacatcgcccccgtcccgctcaccccgaactgtaatccgatgaatgttcccaccaagatctgcaaagaaatcaaacaagattgttaataaattaaatctttggttttgcagacaaggtgtttgatgaaatgggtgagtgcttgctgaataaattaaatctttggttttgcagtcaaggtgtttgatgaaatgggtggttgcttgcttgcctgggagatgatcatttgggtgccaccttggaggaagagggcgcggcggccgaccttgtcggcggtcatgacggcgacgaaggtggagaagacgttgacgaggccggtgatgacggaggagacgagggaggcgtcctggcggaagccgacggtcttgaagaggacggggnnnnnnnnnnnnnnnnnnnnnnnnnnnnnnnnnnnnnnnnnnnnnngaagaaggggatgagcaccgcgaacgcgagctgcggcttgtacctgccgccgaagaagagctcccgccacgggtgcgccaccgccttgctctcctcgctcgccgtcgtcaggtcctcgaactcggcgcgcacgtcgtcgacgccgcggatcttggccagcgtcgcgcgcgccgcctcgccctcgccgcgcgcgatgagcgacaccggcgtgtccgggatggccagcgaccccagcgcgatcaccgccgccggcaccgtcccgaacgccagccccacgcgccacccccacccgccggcgatcttcgacgtccagtacgttgtcaggctcgccgacaggatccccaccgtgatcatcagctggaacagtatgttcagcatcccccgctgctgcgccggcgccatctccgatatgtacagcggtgacgcctgcaggccaatcaccggcgatcgatcaacaactgatatataattttgagtattttctacaccttagctgtatacatgcggtttaaatggttatataaaattttcaaaaagtttgataagatagattataatgatataagacactatagaaacatgtaagttaaaattcaataataaaattaacaaatttttatgggttgtacattacaattacaatgtactattcactgtttgattttactctttttttttctaattgtagattaaatttaatcttacatgcttatctatagatttatatcatttcaacttatgttattgttttatttaaataaatataattatttaattcacatacaaataataatgagtgttatggtatgcaggtgatcgatgtcacatgacaacgtacgtggatgcagacgccgacgccgacgccgaggaggaggcggccggtgaggagaacgatgaagttgaaggagatggcgccgaggatggcgccgatgaggtaggcgacggcggcgacgaaaagggtccacttgcggccgaaggcgcgggacatcggggaggcgaagatgccggcgaccatggcgaagaggaagagcgacgagccgacaagcgtcagcacctggctgtcgaacttgcagtactggttcgtgatcacccgctcctgctgctgctcgaagatcaccgggaagaacatcgccaagaacgactccgtcgacgtcaacccggctgccatggacgtgatcagtcaaccacaaccaagaagaatcgtatgtaatggcggcggcggcggcggcggccggtgaggttgcgtgtaccggtgaggccgatgtcgtagccgaagatgcagccgccgacggaggcgatgaggcagcagaagaagacgaagccggtgacctcgccggggtacgtcttgtaccgcgtgtggtggtgcacgatcacggcccccggcatcttgcccggccggccggcggcggcggcggcggcggatcgatcgaacggcggcgacgtgggagatcggtcgatcgatcgatcgaagccgcgagctgcgcggaggagggaatcaatggaggaagagaagagagagaggagtacttaagagaggggaggcctcggcgaacggcgcgacggcaatggtgggtgcatggcgagcgcgagcgccctaaatcgtagggacgtctccttggtttcaaggtcaaccagaaaaaatgatttccattcttagcaagtttacaagttagcatctttgctggatgctgcaaagaagatgaaatttcgtttagttcttatttatttgtaccaaggaacactagcttgtgttatattttagtttggttttgtaaaatcacctggtcatgaattgaatgtggctttatagcagtaaggcataacgacttgtgttcaattttgtgcacctaagaattgggggcaataaagtatgaaacactacagaaagcttcaaaaatcataagttggatgtgacaaacaaacgattgattgattataggccgtgcgatctacacaaaagaatttcatggatagtacaaaagaattgtagggatgagtagtgaggactgaacaagaatgtaacaggcaaagaggaactatgaacagcacgcagccacgcagggtagcaaaagctgaatcaatgaattctgtggttcaaaactgaagagcgatcaggtaaacgcgagaaggaagtcatgtgatccggattctcgtaagaatgctttgcaacttgttagcacagagtttcttcacgatcttcttggcaggaaggtcaccggagtctgcgagtcctttcaagctgacaaaatgttgagacgatatgatcttcttccttccagcactggtctctgccaacgacacgaggcaagaaatggccaaatccttcgccatcgtcttgccgtcaccgtgctcaagcgactgcagcagccggttcagattatcaccatcttggatgaaaactacacggttagagtgaagcaacagtaggttgcagagtacttgtgctgccatctccctgacctgacaagatttggctccaagtgagcttaccagggcagtcatgaaccctgccctgccaaccatcttgctgtattcctcggagatcctcgttagccgtaccagaatgttgagggtgcattccaggacagcatagtcaacattgttgagataggtttgaagccagctaagaaaattggagctgatgagatcatctgtcagagctttggaagggaggcagaagaatgcaatggctgagagagcaacctccctggctttggatgagtatggaagatcagggttcatcagctgagtgagtgattggatcatccccatgctgattgctgcttgtctgacattggcatcagccaaggccatgtaatggagcagctcaactgatccaactttgcgttcttcctccttttgtcgggacagcttcaccaactccataactgcaccttgttccaccatgaacatcttcacctcctccaccctgctcaggttcttcagcaccgcgaaagcggagctgaccagcttgcccctgctatcgacattggcgcagacgatcaggagcacggtgacaccgccttgtgcgcagacggcccagacgttgtcggagttgctcgtcagctccctcaatgcatgagctgctctctcccttgatgaaacagtagtgctggtgcagcttggactatccagtaactggacaagtggagcaaccacacctgctttcacaagcattcctctgtaagaatcatagcctgcaataagggagacaattcttgcagcctgttcttgaatgcatgcatcccctgattcaagaaagctgatcaggagagtgatgctattatcaatgtcaagagctacaatcttgacatactcgatatcttcagataggagctctccaatggtgaccagggcttgttttctttgagccaaatccccaatcctcaccctcaagaagagatcattgatgtagaacctcttgttgcttaagcttgcaccaatggcaggcctcgttgcgatgacagcttgagaacgcacagaaattctggaggaaaccatctccttgaggtccttcaggtggatatcaagcttggagctgatgctgtccaaatcactcctcagacgaagccttccaccattgtaagattcatcgctgcattgagaagcaatagcttgaatatgacttactgttgctgtagccgtctgaagaaactgaacaagaatcacattttcgttgcagctgccgtcgtctcctggcgcattcaggttggaacagagttgctgaagcttgtacttgatggattgccacttgactgggaactgaacaatcgaataagccattgatgctgaagccgatgcctttaaaatttgcagcttctcactgcattctgctacctccattcctgcactcctgttgggatcaaaactggttcttggagttggagacatggaattgaagatatgcagatagtagtttttctgtttagtaaatgataatgataaggttcttatagctctagtggtctgcaatgtatatgcaaagcccagctggcctggccagatgaatggatcagttggtgaatccatttgatctgtctttttgctgcctccttttggtttcttcgattggaattttgcactgctctgcctgccacaggctcgaggcatcttttgctgcaccgaagtgggttagatttagtgggataggtgggtggagtgctggggtgtaaagcatatccttaatataaacctcggtagggttgattacacctgataatcatatataaactgcttctcattgtgatatgtgcaaacatcaactcttccataaatgcctttatttagtaaaatattaatattcaatttaccttttcccttctttgttttgtcctatggaaaaaaagctggctggcaccaaacaaacagttctttttcttttcccttttttttcagattgcagtagtaccatacaaacttgcattgaaagaaacactgtataatggggtcatctatgatgcagaatctgagcgctactgcatggtggacctacagaccccaaaaatatgcatgacaaaagcaacttggaatggaagtattaaaggaaagattaatgtttgcatcaagccatggcccaatgaccagtcctttcacagttcaagtgaacaatgcataacagtaataggctgtaaaatgcaaatgtgaaatgataagagggtgtgaaagaagtttatcacatgttaggacctgaggtactggacctgtttcagactctccccatgctgccctctgctcgtctgtatccagcaggtttagctgtgtactgcattcatttataaaggtagttacaaagagattagatacggtacggagagctaagataagagcaagtgcacgtgctggaaaagagctaattggttggtgtgagcattgagcagggaaaatggaccagcatgctggagtagtagagactgtacgaccactgaccagtacgggtggtacctaattatcccagtggcacaccacctcccatgtgatgtactactgatgtaccctcctaaattcaggattggataagctagacatactgtcgtcgctaaccctgtagaacaaattaaaaaaaaactaggagcttgagaccacactttatttctagatatatatgcatctagacaaatatttgtctagattcataagaaaaaattgaagtctaagtaggacagaggtagtaagtaaataaagaacaagtaaaggtgcatcctctccatacaaaggaaatccataggagaaaattgcagctatattattttatagaagtatgtttatacctagaaaatgcatttcattttagtataataatttgcagcgtgcagtgtacgtgctagtgctgctcctagatactcaaaggttattactctcagctacctccagaatcagatattaaaaggtcatacggattgtaatgggggccatccaatcagcaatacagtgcttttgcagttttgctcccggaagaacccaatatgggataacaagatatacccagtcgtctttgtaaaatccttctccagctgccactacttaaaaattaaacccccaaaataatatggatgaacttggaagtaacatacatctccttcatgctgaaacctggtagctttgagcctttgaagagcaaggtaaataaaatacaaaaactggtcaccaagtgaagaaagagaagagcaccaataggactcaaagactaccagtaattggctaattgcttgtgcctttttaatttacaagtttccccatgattttgtagcccaccttttaagggaattgtgaacactacccagacatgtccacctgcccgcaccactttctggaagagaggggactaattattattattattatggctctaaatcgccacttcaaataacttgatcctgtagtccctgtagcaacatagctcgacatcaaggaatacaaatactaaaaagtagtctcaactttcaacatagaccaccactagcacagtagcacgtatgctgtacactgatttaaataagatgtgcacataccattcatcataaagtaaatggtacagtgaaatgggaggagaaatgaaaaggcaggtatactaggcaaacaatacagtgaaaaatggaaggacaaaagaaaagcaaggtactgcaaaggacacaaatatttaagagacgttgagagagcattcatatgtatgtaccagacatataattggttatttattattatatttattacaggtcagtagtatagacgtatggaacaatgaaaatactcatggaagactggaaatagaactgtagaaaccacctgagctgttgggcaacaaacctttcccaattcatgtcttgatgagccatatatgatatatgatcaccaacaaggcatttatatgaatgaaatccaaaaaaagaggtgattccaagaccagcagcccaaacaacagcctcgaataagtttccccaactgatgtttgatgagttcatcgcagttgatcattatcatacagaataagaattgtgcttcctctgcaggctttgctttgacaccagggaagtaccatcagaaaaatatcgaactatggagtaaaagaccaaaaatgcattcagctccttgtataaaaggccaaaaggacagggtgctggtattaccatgtatatagtcaatggtcatcatattattttagggcaaaaggtccagggaattggtctagtatgtacatgttgactgccaaaccaaaccattggtttctaatggctaattagtcatctactgttccagaacaactcatctgttacaaagtaccctataaagctcaaagcccaaaattagcatgaagtaatactagcttattattaaaattatgtaattaaattaactgaacaaaatgagtgatataagaaaagaatttatcagaggcaaataatactccatccgttcttgaataactggcaatttgaccaaatcatttgtttcagaatatttgtcaccaccatactttcattggtaaaatccaattttgcccctactttcccatggctacacttgtgggtctaaatcaatcttcaccatagagaaaacctctagatacttctattttggatccattcctttccccccacctcccatttattcttttttttaataccatctcctaacaattgccaagggcaaattggtcacaaaatttgttgccttgttctacatggaatggtcaaattgtctattgctcaagaacagaggtagtatagtgttctactaagatgttattctaattggcaaaggctgacttcagtttatataagaaatattaacgaggctgggtatacacttgtaacaggaaattctttacccagtctttcttaatcaagttagtagccatcttgaaaaagaattgtagctagtattgaaaataggggttgtcatatgtaaatatgtacctaacatattcaacataacatgcagactgaataacttaaagttgtgggagaccttcaataataaaatcatgtacctctgctacaggggcaatcacagtaggcccaccatgccaccatagatcacaaaaagtaggacatcccttcatttcctcaccgacatatgtgaaggcgttccaagtaaccaatcacattccttgagatcttgtaagctgctcctccttcctgatttttttgcaaggtggcactgttagtagaggatatatgtagctcatgtatctttgaaaagttaattttagatagattgcagactaaaataaaagaatatatagattatttctcaagtattgagaaatcaccaacggtaaattttatcaatggaggtgctaccataaattatttctcaagaaatgattaggtttgcatgaaaatgtctaattaaacacaaatcaccccaaaagtattaggattttaaagtgagtatttgtgtgcaataggttaccaaacaactaaatctccttggtcctcccagccacaatcggatctgtacaggtgcttctagtgtagtgtagtgtacaaccccttgagtcaataggcattgaacattaaacggtggaattctcaacgttgctttcaacttctgataaaaacccaagaatctatattaatataaagcagaagtatggattaacttgcagaaattatgacatggcatatcaaatttgttctggatgtaacgatattttactgtgctttggagaacaatcataagtagctatgtaagcatgaaaaagtcatcaaataaagtcatctttgaatgtgtcaggcaaagagaaggatttgacatcaaaatggaaaattatctaaatatccataacctaggaaggcaaagagaaggatttgacaaaaaaaaatgaaaatgcatatatttacagaaaattatctcacaactaaataccaatagcctagttattcttgtcatggtatgttactgtttgttgaccagcctttaaacgcctgtgaaccagtaggtagaaaaatgcaagtactactacagaaacacacgacagagaaagtgtgaatcccataaagcttagaaatcactaagcccaagaaaagttaacgttattcttttttttgcggggcaaggaaagtgttattcaatagacatgtatgtaaggttcatatcctaaagggttcaaaatatagcaaaatacaaacacattagtaacagtgcttttcaacataaaaatgcataaaataggttgtagcataatggatacctttatcaacattacccatatcattccacaaatcacaatgctgtgtggctcaatagttctatgtggcacactggcattataaggtgcaaatgcaaaacaataaaaggtgatatgactttcagttcatataaggagcacataagaaatttcataaagatgctccacccaggtccccccagctaacccaacagaccaagggtaataccaccttcttaggggcagtgtgagcttacatcaggaaatcatcagcatgaaatggttcattcagtcatgcctcctccaacactgcaaagccaagaaacaaagctagctaagaactgttcatcaattgatctcatccctcagcatccaaatgacccaaacattcaagtatttaacagaactaagaggccatgatactagccccaaataaaaagcaggtataagagtcccaacaccacattttgagcatgagttatatagcgcttccatatgacttaacttaccaccatatgtttcatcagtgcccttctcagatatatgattgcatgaaaagtcaatgttgctagtatcgagtaaaactggctcccaccaacaccacaagtaattcagcttccatacaaagccgacacaaagctatctttcatcgtaactttgtcacactgacttaaaataaatgtagatcagaaaactaaatacattggttggaatttagaaagcattccatccatttaaaataattaaaaagaaagaaagaaagaaagaaaaggaagggagagaaagaagaatcaaaccaactccttcagaactcagatgcatttcataacagcaggaagcaagcaaccaccacacaaaatagaaatgcataaacatcagtacaggactccctctattccaagcaccaaatgagcatagatgctagaaatcatcaaacaagcttatactagtatatatttgcatgaagtataaaaaactggagtccaactgactaaagaacctctatagtgaataaagagtgaagagcaagagttcattcaaatttacattcctatttgagtacatctgcgccacttttttttcagcttctatactgaaatatgtttgctattgatgaacataagtcaagaatatacacagaatacgaattttaagaaagtatttgtttcttaagaaactccttgggaactttcgtgcattaccaacttaaacaagatatacgcacagtttcacaggcaagaaaggcatgctgaaagatgtataagacacattatacaagaccaggattctctgaggaccgctaatgaaaaccactcttaaggttgcacaggtaacttaattcgtgacatacagtccaaggagtgggaaaaagaacacatagcccatatcaattcacattagttgaatgtagaaacacgtgttctgtcatccgtgccacctgtcctatctaagttcaaaccatatttttcacgttcacgaacaattgaatatgctacattgatgtccataacttctgtagtttgtccaaatttataatcggtaagacactttctccgtgttcatttcttctctaatgtatttttttacatgtgtcatgaagatcaggcaacagaatagctcaccaattttagagtgcaaaacataccagtccacctccagggtaaatcatttttataaatggtatcttacagataattggtaccacataacacacagttatgttcataacacacattggtgtatgttttagctagatggcatgccaaaagcaaattttaaataagctaactcttgaggggattttggacaaggaaaattcaggcatttgaaaacacaaattgcaattatgttataccaaactatagtttcaatcatcttgccagaacacgaggatcataagaggactggaataccacaaatttcaaccatcttacccagacatttcaaaacataaattgcaaatatattataccaaactttgtatgcttgcagatctttttcatgtctgttgcctaaaagctataatggtaataattaaggagcagcaattaaactacggtgcaattgcttatttcagctaaactctgacaaagacctccgaatgcaagggtagtatctgaggactaacagactcatcaaaaattatctgggcgattgctgaagctctttcaagatgcaatacatctgtcttgagaaaatggggcagtgcctccgagtggacctttcggaggccttgtgggtgaacctccttgggagcaatcaggaacagtttgttaagacggctagctttcctcagcaggaaatccaccagtcgtagttcattgcgataacccttgaagtttgtcatcttgaccaaccgaaggttttctaatccgccttcaggcggttcttcctctgctacctccaaataattcgtcgtgaacgaatcataagtgtttgttgggagctgcaatgttgaacacaatatgttaagtacataaatggcacacacctataagtaaactagcaacaaaatgcattttgcctagaaataacaacctgcacgaagagcctctccaactgaggacaacggcaggccttgaggaagctatagatatctgcgaggttggagttggccattccgaacatgagcagctggagctctctcaagctgttcaagctcttctccacgttgggggtggctactgaagcagagacatactacaaggcgtgcaagtataagcacaaaagcaacaaaatgaaacgcaaccaaagacggcatagatacttgggcagacctggagagcaatgctgcatagggtgagtacggtgaggtttgacaggcgggggactgccgacggcaagttggtgcgcggcaaacctgtctccggcccgccggagcagaggtagagatgctcgacacaatccgcggtgctaccgaaaatgttgctgcagaggaacgcgccgctgaaccggaacgaccggaggaggggcgccgatggcacgcgcagctccgtggcgcgggagcagtcgacgacggtgaggctcttgagattggaggccccgacggtgaaatcgatacggcggaggtgtcggcagtaccggagctcgagctcgcggaggcgcgggcaggcggagaccacccgccgcagcgcggcgtcggtgagggagacggagtggaaatggatcacctcgagcgtggcgaccatcgcgttggcggacgccgtgaggtggagcccccgcaccgacagccgcgcgaggagcttgctcccgatggggaagtgcacggcgagcgcgccgggccgccgcgtgccccctctcgccccacgcccgccgccgtcgtcgagccgcagccgcaccttctccacgtcgcacgccgccgcgtactcgatgaaccgcttcagctcggggggcgcgagctgccccgcgtggaaggcgagcgagaagaggtccattcgacgtcttccgcgccggtcgatgcctgcgaggtgctcggcccgcagcgccgccaccgacgccgacgcggttccttcccccgatggcagccgcacgtcgagcgacgacgggtcgggccacccgtgcttccacaacccccgccaccgcgacgagagggcccccgtccggattgccgacttgagcggcaggaggctcagaatctggagccgcagcgcgtcggggaggtccgagatgcggtncttctnctactncccccaaccccgncgacgattgtcgcttccctcctgatcccccaccatttggcaccccntccccgctaccggcgtcgccgcacgaacgacgcggattggatgggattcccacgccagccgggtggatagctggtctactcaacttcttttttctttgtttaatctcaagaagaagaagagacctgtggagcgtccgtatcttcgcggggcaaagccgtgcgtgtgccgtttacaccgtgctactgccggtcggtaaatacacactggttcgacgggttcaccaatgtaaaggactaccaggccagcctggggcggcggagtaattatggtttaacggagcctgaccgaccgaacattatgaattaaccgggccttttatgggcccggacaccgggaccgaggcaaatccttttaacaagctgggcctcttgacctttcttcctatttttctccactctcggggttttttcttcctttgttgtcacaccctttttttgggtggttataaaaggacattcgcgcggggtattgcaatgtgt

SEQ ID NO: 49219 - DNA, 4687 bp, Oryza sativa
  unsure (1)..(4687): unsure at all n locations
tacccatcataaggctggtttattccaacgattcctccccaagaccaccccaaattatagagcataaaaaaatattccaactctgggagatcgtaaacaggaaaagaagaaaaataggcaccgcccacactccaatagctctagcttaaaacccgggaaaaggctagcattcgttccgaccgcttgctaagccaacaaaggaattcaagtgagatcgtctaaaatccattcctaacaactgacaccaaactctactctagccacatcttcgagattgagggaaagagtgacagagaagaatggaatggctctccaccagggccctctgacgtggccatcttgcataagctacggcgccgacacaagaggacataagtttaaagtgagcttgcaccggttgtctgtaggttcttcatccacggcctaccaacatgacgtctctagggagaggagtgaaagaagccctcccgccaccgttgctgaaggtgccgcctcccctcctgatcccccaccatttccaccccctccccgctaccgccgccgccgccgcatcgacgcggattggatggattcgccccggccgcgcgggtggatggctggtcctcctcctcctcctctctctctctctctcagtatcaaggaagaggaagagacgtgtggaggcgtccgtctcttcggcggggcgaagcggtgcgtgtgccgtctccaccgtgctactgccgctcgctaaatacacgcggctcgtacgggttcaccagtgtagtgtactaccagcccagcctcggtgcgccggtctacttctggctcaccgcaccgcaccgcaccgcacattcgcatcacccgggccttttttggcccgggtcgccggcacggtgccgagcccttttcacacgctggccctctccaccttcctcccatttttcctcctcctcgtggtttttttctccttttgttttcacaccttttttttgggtgtttatgaagggacattcgcgcggtatatgcaaatgtgtgtacagtgtgtagtgtaatgcgcgaacgtttaaacatttacgcgggaatggtgcacgcaaatgtgcgcgctgggtgttatgcgtggacatttgcgcgggaacggtgcatgcaaacattgtgtgtgttatgaggtgtagcatgcaaacatttacgcgggacgtggtaaatatgcaagcgtgttccgcacggcacatgtgtgtgcgcggttcatgtttctatggctgtgttttgtgtttagttcagcgcaaagtttaaattttgtttgaaattggagatgatatgactgaaaagttgtgtgtatatgataggttgatgtgatggaaaatgactgaaatttagatccaaactttagatctaaacacagcttatatgtaaaaatgttctatgtaaagaaaatgtttgattagaaataaagttttgatgttgaaattggagccatgtcgaaattagatgtgtcttctgtgtgtagaaatactattttaggaaaaccttatgtatataaggtttcaatgtggaatgtttctttgtataaaatggaaccaagtttgatttagatattgaagttcatatatataaattttatctatataaagtttatgtgtataaagtttcacactagaagtttgatccgattcaaaaatgggacatttgccctcgggggggtacgcatgaatctttttgaccctttttagtgccttccgttcactgcctgcttagtttatccaagttaagccagggcaaaaataattaggcaccaaattgaaatggcatttggttttgatagtgggttaataaacaataaacctttttataatatcctcactgctgctaattttgagcgaactttctaataaccgtgtagatgtactagctgggacggataatatagagaaaagcaagcatatattttccttttttttttctgattggcagcggatggtacacagccacgccgggaaaaaggggttactacatgcgtctccatggctgtcaaatcatgctgttcctttcaataaaggttagtttttacaggatttgtccagctaatatgttgattgacagattctgagactgaaaattaaccctgacctttggtctgatgatgcacccatgcgattctacagctgctacaccactatatatatacatcagtggttgaacaactgcaccgtaaattgtttataggacaattttgtataagagcatgtacaatagaaggctgtccctctcataacctatggctgtccctctcatctcaccatccctcaactttctccctcacctacagtggtcttcgttcccgctttgaagcacacggccgttcaacatcgaaccacagcatgacatgcatccaaatcttgttgcaaaggcaagtgatttcatccataaaacttatgatgtcaaaaaaagttggattgatcttgagttgagtaccagtgccagtgtgccaccaaatctcctccaacttttgccttggctgcatcagggttgtcaccaattagggaaagggatctcatgtttgtgagcacagtaaaagatggcataatcagatgttggtttgaggtgaaaaaggaagaagggacattattgtggatctgtccatacaatctccaccgtccctaattgtggttagcaacaagaaaaacgtggatatcactacaaatctcttgggttggcttgtgtagttgtgtagtaggaggtcaattgctatcatgggttttggtttgagtccttcatggcatgtgaccacgagctttaatagcggtgatattgtgagaaattgttcaacaaaaaaatgtagtatatgtattatgagtggtttaaaggttaaatatgaaaaattgacctcaacaaaaaaaactctatatttaagttttctttcttttcggttgacaagtcaacaagtataaaatacaaggcgtaagcaagttcttttagtttcctcctcacataagggtattaaaggtgtttttatttgctcataccgtctccaacacaaggtcgttgagatgtttacttatctaaaccatgagaccaaatgatttttgctgtttaataaatagatgcaccataaaattggtacggggatttgattgacgcgatgaaacataacattcttatttctattggtgtttttactctgcactttataggaggttcttagcattttagcaacctttatatcaaatgcatgccttgataaaaacatcaaatatgtaaaaccacactagtttttatcactacaagaaacaatagcacacacatatatatgattatacgttatgtggttaaatccagcatatgcttcgatgtcttccctctaaatctagctcagcggccatggctttccgtagtcgagctttgtaatccttcttccacatgcaaaaatttgacttgagcttctcgaggtcatcaatggaattcccaccttgagtgcttggctgccatggctcccttgactccacgagtgcttggctctgttgtcggaactccgtgcatgtaccacgagcaatgcccgcataatggcgagagctgtgcgccaacctcgccgatgtttccttagacatcttcacgtaggattccgaggattcttggcggtcatatagtgataacatttcacgtgatctcttttctacacattcttgagccacctgtgagattcagacaatcaatcgaggttagttagattattgtcactttgtcacgtgaatggctgcaaaaatggtttgattaattacgtagctggtgatagtgttatgatgctgacctgtagagaaatcatttgttcatcaatggtttccttgagagagctgagcctaatctcgtgttgcagccacctaacatggtaaccctcaaacttccgtttcagttcagcattctcctcctctttttgcctcaatctcgcctctgccatggccgccttcccctcaagctcctcaaccaacgttgttgttttgtcctttgcttcttcttcctcctggcaatccaagccatactgataacttgatttgcacttattattatgattaattcatcatataattcaaatgatggaaccttgagatgtgatgatgaccacggttgcagtgtccatggccctgagaattcgacaatgacatgcctttgtggccgcgatgaatgtcgtcggcatcgtggggtcggccgcatgggaagaggtggcaatggcaatgagtcgaggacattgtcatcgattaacacattgtcgcctcctcctcctcctccttctcctgatgatctccccatcatcggattcaacatcacctgcaaggagcttagagccaatgtcgctatgattgacgggctctctaaaggatcccaaggccggcgacccctatgacatggagtatgaacgattgatagattattgtattagcatcaagaatcagagacatgcgatcaagcattgcatgatcgttggataaagaaagctagaaaaaaatgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccctcn

SEQ ID NO: 49220 - DNA, 2159 bp, Oryza sativa
catacggtgcttcgcttgtctatatcatttatttggcatcttaaacttctcaagcttaacttgtgcatacaatattgttaggttttagtgttctatgcctatgaaagtgcaaaaggccaataactgatggatgaaatttgtgaatcatgtgatgttattttgcgcaccaaattgcattgcatcgcattgccttttttccccatatctttagctcaagtagtgtgggccaggaggttgatttgaaaactcaatgcatcgaatcttgcttgtagctgcttatttcctattttggtggttgcctacttcccttcctagtaatccatcacaatattttggaactttaaagctgtgctcaaaattatttctgaatatgtatgtcattcaacatacactccttacactgtaatcatacagaaaccatgcacacattatctcatttagttactaccatttgcatgttcagttgtgtacaaatgtatttgtcttcatcggacaatgttgcttccttgtgtcccaattagacttaatttcttcgtgttatgtatttatctttgccaaaggtgcaaagtagcacttagtttgtatcatgtacaatttggtcatctgttacagactttctataaagcgtccaagaaccgctttgatggtgatgcagaatttaaagacagagctcaacaagcagtcgttagacttcaggtcagtgcaccttcttggatctggaatatgttaatgtttttttttttttttggggggggggaacaatggaaacactttgggtgtcattccattagagatagaaaatgagtatgttaaaattgcatcttatcatcctcatacaatgcctaagaaatatattaactgtagggaggggaagagagataccgtgctgcttggaacaagatttgtgaaatcagcaggaatgaatttgacatggtttacaagctcttgaatgtaaagcttgaagaaaaggtagtgtcacactctattggacgcgacttatatttctttagaaggttgcttatcaataacatgaatttgctacctgaaatttctgtttgttgttttagtagaatatttgcgcaaccatcatccctttccttttctatataggatctgagacttaaacttttactgtatcaatttttatgatatttttggatagattgttctttctcttgttcccatctgagccattttgaaaagtctctgataactaaccactagttttacatgactcaacaaggtgtacctcatcttcatatgaagagtggaaacattttgctgccaaaattttacaaattagtcagttgctgattggggtccttttacttgatatttctctgttgcatagcttgtgattcctattggaagatgtattgacgttcatattccagggatgttagaaacacattcaatttgttgaacttctgtctttttagctgaatccattagtcaatattttcaggagatatttatagggcttcacttatctgttttgtcgatatgtatttgttgaagtttccgatggcactaatattaatttagttggatttctggatttctttcttattagtaaaaacatcagtttgtctgtttatgatctgttacagcttgtatggctgcattttatcttaatccattttgacaatagcacctgtagctgtgtgtacttgctttcaaccaacttttggctattggtatcatgaaatgcttatgtttgtcgttttcttccctgagcatccaagcagcttgttgatttatattttgtagtgttgagaagagagctattcttttcagggagagagcttttataatccttttattccacaagtcttggaagagttgaataacaaaggtttgatcaaagaaagcgagggtgctaaagtgatattcatagaaggccatcaaatccctttgatagtggttaaaagggacggtggctttaactatgcctcaacagacttagctgctctatggtgagttgctaatcgataattttggtgtgttcctacagtgcaattactcttatattagctataatttgcagaaacaaagtgaatatattttcgtagttgattcagtctatttccacaggatcagaatttgtgaatgtaatcgttctatttgtgcttttatgcaggtaccgtcttaatgttgag

SEQ ID NO: 49221 - DNA, 1537 bp, Oryza sativa
  unsure (1)..(1537): unsure at all n locations
cacatttagctttgaacaaatgctgagtgataaggtatttctagactccactatttgtttacttgtataaaagggtgtttttctccattaattttatttgtgttaaaacttttatgcgccacatatttgcttatgatgtattccagtatttgtggaaggatctgttgctctatgttctgcattggatattgaaaatcacagtctatagtggtcgctcttttgcataaatgaaaaaatatgttcttgagtagtttctgggcagattctttatattagtaagtagttggtgaacccattcaccttcttgcttactctcattacttgttattgacaagctcattcctttttgtcaccagggaaatacagctgtttaccttcagtatgctcatgctcgcatttgctctataatcaggaaatccaacaaggatgtagaagagctgaaaatggtaatacttgtgttatttctatgcactgattctattgttgattttataaagtcctgctgttgttattttagagttccatcatctttttttttttacttgagttccatcatcaattattcgttctctttcagctatcagacatggatttaaacacgttgactctgttttcctgtttttcttctcagagtggtgccatttctcttgatcatccagatgagcgtgtcttgggactgtacctgatccgatttgcagaggtatcattggcgctattaactgaatcttttttcttaaagatcttttttcagacctatattttcataaggcctaggaactaaaaatgagctaaaaagggtagtccagtttattcttgaacagcaaacagccgcagtggtctgacagcatgttgattgtgtgctcttgtttggagttgtttgtgcttagcccacaagtaggtgcatgttactgagattttcctgttcaactttaggtgtggttagtgcaagaacaatggaaaaactagaagtcatacattacatcattcagataatagtatttcattcagataattcctacgaggtgtaacaaacaccgataattctatttcatagtttagtcaacaatatggcttaattcacaactaaagcttttttcccctcttctgatttacgtttgctgtgtctgtcaggttgtggaagaggcgtgcaccaacctacttccgaatgtcctgtgcgagtacctgtacaacctttctgaaatgttcacaagattttacaccaactgccaggtatacttccatctgtttacatcattttcccctggtgaatcttactttcttccagaacttgaaaaaaagtttctgacatgttcaccaagtgaattttgtttctcttataaactagagaataattataccaaacattcaaaagaaatgatttttactgcgggctcactttacgttgaacccatcaggtggttggatcgcccgaggagacaagccgactgctgctctgccaagcgacggcggtcgtgatgcgacaatgctttgagctgctcggaatnnnnnnnnnnnnnnnnnnnnnnnnnnnnnnnnn

SEQ ID NO: 49222 - DNA, 719 bp, Oryza sativa
catatattacgttacccctattcctctggcaacatacatagcctcatatctccacctcacatgaatgtcttgtgatcttcttacctcacatttggcatcatcttcatcatatgtaagtcgaaaaacgaaaggtacagtaacccacagcctgacgcctctgtcaatggcggcgtcgccggcgacacctcctctcgccggaggagggtggcatatgctactactgtctaggtctcttggagctgcagctcgggcacttgtactgctttatgctctccgccttcgccggagtgatcttgacgcacttgccgtggtaccacctctcgcacacgtcgcagccgatccagaactcgtcggcgctgtatatcccaccgcaagtcccgcatagggtctcactgtggtcgccatcgtcctcgtcgtagccttcatcttcctccttgatattattttcgacacgcgccacgtcgctggtatgctggggagatgggatttgttcatcaggactcgtgatggaagggaggggaaatggtgaaaaactgtggagaaattcttgttaccttcgatgaaattttatttctgctgctgttgtccatgccggatctgtccctctccttagattgtcttgaaccagatacgacttcgtaaacagttggcaaatcattcatcatgccaaacaaacgcttcctgttgaattggagagcgaaaacagcaaggacaatgag

SEQ ID NO: 49223 - DNA, 1639 bp, Oryza sativa
caggtgcacaaaagcacactaaaaacatcactttgcgagcatattactgtctctccacatggccatagtaaacaattcatcacgggggaatgagtatggcctttaaattactaccttcttccacaaaaaaagggttaaaaactgaaggtctcaaaataataggcatgcttgcaattctacatcacaattatgttgtagaatgcaatcagatagtccttttagtaatcaagctattaccaacgagtctgtatgtacaaaaacatgccaatataaccagcacattctaatgcaagcagacattatggccaaaagtgtagttatagcaacaaaggaaattgttttctcaaatcagcagaataaccaaatattacccaaaagtgtcactacccaaggcctattatattgttcaaacttgtgtttcacatggtacttaccaaagcaccataaccaagctatgctagaagggcagggtgataactaataagcaggagtacttgcaaataattccagaatttctttgagacaagatgaattacaatagcaccaacacagagagatagcatgaccataagatgcctgtaggtaatttttaacggtgaaccatgaaaaggataaatatagtatgaactcctaggtcatactttattgactggcaccgacaaaagtttgaccagccataacccaatgatgcagaaacaggttttgaaattgaatcaagaggaggagcacatatatataggcctgtgaaaaaagagaacagtgctgcagaagatggctgcaagaaatgaaacaatacttccccggaattgatcccctttcctatctcctgtcaggaggtgctaacctttttgctccaaaactaggaactcatgtcctttgatctatttcttttctctatgacaaatggaaccctgcatattccacctttatcacaatttcccattcctatttttcaggaaaggaaaaaaaatcttaggaaatttaattttcctcctgagaatacaaagggatattacttgcatgagtatgcagccatattttctctcttaacaactcaaaactacaaaaaaaccagtgttcacttctagaaagatgtacccttggaataacccagcacactattaaagcagacaaacatgatggaactacaaatttggaaacaaattaaatctcttggctcatatagaatcagcacaacaacccacaatattccataatactatggaaaaccaaaagaaccaaaacttaaatgcatctaatatgtactgtacttggcatcatcacactggaagcagtacctaccaaagcaagcattacatcgaaacaaaccccaaggccacaatatcatttcctcacactagaagtaataagttgcctcatactcttaccctgatttatattttgtcatgaacataccgtaatttagaagctcaaacattacgctgatatggcacaattagggacaaatcaaaaccaaaatcaaacagaggcgagatcaggagggcgtaccggtcgttgcggttgaggcgcgcggcgtattagaaggcgacggagacgagccacgagtcggagtggacggcgacgagcgcgagccagtcgccgcggttcatcccgtcgcgggcgaagttgatcccgagcg

SEQ ID NO: 49224 - DNA, 3458 bp, Oryza sativa
  unsure (1)..(3458): unsure at all n locations
gccgcccccgccgccgccgcctccgcggccgtcgcggcggtaggatgcgtccatggaaggnagncggcgcgtgggtaaggcgatctccggcgaggcgaggcgaggagaggagaggaggaggtgatcgcgatgcggaggagaggagagagcgaagtgaggagtacacggccgatgccgtggagatcagcggaagatgcgttaagattttgcggttttacgtctaggtcctcgtatgagtagttgtagtatttatttgtaacaaaagaaataaaatcccaacttttaatcgacccttatgaggattatatgtgggataatctgagtgaatgatagttggttaagatatcaaataatcgaaactcattttaatgggtgttagattatcaaatatatctttctaatgcggtgttattttatactgctaaatggcgcgttccgtgtaaaaattttctatagataagtttctttaaaacattagataaatattttttaaagtttgtaataattaaaattcaattaatcatttgctaatagtttgttgtgttttacgcgcctttaactttacattcatcgtgttaaaaaagaacatgtaatgaaagcaaaggattgaggtgtgatgttccatagcattcttttggaggcaccctagtaaagcccccacctcttttcttattaagatatactccctccgtatgttaatgtatgacgccgttgactttttaaccaacgtttgaccattcgtcttattcaatttttttatgcaaatataaaaatacttatgtcatgcttaaagaatatttgatgataaatgaagtcacaataaaataaatgataattacataaattttttgaataagacgaaaggtcaaacgtttattaaaaagttaacgacgtcatacattaaaatacggagggagtatattttatcttggtttttattaatacgttttcaaactgctaaaatatcgtgtgaaaactttctatatatatataagttgatttaaaatataagataaatctattttcaagtttgaaataattaaaactgaattttgatgcgctaatggttaatggatttctcgttttttcatgcgctgatggccataactaaataaccactgaaataactaatacaatgacataaataatccgaaaaggtccactttatgtttcttaactatgaatcaactttcattcgtgtcccttagctacaaaaccgatataaaacattccccaatttctaatgttggtgtaaatagagtccctcggtagtattgaaagtggttttagctgatgtgatatatgcatgtcttgttaacttgatcttagtagtctatacagtgctataaacaaaaaaaaaataaagatactactaggacccatatatcaatgatagttcagattgaaaaaaactaacaatttgtggggctcatatgttaaaggcacttcttccctcaccgctatatgcatttgacaacaacagcgatggcatgcactccccaagccagggcggcgacacaacgctttgctacctccgcggtggtgattttcggtggatgcagaaggtgaagctttgcccaataggtgaggtagtaggcgaaagaagctgtggatcttctcgctgtgttctctcacctcagtaagctcgaagtgctcgaggaggtcggctactcagtgtcagccgttgaaaagaacgtggtctctccggccctcggacacgatgtggcactccaagctctaggtcgaacaaggaaaaggtcccatatgctactaatactaatttctttttgctaattaggataccatatagatcaaaaccacttttaatactttgtaggtcccatatgctaccagtacttttttttttctttaattaggataccacataggtcaaaaccacttttaatagtatcgaggaactcaatttacatcggttttagaggttacaaaacaccctatatcaggttttacggttcaaaggacaagaacgaattttttttcctaaataatattccagagattgatcaattgtgaatacggcagagattgatcgtgagggataacaattgggcctcgtactgagctacagtgtacatataccaagcataactcataaattttgagtttagtaccccaaattttaaacccaacccacaaaaatgtggggccgtttaccaccccagatccacatcattttcggagttctttgtgatgtgatctctgcttacatttactctctgtgatctcagctgcaagaactgcatgtcattttagtacatatcatgtcacacccagttctttgaagggcagactacatcagggaatacaacctctcgaaacaaactgatcatatgctactacaggtcgcgtcaagtcacaggttattgatctctctactcaagacggcgtgaagttcatagcagacaggctacgtgaaggtgtcctccctatcaccttccgcgacctcgccctcgtcgatgttgctgaactcgaggaaatgtgtcggccgatggtcctcgtgatagaagtccctgggcgtgccaagcttcatgttgtacttcatcagcgggtcgtgcttcactcccatgaagttgaagttccaaggggtgttatccggcacctggtagagacacggaagaaatgtaaaactctcggcagagtaagaactatctccgccccaaaatgttataacttctggctccagctccagatccgtatgtccagatatatagccaaaagttactatattctaggacggaggtagtaattcttatgttgttgagtcttgaaaaagcatgcgttagaaaatcatcaaaacataccatgtagaatcctaggaatctgtcactgagaagcatctggaccttctcgtagtgagtcgggagatatccatgtgggttgcttccactgtccttgttgctacggccccactcgtaaccacttggcgtcaacttgtacgcggtcaatgaacaagatcctggggtaaagctgcatgtcaaaatgatgcacttctcaccatcccattgcttgttgttctccaagatcttggcgtgcgatgtcaaatcctgcaataatcaacaaaacgattagtctagtcttatgacaacttgtgttcctttgcaacagctaaaagaaactgaaagcataaataatctaacctgtggtgatagctggggagcttcattaggctgggtatgcatccagcccagtggctccaaatcattaaggaactcgtgctcaggaaggtttgcaggcagtgtcaccatctgatgagttccgtgctgtggaggaatagctatgcatctgatctctttaacttgggggttatcctgtggactcagcccatatagaaaacctgcaatctgtgtccttaaatctgctatgcatatgaacttctttaatatattcttcggcataatgtaagtgtagccagtctcctgcaggtagaatatttgagt

SEQ ID NO: 49225 - DNA, 977 bp, Oryza sativa
tcatccagctagcgatgagtcatccactcgagcccacccacccccgaaagttccggaggaccccgcgccggccggccgccacgtcacccacccacttgccaagctccccatctccgccggcggggatcggatcgagctcgccgcagccgcccgctcgctcgaggacgatggcgagatcgatcgatggatatggaggaggaaaaaaagtttggaggatttgagctcttctcacgtcgcaagccaacttcaccacgtatatttaaaagcgaaagggcagcaaaactctggcccacctgtcagtctccccatcgcctcccaggccatcgggattctgtgctctacggccactgacaggtggagtaacactggcacgtgcgggcgtgggccccacctgtcagtgaggctacgcgacgtggggttggccggaagtgcagtacggatagggtcgggaaggcgtgattacgtgaagacctcgtccgagtactgcggtggctctgtatgtacaggagtggtgggacccacgtgtcagtggaagggaagggaatctagtgctgtgttcttcccctattttcccaaaccacatctcttattttctcgcgcgtttttcaagctgctaaatggtgtgattatgtaaaaactttctatataaaaattattttaaaaaattatattaatatatattttttttaaaaaaatagttattattgtaataatacgagcttttgttttatgtgccggaggctaaagtcaacagctagagcgcttgctggcttgctgcaggatgtagtacgtgtctgtttggtctggcgtgagcaacttgatgcatatctatatttttcttcttcttttcttcgagacacatgatgcataggagtacatatctctattcggtagttggatggatagctttaaaaacgtaacacatgcagcagtgtcagggtctgtttctattcataattattcttattattattttg

SEQ ID NO: 49226 - DNA, 3024 bp, Oryza sativa
ggctttatcaattagatgatgtatattgtatgggtgatagtgtgagaaggatttaaattttcgtgcttatgtctgtgagtttggggctttgaaaattagctacctggttgggatgtaaaatttgccttctctactgttctcttcatcccttctcctgtaagcacaactttccatttttttgcaactagctttattcaaatatgagaatcttgcatttaattaatttttacactgggaaacatttttagaactgttgaatgggcatccaaacattggcatgtttatgagattttttagctttgtaggaagattgtggcatgtacgttttgctgtttctgcatcataagctcttttaccatattgaatgctatgttgcaggaggtccgaagtttgagccactgtaccgtgatatggagaagggggatgaggactggaatgagtttaatgacatcaacaaactcatcatccgccaaccacttaggacagagtatagaattgcttttccacacttgtacaataacaggccaaggaaagtgaggcttggggtatatcatactccaatgataatgtatatcaagacagatgatccagacttgcctgcattttactatgatcctttgataaatcctataacttcgacaagcaaggttgatcgtcgggagaggaggacaattgaagaggatgaagatgaggacttctgtctcccggatggtgtggagcccctcttgaaaggaacagaactttacactgatacaacagcagctggcatttcattactctttgctccaaagccttttaatatgaggtctggtagaacacgtcgtgctgaagatatccctcttgtatctgaatggtacaaggagcactggtgagtgccattatgacatccttgatactttttaatgatctctttttaccaatgttctgcctgatgcacttgaacttccaatgctaatcacattaatctctcttttgtagcccaccagcttatccagtgaaggtgcgtgtcagctatcagaagctactgaagtgttatgtgctcaatgagctacatcataggcctcccaaggcgcagaagaagaagcatctgatccgttcactccaagcgacaaagttttttcaaacaacggtgtttgtctgggcagaagcaggtttgcaagtttgcaaaacagggttacaatatgttgaacttgttgatccacagaaagaaccttaactacctttacttatactacaaattcaatttgaaacctgtgaagactcttacaacaaaggaaaggaaaaaatctcggtttggaaatgcatttcatttatgccgtgagatattacgacttactaagttagtagttgatgcaaacatccagttccgcttgggaaatgttgatgctttccagttagcacatggcttgcaatatatattctctcatgttggccagctgactggtatgtaccgctacaagtatcgtctgatgcggcaaatcaggatgtgcaaagatctgaagcacttgatatactaccggttcaatactggtcctgtaggaaaaggacctggctgtggattctgggctccaatgtggagggtgtggctgttttttctgcggggtattgtaccactgcttgaaagatggttaggtaatctactggccaggcagtttgagggtcgtcattcaaaaggagttgctaaaactgtaaccaagcaacgtgttgagtctcactttgatcttgaacttcgagctgctgttatgcatgatgtccttgatgctatgcctgagggtatcaagcaaaacaaggcacggactatactacagcatcttagtgaggcatggcggtgctggaaggcaaatatcccatggaaggtcccaggcctaccggttcctattgagaacatgatacttcgttatgtaaagtccaaggctgattggtggaccaatgttgctcactacaatcgtgagcgtatcaggcgtggtgctacagtcgacaagactgtgtgccgcaagaatcttggaagattaacccgtttgtggctgaaggcaaaacaggagaggcagcacaactacctgaaagatgggccatatgtgacacctgaagaggcagttgctatctacacaacaacagttcattggctagaatcaaggaagttctcacctattccttttcctcctctttcttacaagcatgacaccaaacttcttatactagctctggaaaggctaaaggaatcttacagcgtggcagtaaggttaaatcaactgcagcgggaggaacttggattgattgagcaagcatatgataatcctcatgaggcactgtcaaggataaagcggcatcttcttactcagcgtgcttttaaagaagttggcattgagtttatggacctgtacagctaccttattccggtatatgaaattgagcctcttagaaaatcaccaatgcttaccttgaccagtacttgtggtatgagggggccaagcgacacctattcccgaactgggtcaagcttgctgattcagaaccacctcctctgcttgtttacaaatggtgccaaggtataaataatctacaggatgtatgggacactagtgacgggcagtgtgttgtgatgctgcagacaaaatttgaaaagttcttcgaaaaaattgatctgacactgttgaacaggcttctgcggttggtcttggaccacaatattgctgattatgtcactgcaaagaacaatgttgtattatcttacaaggatatgagtcatactaattcttatggtctcattcggggtctacagtttgcatcatttgttgtgcaatactatgggcttgtgctggatctccttctgctcggtttaacacgtgcaagcgagattgcggggccacctacgatgcctaatgagttccttacatatgctgataccaaagttgagacaaggcatcctattcggctgtattctcggtatgtcgacaaggtgcatataatgttccgctttactcacgaggaagcacgcgatttaattcagcgttatttgactgagca

SEQ ID NO: 49227 - DNA, 1015 bp, Oryza sativa
attcgacatattgacacatgcatctgattcaagtggcaccactagcctcataagacaagtttttttttccgcctctcatcgtttacagaaaaaagaataaagcaataaaataatttaatgataaaaagttatgatgagaaaatcttaaaatgaaccctaaaactaaattatgttttaaatttaaaattataagtcaacaagcaaattagcctacttgtatattgaaaattgtgtcaaaatcctcgattttcgacaagtaatgaagcgtataaaccaagcagcgagtagcgacctttattttctttctgtctttttttttgttgtgtcaacgatctaatacgttccttctcgtccaaaaagaagcctatttacttcaaaccagaatttgccaaatttaaatctgcttcttaaacgcaaattcaatgttgacgtactagcaatattaggcttagtttttctttttaactctaaactttaacttcttttttcgttaacacaattttcatactgttaaatgatttttttaaaaaaatttatatacaagttatttaaaaattcaaataaatttatttatcaaattataattattaattaataagcttttctcgttttacgtgcctaggaaaactctctccaacctgttacctgtcgcccccgccgccgaggggggaagggaacagtcgcccctatcgtgtgggggcccacgtctatcctcccgggtggggcccacccgctttccccctccggacgacacccccggctaccccacccgccgcgtcgccgccgtcgccgccacacgagcccgccacaagaacggatcagtcgctgccgtgtgggccccacgcctatccaccctcccccgcgtgggccccacccgctttcctccgagctccgaagcctcgatcgaagcgcgccaccaccaccactcccatcgctctccccgattccccgccggccaatccaatcccccaaatattccaaattcccagccaccaccaccacactagcaagctca

SEQ ID NO: 49228 - DNA, 2116 bp, Oryza sativa
ctgtacgtgtcgctcaagatggagaacgcgcggatcaccggcgacctcgtcccgcacgtctacggctccgagcccatcatcggatcctgggaccccgcccgcgccgtacgtacgccaccacgatgatgctcctccattccgttcatttgcttgatgatgatgaatgccgctcacttgcttaaaattactgttttgcttcgaattcgcgcccccccctgcagctcgcgatggagagggagctggcgtccatgtgggcgctcagcttcgtcgtgccgcctgaccacggtacgtacggtctctgcagttcacatgtgctgtttgatatgatgagatcattgggatgtgccgcttgcatgatgcttttgctgtttttgtgttcgtatttggggtgtgttaagaatgcaattggttattagtgactctatttatagtctgtcccatcttttttttttcaacgcaaaaggtcctgtccttttgttcttggcagtttttacttgttattggtgttctttttctttgttttttgcgctttttttttatagaagcgggttttgtgagcttgtttgatggactctatttatagttagactgtctagtaatccttgctgggttgctgtaccttcaggctgtcttcctgactgtaatatcaagtaaaacatgtaggatttttgcgtttatatttttctgagtagaattatgaaatttcgttagtttgtttgttaggcatagagtttcttgactcagttacaagaggggcagttagatttaacttacttaaaattctgatgcaaattactatgctcatgctatttcctaaccattgcaacttgtggaatctaccatagaaacactcgacttcaaattcttgctcaagcccaaggatgcagacaccccgtgcatcattgaggaaggtccgacccggcatctcactggaggcatgctcgagggcgatgtgaggattgcatggttcaagatgaatggggatcatgagacgcttgagttcagggttttcaataaggcagacattgtgtccccacttgatcttgcagcgagttggagggtgttcaaggagaattttcagccttccaaagtccggggaatccctgatgtcagtataaatgtcgcacctgcgcatgggaccgaggtgataacagtagttcaatttctatttgcatttgaaattggtcttcttgtgctttcatatcaatatatgatggtccgatttgattgcaaactattactatttaacctttctactccaatacttatttactgatatcctatgtttatctatagccaaacaaattgacagaaaaggccaagcactgaattatctgtttaaaacatctgcttcctttgaaagttatctctcgagggcataagtggccttgttctgaaagccgagatatgcttgttaaaaaggcatgtttaggggaaacttaaacaattcagtattcagatggaagagatcccatcgtatatgttattacagaatataccaatgaaactttttttttcgctggtgggatatttgctcttccattttcttcattttccctggaaccatctggtgcaacatttatcattgtacacgcttaataaaatttctaaacaaaacgaaatgccctttccatttcttcaacttttccacaaagcttccaatgcttgcatgatgttttgcactttaatgatgatagctagtctaatcaatgttctggtttctaacaggttttttttttcatatcttactgtaggatacatctactgaaagtttggagcttgacttggagcattacgttattccaacaccatctgcagcaacatctgaatatgcagcaaaccttgccgcaaacccagcatcattgattcaaactggagctttatggacaaatgacatgcttctcagtgatggcatccagagtccaagtagcgccactgcagattttgaagatcacaataactgtaacaaggtaagcactaaccaggtcgaatcggtatgctagaatatttgtcccaccaatgaattattatgtattcccccccagaaaatgaagtgtgttgtgtttttattttaaatcatattttgatgtgatatgtcacctatcaataaccatca

SEQ ID NO: 49229 - DNA, 809 bp, Oryza sativa
gattgcatgggtcaaaggaggaccgaaaactagctattgttttggtaaattactgctgtcatttcctctcttatacgactttcagtatttaatcaccagacatcaggagaagccaactttgcttgttggctgttgctatctaccagcagacctttctatcatgtctatatggttttaaacacataaatgaataaaaataaatgaaaatacactgagttatctgggagctaaaaagctaatctccaactatcatagtataataattatttgttattgcatcttaagattcatttgtatcactgcttattttgaaaagcagattttcttcctaaacatgtctacttgcaaacaggttggcctaccagctcgtggtaaaacttttaccgcagctaagcttacaaggtaccttcgttggttaggtcatgaaaccagacatttcaatgttggaaaggtgattatattcttttcctgattaattgttttgccacaatggcgtatgttggattgtttggcaagtgaacataactctcttttggttgaaactcggtgtgcagtaccgccgcctgaagcatggagcaaatcaggtactaataactaatttgctgcaattctctttgcacacactgattttctttgaagtatttcttcttgttaaatgctaccatgtcagaaattttcatttcaagttttgtaatccaattttatttgaagttactccatttttatatttcatttgttacatcgctattttattttggtgtattaagaatgatattatcttatgttctgattcatgagacacatgccaa

SEQ ID NO: 49230 - DNA, 3719 bp, Oryza sativa
aggtgtatgaaccagtgcaggaaggttcttacattaaaatgattgatatggtaaaagggcagggaggccagttacaggtaaattctattatgttatccctttccatgttttgcagtaaacaggctacattagaaaggttgagaatgtgacatgactatggaatgatgcatgggcggataagggtgtaccagttgggcactggcagccccaaaaaattttaccatcaagtatgtatgcattggagagactaaatattaattgcaaaaaagaatcaataggggacaaggattgaagtgacgttttttgtgatttgtaggcttagattaaattgagttgatcaaatttaaaccttatttttgtttgtgtgtatgattttgtttttttattcttgagacgtgtgggcactcccaatgagatatttttgggtcctccactcaatgatgtatggtattggtagcaattctatttcatgtacctttaaaaatactgaaaaatacttctgaaggacacaatttcaccaagggtcatagctcttagtgtattcggatcaattcattacataacactgtttggcttttattatcatatgtttttagcttctgaaacaagtcatgcattttagctttattttgattaattattcattattgtcaagctattaatttgtcctgaccttttatccaggtcaacaatatcagtggttatctccctggaaggattgtctttttcttggtatgtacttcaaattcaataatcagaaaatacaagaaataaatagcagaatgcagttctatgagaaactataattttgataatgggtcaatgataaagagcttttaattactagtgcattgatgtgacacatttctcaacatttaactgcaggtgaactctcatcttacacctcgacctattttgcttacaaggcatggtgagagtttacacaatgtcagaggaagaagtggtggtgacacggtccctgaggtttgctttaactttttttttcctttactaccttccaatggggcacaccttcagaatatatatttctactctgatatctcatttgagtatatggaagttataaaatgctatgagtaatattcagcaagttttcatatttacggaaagtgtactctgaaaatgcagagccatttatttgatgtattgaactaataaatttataattaatggtgcacagtgaagatggagagctttactcgaagaaattagccaacttcatagaaaagaggctcaaatctgagaaaactgcatctgtacgtaatctcttgattgaattgcattgtttctagaggcaacttcttatgtcagtatagcatttggagatgaagactgtaaaggagatgagctaatagagtgagagtctctcatttttaattattctgatgtttagatatggaccagcacgcttcagaggacaattttgacagcaagtccaatagttggattcccaaaggtaatcaggaaagttttggagtatttcttacataactcttgcaaggtagttatttatatgggcgttgcttaacaattgttgtttgcagatacaatggcgtgctcttgatgagataaactctggggtgtgtgatgggatgacgtatgaagagataaagaaagttatgcccgaggaatttgagtatgtgctattgttatctttgtttacatttgtttgggagttctttctttagtagtttacatgatgtgcccatctgctagactgctgattgtcaatttgtatcttacattgcacttttaactatcatggttttttttattaaaaaaaacacaatttgagttgcaaaagatggtagtaaggtataaccatacaagtcgcagtctaatgtgtaagtcttgcacttatcactggctggtccacttgtatttattgaatgcttgcatatgaaacacttatgatgcttttccaatacttgttgcaaccagatcacgcaagaaggacaaattaagatatcgatacccccgtggagaatcttaccttgatgtgattcagaggtttaatcatttcttctaatattattcagaaaaaacttttcacagttctttagactgcacaatgcaatggaaataatcaattctaccagtacgtcttcagtcttcactaacttgtgatttggtaaaatcctcagactggaacctgttatcattgagctagaacgccagcgagcaccagtagtcgttatttcccaccaggtaaatctctaaacttcatgatttttccttctgcagagccattgatcgtaaaccatttatcctgtttgtaggctgtattgcgggcgctatatgcatatttcgctgacaggcctctgagggaagtcccagatattgaggtcacacatatgatcttctcttgttcattattgtgctagaaacctaagaaatacatagaccaaactaataccctttaatcttcatgtagatgcctctccacaccataattgagatacaaatgggagtcacaggtgttgaggagaagaggtacaagctcatggactgaatatacatacatctaggctcagtaggacagcaagtctttgctgttttcagatagtcatacagtaacacagatatacgatcgagtcactacaggtctacagctaccacattgtcatttttctcccgacggtgcaaaaacaaaaactagcacctccggtgtaaaactgtaacccactatacccatgaatcactgtaaaaagaagcattcacccaatcagtagttaaaaaaaaaaaactgtaaaataaaaggcatactgctaccaataaagagtgcagatatatacatatagggccctccctaaattttttttctaaaaacatcacatcgaatctttggacacatgcatgaagcattaaatatagataaaaaaaactaattgtacagttatggagaaaatcgcgagacgaatcttttaagcctaattagtccgtgattagccataagtgctacagtaatccacatgtgctaatgacggcttaattagtctcaaaagattcttctcgcggtttccaggcgagttctgaaattaattttttcattcgtgtccgaaaaccccttccgacatccggtcaaacgttcgatgtgacatccaaaaattttcttttccccgactaaacacacccatactgtcaaaaggtaacagaagttgtggctgatccatcactgcttagttggacttgatgagactgacctaccaaactttgaactgtcctgtcctcctgtgccatgtgaggacacaaggcaagcagtttcttgctccagaaactctgctcacatcatggcacgatgctgaatagtatgccaaaaacttccttgattccatgcggcctccatggctgctgctgctcatttgtccctgtctcaacaccccttctatctaacaaacactagtaccattttgtaaattatgtatgacgcggttgactttttattaacgtttgaccatttgttttatttaaaatttatgtgaaaatataaaaaattttatgtcatgcttaaaaaacatttgatgatgaatcaagtcataataaaataaataataattacgtaatttttttaaataagatgaatggtcaaacgttaaacgaaaagtcaatggcatcatatattattaaaatatggaggtagtactttgtaagcttgtatgcttctactactatactagtgtaatgcattgctattgcct

SEQ ID NO: 49231 - DNA, 1340 bp, Oryza sativa
  unsure (1)..(1340): unsure at all n locations
gtgatcagcgtcacggcgtgcgcgctgaaggcgcggccctggacgccaagcagctgggcgcgctgccggtgttcacgtgggggtcttcttctccggcgacggcggcgccgaacgccgccgtgcagtgcacggtgtgcctcggggagatggaggacggcgagctggggaggctgctcccggcgtgccgccacgtgttccacgccgagtgcatcgacacgtggctcgccgtgagctcaacgtgcccggtgtgcaggacgacggtgggggcggcggaggatgatgagccagcggcggctccggtcgctggcgtgtcgccggcgagctaggtgtgttgagtatcagtgtacattcgatcacttgctagagtttgtatctatgcacttgaaaacaaaattcgggtattttttttctttaggaaacaataaacttcgtaggatttgtacattgcaaatcaaatcgaccctgaatgagcacagagaaacttagaattctcgacaaattccaattaaaaactttatatcccactttcacatagcgtataaatccaggtgctccatatttcaacctctctgtgtttagggcgactgggttgcttgagattgatttaaccacatgtgcttcaaacaaatatttaaccatatctcatcggtccggactaattcaactagaaagccaacaatccatggattaaccatgatgactcgaggtaaaacttgaagagctcattacagcatgacaccatctcgaaggttcactgcttgatgcataagaacctactccctccgtcccaaaatataaacatttttagctataaatctagacaactatatgtttagattcatagctaaaaattgttatattttgggacggaggtagtagtatgtttccctacatcactaacccctggattggcagcctcagatgatatcactgcacttcaccaatcacaggctttcagtttcagaccatataccttgttgggaatttgagacagctgaagatactggtggttctctcgcaaaacaatcctgctggaaatactaacttttcacataaatttcaaggaaatccagacaaagttgagatgggggtcacttgttcagggaaaatttttctttcaagagcctttcttcagagtcaccgacatcttctctgccgttgatgcgcatgcacgctgcatgtcccctgacgtcggtgggccgggccttcgtttgaagcccatatactacgcgcaaaaggaaggaaacagttttgattagtcccaccgtgtaaatatacgacgccagaaacctgcataaaaggaagcaannnnnnnnnnnnnnnnnnnnnnnnnnnnnnnn

SEQ ID NO: 49232 - DNA, 1540 bp, Oryza sativa
attttgtaaccttgttctaatgtaaaattatggtcaaaactgaacggttaagaaggcgaagaaaatgtcaaatgtcttctttttttcccaaagggagtacatatgctgataagtacaatatttttaaaagtgagctcttatcagagttacaattgctgccgctctgctcaacggcccagatgtttcgctcggttcagttacaagatccgacggataagaagcttcagtgagatgtaacgtaaatcgagttatccttagtttagctatttgttacactgtttagtttatttaagacgcactgagcaagctggtgcagttaggaaggatagctaataaatgtgcatccagcagtagtattgatttgtttaaatgtgaatgacggttaataaaaacagtaacttaacgtgcatgacagatgataaatcatggtaaataaatatgtgagtctagcattgctcacatatatgtatagattcattaatatctatataaatgtggataatactaaaaagttttataaactgatcacatatatgtatagattcattaatatctatataaatatggataatactaaaaagttttataaactgatacggaggaagtatattttttaataatataaagaggtcccttgcaaaaaaaagttctatcacagggaccaacatccctctttgggccacatttgggcctaagcagcgcaaaaaccgcggcccaccagagggaagcggggccctctcctctactctcccgcggccaccttctccgagaaatccgcttcggcgcttctccccggctgcttttttgctccgcctcggcgcctcccatccaccaccgccaccgccatcgcctccgcctccgcctccgccgccgccaccgcctccgcaactcggcgctcgccccgctcaaccggcaggaggaccaaggtgagtcccctagcttgctggttgattttgcttggattgtggcgttgtgcggtggtctctgttcgacggcgcgcgcgcacggatttctctcctcatgccggagctcttcgcacgccgcgctgcctgcctccgcgatttgttggtgaaacctcacggtctcccgtctgtgcttggcccgtttgcgtacgtgtgccacggcgtgcgcgctagtctcgccgggcgccgcgcctcgtcttcgtgtcgcgccggcctgttgaaactaggcagtttcatttttcatggcatttgtttttagcatagtctagggcgcattgagaaagatgcttgttatcgggggttgtggattggtatggggacggtgggggcattccgtcgagcacttgttaggcaccaggattgttaggctttgtgtaggctaactgttacgttcccccactccatatgaatcaatgattcaaactcaaaacacaccacactgtttctgacacttgatacaaacaggattatttgggtatgcaagtagggaaatagaatcaaagacatgaaatcagcactaggttggagaagaggggaatagctgatattgaagaacaggggagagccgagtggacgaa

SEQ ID NO: 49233 - DNA, 740 bp, Oryza sativa
ctactgagcctagatgtatattcagtccatgagcttgttattcagttaaggtcatgtagtagctactctatttttgttattgaattagaatgtactagctcctccatcccaaaataatatcatctttgcctcctcttgtttgtcccaaaataagttaatctttcaagcaatcattgtattggagtttgtcatagtgaggaacaaatgcattgtgactaaacaaagtggaagacaattgcattgggatttgatgaagtggagggcattgcagttttttgcttttgtattgatatgtgtgggatgggtgaaaaacgaagttattttaggacgaagggaatagtagctttctttatttttgttattagtgtataacaacgttttgtgttgtcttattcagatggaaaacatacggccaaacatgttctcgaacatacctcagcggtatgtgggaactaaaagggcagattctttgtttttcatcaaggtgcaagtcgcatcaacagattataaggttcagataaaggaacatttggtgaataattgtggtatcagaagtaaagctgtcgacaaatggtttcaagcagttactgtggccacaggatttacagctgttgaggttgagaacttctactacattctaacatgtgcccatctatttgaatatttctattcagctgagatcaaagttgactgtgacaaattaaattcttggtttaacattttgatcatatgccaacact

SEQ ID NO: 49234 - DNA, 1046 bp, Oryza sativa
aggccatactatcctgctccacagagcaccaacataagtgcacctgtgccaacgcttcctatttcttgtgacagtgcaccatttgctcatggtgggtacgcccctagatcagctcatcgtaacaacttacgcacttatcctcctccagcttttgcatcgtcttccaaccctggagcagtctcccatgagccagctattcctagctatccacctgctgcccctagctatccacctgcaacctctgcagcatcatcaagtgtccagccatttcatgctgaagctgctgcacatttgaggcatccaaggcatgtatctgtagggggcagtggtagtgcaaggagtagaaggatgagggattcctatcatggttttcatcatttgatgattgaagacaataacttgggaagatcagcagctgaggtagatattattctctcctcttgatatcagtacaatgttaaaattttgaacacgcatctaatctattttcactctttgtagcggtttatgatgctggatcagttagttatccatgaatcaagagaagcattcgatcctcactgggacatgagactggacattgatgacatgagctatgaggtagaaagaatcaattttctctttaataccacagcagctttagaatgctatttaaacaaatgcaactttttctatacacaggagctgctggctttggaagaacgcataggccatgtgaacactggcctcgctgatgagaaaatttctggctgtgtgatggaggtagcctgctgcagcagtagtcatttgcaggatgatcaggacaatgaaagatgtgtaatctgcctggtaagatagtggatggtaccaatctacctactatgatagcgattcccgcagcgcattttacgcaatacaagttacttaatccacaacctctttttcactgcaggaggaatacaagcatgaggacacacttgggaggctgaaatgcggccacgggtttcactgcaattgcatcaagaagtggctgcaggtgaagaacacctgcccagtttgcaaagctg

SEQ ID NO: 49235 - DNA, 8621 bp, Oryza sativa
tgagcgtccatatgggtgcaagcccgtaggatgcaaatgggttttcaagaaaaagcttatgcctgatggtacaatcgaaaagtacaaggcaaggcttgtagccaagggttatacccaaaaggaaggcgaggacttcttcgacacatactcaccagttgctcgcttgaccacgattcgagtactacttgctctggcagcctctcatggtcttctcgtccatcagatggacgttaagacagcttttctaaacggagagctggaggaggagatctatatggatcaaccagacgggtatgtactagaaggtcagaagggaatggtgtgtaaactattgaaatccttgtatggcctcaagcaagcacctaagcaatggcatgagaagtttgacaccacgcttacatttgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcaactgagatactctcaaatcattggttcattgatgtacttggctagcgcaacgaggcctgacatcttatttgctgtaagcaagctgaaccggtttgtctcaaatccgggagatgagcattgacaggctctggaaagagtaatgcgctatctaaagggcactatgagctatggaattcactaataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctttcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgaaagaagagacccttgaaaagggctcattttcatgatgtgcttctcttctttcctgcatggtagaatggcttatgtcttaatgtgaaccgagtggcttttccaaacagagatgttgacctgcagaacattctcagaaggaacacacctatatgagttcgactgctagtcacagtctataaggtttgggcaatctctagatactcatgaaaggcctggagtttgacttatatgctccaaacagaggggatgcgaacgacagcccagtcccagtcaaggttttgagtgaaacctgatcacacaaaacttacaattcaaggcatagtccattgttcagttgtggtctgatgaagctcatttcctaggtggaagttcaacttgacagtctccaccaaaaccctggtatatcaaacaggcacaacattgggaacatttcttatgagccttgaaatttggtggggattgttaaaataattgggctaggcccaatttataatattaaatctcaaaggcccataataaatgttgaggataataataccacctcaggatttaagcgagaaatatctcaacctaaatagggagttattagaggctccctgttgaccagttgaggtgggggtcggaatgccacacgcgcgcgccgggccgggccgggccggggcgagggcgaggcgtggcgtggcgtggctggctggcggctggcgtgcgtgcgtcacgtcgctatccttttgcagccactaacccacgttcccacgattccctccgcaacagcgcgtccacgttctttctcctgatagataaggaggccgcgagtccgatccgacttcttcgcttctttcccggtgttagtttctccttctccgcgcctgagttgctctcgcttccccgcttctgatctcttgcgcgcacgagagattggaaggagtagtgcctccgaaaccacaccttcgcctgagatctgcaccgggtaggcgggtgatcaggttttttgggagtgcctcccgcacgactgctcatcgccatgtctggagttgctgccgccactgctggcggaggtggtacgccgccgccgacaggagctggatctggatccggagctggtgcgccaggaggaggtgccgtgaacgactacaccaacggaggcaattctgcctcaccatccagcggagggccattctcggggtataatcttctcctcctgctactgctgttagcgctattcctgttcccattgttagcgctatactatgtgcgctatgttcttgttcctgttctacatgatgcctctagcatgttatcgcgttactggtatgttcctgttcctgacattcatgatgcgcatagtatgctactggttatgttaagatcaccctacactgcttatgccatgatcattgtttcattttcttggattaaaatatgccgattaatgactatattttcaacagaccacaccactatcaccgttggccatgggcgagggcagtaccaccgctgcggctgagagggatgctgctgactcctcatctgagtacagctctcctctccgtcgaccaatggtttattataactccgatgtggcagcagtggatctctaccacaggcagtttttcaagtaccaggaaaaaaaaggtataaaagtgctccacttttccccatacgttcaattttgcttactacctaaaacaacaattgactatttctcaaaacatctataagcttggccttagagttactgtcatcctgtgagctatttttcactgagtttcataaacagttataatgcatgtaatcttttgatgacacaatctttgtctatatatatttagctcgtctagaacagttgcccacactcaagcagtccgattattatcaaaatattgccgattggcataatctaaatcagaagagagcagttctgggtgtagcaaaatcagtgctgagcctttcatcgactcatggtattacctttttttctctccggtatacattcttagttactttatccatatgcacatatcactaaatttgctaagtttttattgatatacagatgagaaagaaatctatcgctgcacgggtatcatcatcgagtgggatgaagtcagtaaatctgccactcttgtcacctcttcacaaatcctatgcaatgaggagtcacaggataacagtatctactatcccaacaccaaggtaaatttgtgaacaacattacttcttggacgtttgctcagtattcttctgttgagcttaggttttgcttcttagtgtttccttgatactgtaatttcgccttactttgtggtgctctattttctctcagcctttgtactttggttattgatgatacgaatagtatacctgtggcgagtaatgatttttggtgaatttttttatacatttctgttgcatttattatggttattggttgaagttaagaatgcttagaaatttcatagaaaatgcagcttcctaatagatacaaactttacctaagcagttcagtgaaatgaattagtgcccctcccacatccacatacacacaaggtcacacatacaaaatctaatatgtagcgatctttcaaataaaaaaaactgtgaatacataatgctaatttgataccccgtcaagacaaactaacaatctacacccactatttctatgtattaaaacataatatacaaagtctttgaatgcacgcagctactgccaggtcttgcccatcttaggccccgttcgatctcccgtgttggagatggatttctgttgcacgcaaaatgagaaaccttattagcacatgattaattaagtattactacctccgtttcaggttataagactttctagcattgtccacattcatatggatgttaatgaatctaggcacacatatgtctagattcattaacatatatatgaatgtgagtaatgctagaaagtcttataatatgaaacggaggaagtaactattataaatttgaaaaatggatttatttgcttttttaaacaactattatgtagaatcttttttaaaaaaacgcatcatttaacagtttgaaaagcggtgctaacggaaaacgaggtatgtagctccatggcctcacagttggctgcactacaaatctttccaattaacctttctcagttgctgagcaaattatcacaatggcacattctgactatctttgaagttcttttcagcataactactggatattttgcatggctagcagtatgcacaaacagtttgcactcactcttgaacacactaagccctaagctttttttcacgggttacatggttgcccacgaaggcgaacaatctgccttctcatgatcttgagcacattatgcgctaaacatttttacatggctaacttggttaccagtgaagatttccaatccaagtgtagtcttgtagcgtactcattgactgcccaatatagttgttcagctcatgcattcaccaaatgtttcacaaatattaatccctggcatccctggctaggaatttactaatttttcacagaagtcttttggatgtttttacctatagttgttgattgcaggattttatttcttgttttttctgtttgttttcaccattgttctcaagactcataatttgttctacttttgtattctcatgtaatcatcttttgtgaatgtcatttacttcaaatcacaatattttcttttcagatgattgctcacctattggatgggactacttctgagatggaattgctctactttagcaaacactatgagattgtcttttttaaggtcaatggggcattggatctacaagtcgcgttgctagatactgagttggaatttggcagtgaagcttgtgtgctagccagggacaaaaatcttgatttgatctgtagacgaacaacaatagtggcaatggacccttgtgaacaccaaaagaaccattatttattcattgatgcttcggactgtgaggtgataatataagcaattatctgattcctttattattatttagataagattgtttagtataacttcattgctaattttattcaagactgcaatggaggagcactgacaaattttaataggaatattgtgagtatggtattatatgctttacccaatgttgcttttattccaagctctcttattctgaagtgcttcgcattatggaaaaagttcaggtattttgattcttgactgtttctaaagtttttgaattcttataaatgattaggagtaagtagagagtagtcttcaaaacttatttgctcaattcttgcatatatatttatctctacaaaaaaaagagacaaagttgcatttagagcaaatcgtagcctaattgttatttatttatttattgcttgctcgtgtctgatttatttgatagtgttttgatatgaaaattgtaacaaatgtgaaatatttttatttttttattttcatctatgattcttaatttaactaattccatttgttcgaatctaataaattgatgataatttggtgtaggaaacttggtcgacctcatttgggtttgaagctgactgtgaattttctggatatatcacatttagagaatctgtctcgtgtttatggtattagttctggcctgattgtagcaaaggtatacccctttctccaagttttctaatgataagctctgcaaactgtaggcatgttatgctttttttttctatatttagcaaactacatttctatcttacacacactactacacttttaattgttcggatcatttctgatgagctggaccaaccaatagctctcaccagcccagccttttttcatttgactatcagtaggcttgtgacttgtgactttgtgagtccaacaagtgggaccaatcttttgaaataatcacaatagtccaagtgtagcaatatgaaatagatgcttgaaaaggtggatttacgataatttaatcaaatctagtgtgattttctgaagctaacttttttagcacagatacagactgttcctatgtttttaacttgattctaggtatccaatggttctcctgctgagagaaatggaattagaatgggcgatgtcatatttcattgtcagcaagagtccatttcaaccacagctcaggtaaaaatacgttgtccttataaatgcaagacttgtgggaatttattttaagtgacttgagctatttctttttagtttgaagatgttctgctagatgtatgtgagaagcactttgagaagggaatcaacttgaactccaaagtagatgttgaggtaagcttttattgaaattagcacattgctttgtggttttttagtacaacttattttttttggcacatatactatcttatagtataaatttctcataaaaaaaactgcagttttttagtgcatttcacgaaattaaaacttgacaaaagtaatgttctaaaaaaatatacaaccgggtgagactggcaggtgattctgcactttcaactacagaatcagcagaggtttgcatattcgatggatattttctaatagttttagttttggatgtttttagatcaaaagggaaaaacctgtgttccattttttaatggaaatgaaacaattttcttcagtttaccattcttacattcttagcacactagaacattgtttaatcgcgactgacacgagcagaaactaaaatgagaacaagttagatcctgcaacatatagttctagtacagaataaacgagagaggaaaggaccaagacatcatacttataatctattacctgccgtgaaatcttatccctatctaaatggtacctttgatcgaagaagccaagagataagattcaggtcttgcaggtttgggcacttcttttcttttcataccgtaccccaattggaaaggcgatacttgtgatgaccttaatgattgcccaaaaatgccatgccatgtgtccgttgatagctttgatagcccattttggaaacttaatgactgaaaagggatggatggggatacatatctacttaagtaaaaggagactttaagaagcagtttttctccatgatatttttcagtcttattcaagaagttatcagctagagacatatttaatcaaggttcaactgcaattggtatcatatcttttgttatcatataccagtccctcaggcccatgcagcattttaattgtttgcttctttttcctctgagaagagcagcattatggtctctcactaggatatctttctctctagatctctatctatccttcatctttccggactcccgaattgaagaaattcctgggtgatttctttcattctatattatcatcgacagataaaacgtctctcagattgtctacccaaaacattatattcattaaccattttttttctgtttagcatcgacactcacgttccaacccttgagagtttttttttcataaagtctaattttaaactgcaccctattaattacttttgtttcagaatgcagagtattccaaatctgtttgactaagccatgggaatctttcttttcaccatttttgaaaatgaatttttcaggcctgatatcaattggttatgtttcaatgaagagcgtaaatattgccccaattgtaggtaaaacaactacagtagataaaggaaattgcgtatcctaagaagtagataaataaattctatccatagcagccaagaccaaagtacattggttgttttcactaatgtactgtcttgcagcattttcgaatttgagttgaatagttcaaatattaatcaatgaaactcttttggtttcagataaacccaaaaagtcaggattacatttctgttgacaaatatactttttgcctttacagctcgttgtttataacttacgcaagcgttccagaagaaccgtcagtttgtccgtagagttatcagatggcatggaggtcattgactaaggtaacaaaattttgccttgttgcccctagatcatgtttggtcacaacattttgttgtttcttacaaattatgcggtcatgtttcctaatattttgcagggttatgggacgactaggactgcaaattgctgtgaggaaattgttattttgtagtagg

SEQ ID NO: 49236 - DNA, 2209 bp, Oryza sativa
tagaatccggcagatgcgaattattcggtaggttatttgctggataatctgaagttgtcaacacatgtaaccactttatatgttgcatacaacgtgagttggcccatcaaatggcctaattcatcgattaacttggattgcttagactacgtctctcaccgtctcatcacacacttgcgtagctatgtttttatatagagagaatccactcagtgccactgagttttgcccacttctacaatatacccctgactttgtcaagttgaacaatatgccattgggttttctttaaccttcactgcgtgccatcacagcacagttagcatctgttagcgatgtaaaaagacctatttgcccctaactcattatatctgttagccatctttattcccattttcaaagaaattcatcgcgtatgcattttcatatatacatcggtgctcatatattaaacctaatctgagtagcagtgcttccaaaaacgaatggattcgcagaaactagtatcggtaaaaatgtaaatacacgcctctaccacctgctaatctcaactcaatggatggattcacagaaatggagatggatcaatgcctctacaaagctcgatcagaccttgagcttgaagctgtagttgttggagcggatttggatccgcctgccggcgacgaggttgtcgacgacgaggttgcaggtcgccttcccggtcatcttccacagcttgatggcgccgaacttgatgcggatcggcacgcgcgcccacaccgtgagcggcacgaacccggtctattgctgttgcagcagctgcgccgccatggcgctgtccagccgcgtctcgccagcgacggcgacggcgaggacgagcacagcgagcagcgtccagcacacgcaccggcagcaccgccgcccgcggcccttgcgccgacgcccaccgggtggattcggtggtagtccattgagatggagacgctgcttgccgggcggctggcggcgcgtcgatgggacctcggcgaccggccgcgcgtcgatggggaggccggcgagccaccgcgcgtcgagggggagccgagctccaggacgcgcgtcgtgggggagccaggcggccggcctcgcatcgtcggggagcaagacggccgaccgcgcgtcgtcggggagccggccggccggcggtgcgtcgaggagtcaggcggctggcgttccatcgatggggagtcggcgccgctcactagagaaacaacaatagatcgatttgggggtggatggtgtgttacggttttcagtcaacaagtacaatgatattttagtcaaagggtattttagtcatttagagacaattcaatgcggtaaacggaggccaactaacggctcgtggacggcgatggcacgcagtggaagttaaagaaaacctgatgacatactgttcaacttgacaaagtcaggggtatattgttgaagtgggcaaaactcagtggcactgagtggattctctcttttatataattggcataatgtattcatgctatttaacacttcagtatatagttattatgattgatcatcattgattattgggttgttgtctattatattgctaagctgatgtggcattgatttgcatatacacgtaacgaccgataattttaatctgtttttaaatcaggtccgcaccattttcaacatccaaaacaatctgctcgatatcagtatccacacactaaccgcatccgcttaaaaaaatggtttgaccactattcgtctgaatccaatctgttttcacccctacttcttgtagccccaccgaatgagttgatcgtcgggcttaggaggacgagggcaatagtcactgtcaggttgggcccacacctgtcctcccgcatagggcccacctgcttcacatcactccccctgattccccgccgcaaaatccaatcccaaattcccaaatccaagccaccaccaccacaacgagcccagcttagagcataccctatctctctctctctcgctcgggcgcgcgtgagcgcaatgaggactttggggtcaaaaggaattgatgccatcagagacatggggggagtcggcggcgtggcggtggtggcagggaaggagaaggggacagccaaatatactataagttccaaagtgcgagtaaaattgtttgataagggccatcccaacctaaaaaccatctagtggtttccatacttatcac

SEQ ID NO: 49237 - DNA, 947 bp, Oryza sativa
taaaactagtttcttgcatgagaaatattttttttcatcttttttcctcttttctcattaactctttcgccacctaacttttcacttatgtgaaggattgggattgccctaatgatgaagagagaaaaaatgtttgctcaatggtcaagtgagaatttgtgagttgtaagatactccctccatcccaaaatataagtatttttttacttcaacacaattttcgagatgatattttgatcaatgatatcttataaagttaagatgctttaaatcaaaagacttgaatattatgatagtttgtttaatgattaatctagtaacatcaattgtgcactttttttattttttgactattaatagtcaaagttaaaaaatgcttgacttagtattattctaagattgcttaaaattttaggacggagagagtactaagatagtgatggtacgaatccacttacaattattgtttctaaagtaacgattgaagaatgattgggaagaaggtggggctgtcagctggtttgatctgcggtaaaggtaaaaaaagaaaaaaaaaactcccctacaggtatctgtacttcttttaaaacaaggcaatggtggtgccagtaaatctgccacctcaccaactcgattgtgtagagcattatttacctattactccatggttgtacctactcttctttcatgtgctttaatattacaaaatagtcctacatatgactcttatcttatttcatttctaaaacacaagtttattatgcaaagacacatataaggacgaatttgtcccaaacatcacaactaatttgttccaagcaatattagtacacatctaatttattttatcatagcaaagcacggtgtcggtgaaatgggaaccagggtacccatttatccaacaaaaggatcattatcaaataagtagcatgctcaaaatatcttta

SEQ ID NO: 49238 - DNA, 2628 bp, Oryza sativa
gtcctcagcaaaaggggcgtagaaacctgcaagacctatatcttaagagaacgagctaagatccactttgggcctggcatagtcttgggcccccgggctcaccttagccagcgcaagtcgtgctactcgataaagaggagtgtcgagacataccaaatataaaggtgtaaactgaggtttgcctctagcctagccttgtttcgggtcacagtttcaccttggtccttgtataactcacgtccctctgcctagaggggcactgaaacgtacaagacacgtaatcttggaataatttttcatcaacgacatcttcgagaagctcatctgagaataaccaaactacttctttaaacgcgggagggcgcgacctcagaacttgccgggaagatgggcgtgctccacagccagctgtgaggcagcatgccccgccataaatgaaacaggtttatggggaatccccagccagtctggagttgaaaggacgtggacaagacaccagcgctaagtcacttaggacggtggcgcctgggacacacgtcgcacatgccccgcgccacctaatttagccaaacgggcagagaagcaaccgtgatgctgtttttggcaggtcaggccttgtcaggcccaccacgcaccacatggtgagcacactggcggaggcccaacttgtctcagacggagtccgacaggcccggggtaatatgattttcaagactcgaagggtttcttgaagactgtgtttgggaaccagccggcaacgacaagacgactgataagacaagactaagagtagatttgaaataatgtgagcccctccttggactataaaaggaaggggaccagatatgggtgaagggttggactattttagatcagtactctcgctttgtagcctgaaaaggcctcctttgtacttatctgatctagagaagacaacaaacaccgatacaggactagggtattacacctctgggtgatgtgaacctgtataaactcctgtctccctctcttcgcgcgagggggcgggcacgaacccttatgatcacagatactccgtacctctcaccgtcaatccccctggtcagatcttcactctcgggaggggtctccactccccgctgtccgagggaccaccccctcgacacacgagtatttaactagttgggaagaaagactctggaattttccctaaataaggggtcaacattagaactttgtctggatttgctgatggcttgaaatttctgcgaaaagagccccattagttgcttaataagccaaaaccaaagctaaaatttaaattttcaaacttaaaaattgttttttaagatattttcaatatagcttctttgtcaatattggtttttaagtcgataaaaacatatacatatatgggaacactacaaaaggttagctccacgaccttgaacctcactaatagaggcagttaaactagattgggtcaagcctgttgtgcacgacagcaatgcctcgccacgccacatgctatgtgcatctatgaggcttctggccaacaccaaatctagcaaaaggagccagatccagccaagcatcctcgccaacagtatggaagatgacgatgcgcgatggatccactgccatctggtggaaagaggggcaaacagccttccaccggagcgggcaaccacaactacacctccgttgtagctccgcatgacaccttcggctaagatgattgaaagcaaggaaaaagaaaaaaagaaaaaaaaaggagaaggaaagggcatagcatccttcaccttcgcatgacaccttcacataatgttgtgggcagagcaagatgatatctctaaatatagcataatgtgaaggtgaaggagagaaattagaagagagagggtgagcgatctctcgtgcaagcagcaacctctacatcatctccaataaaaatgcaagatggtgtaagattgaactaataaaaaaatattaaagtttgtgtattaaagatgatatgctatacttatctcctaattaataaatagatcatatggctcaaattagagatagcatccatatgcactataaaactttctcttatagaggactcgagggaggtagcaacaggggcaagtgcgtccatctccaccgccaccaacaacgttggggttgatgccttgatgggagacgactcaagggttgtggcaagatctaactcccgagctgccggatgcgttcttttctttcatttcctaacttctactccttgtttgtcacgcgcaagcttgccgaactgctaaacggtgttttttttaaaaaaaagttatatattaaagtttatttgaaaaaatatattaatttattttcaagttttttaagctaatacttaattaatcatgtgttaattgatcgatccgttttacatgccaagaaagggttcagacacaaccttaggatgcatattagtggacatactaattaagtattaactatcttaaactttgagaattgatttattaaatagaaaaattttgtattaaacgcatcatttagcacttgatgtccatgatcccttcccatgctgctaagccacgcttctacagttgctaagccccctgccacctgtgtagcagtcagccgcctgttggg

SEQ ID NO: 49239 - DNA, 742 bp, Oryza sativa
gcatataaaaaatattgagatgtttaatgtcacattatcaaaatttggactattggagatccactatgttagccaaattctaccaatcatcttgaagaagatagttgtctcaattcacagctgcacaaacacacaaactccaccaatcatcttgaagaagatacctagttgtcccaattcacagctgcacaaacacacaaattccatcaatcatcatgaagaagatgcatagttgtcccaattcatagttgcacaaacacacaaactccaccaatcatcacgaagaagatacctagttgcaccgactcacaactgcaccaacacacaaactccaccaatcatcacaaaaaaggtacttttcctactcccaccagtgacaaattcaaagctgcacaaacacaaaacaagtcagaaaggcccttagaagattgtaaatgctgctacaaagttgtcatatatatatatacctggtgagctcccaggcaaaattcatagatatctgcagcagatactgcatatcccaaagactcaatacggccatggtataaaccaatgactgctgcttggtgactcagcactggagcaccagaacaacctgctcctccaactacattcagctcaactagatgcatgctgtatcctttccacaaatactgggtcagctgcccatatactctgtctcttgcaaccaattggccagtgattactgagtcttttctgcaaggtggccaagacactaaca

SEQ ID NO: 49240 - DNA, 1580 bp, Oryza sativa
  unsure (1)..(1580): unsure at all n locations
gcctgatgtcaaacccaaggctgcaaccaattttaagaagaaaggcaagggaaagacaaagggagactgctttgtgtgtggcaagtctgggcattgggccaaggactgtcctgagtgcaaagacaggaagtctgccaacatgatcattagcgagggcggaggaacatcggggtatggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcacttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtatctaaatatgggacttttgttggaaaaggttatgacagtggaggcttgttccgcttttctttgaatgacatgtgttataatcataatgctgtgaaccatattagcgagaatgatgagtctaatgtgtggcattcgcgactctgtcatgtgaatttcggttgtatgacgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaactttgaaggaaaatcanacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagatactgcggggctttccaaggaatggtggggtgaggcagttttgactgcgtgtcatgtcctgaataaaattccaatgaagcataaggaagtaacaccattcgaggaatgggaaaggaagaaattaaatctctcatacctacgaacatagggctgtttggccaaggtaaatgtacctatagccaaaaagcggaaacttgaaccaaaaactgttgattgtgtgtttcttggttatgctatccacagtgcgggttatagattcttaatagtaaactctggagtacccgacatgcatgctggtacaattcttgagtccagagatgctacattctttgagaatgaatttcctatgaaatatacacctagcacttctagtaaagaaactgtcatgccccatgagcactttgcaccgatagaacacgatgatcaaa

SEQ ID NO: 49241 - DNA, 3513 bp, Oryza sativa
aaaaaaattaagcttatattgaatttttttaaatgttgcacgatgttccagcaggtatatcgaaattgtctcactaagtagattgaaaatgtttcactcgtttaaattgggtattgtttcaccttatataaaaacaatgtttcagcaaatagcgaaagaatgtttcagttcactgcaacattagatctatacatagtgaaacattgtgagtatactaggtgaaacattttttggtggaacaaaaagtaaaccaaattcccttaataggggtttccaaaatatatgtgtttttgttgcaatggaatatttcgttcactgcaacattagatctatacatagtgaaacattgtgagtacactagatgaaacattttttgtggaacaaaaaataaaccaaattctcttaatagagagtttccaaagtatatgggtaatttgttgcaatagagttgtgtgtgtggacacgtggtgggctaggggaggggagcgcgcgtgcatggggcggtggagcgcccaatttctcctcccccgcccgatcgcccaacgggcatcattatcggtctgaaatatgccaagaaaatatacttaattaaataaaccttcgttttatactataagtcaattttgattttttttctagtcaaattttccttaatttaattaaatttatagaaaaatttaacagcatctacaataccaaattagttttattaaaactaacatttaatttattttgataatatatttgttttgtgtcatattgctatactttttttctataagcatgaccgaactttaaaaagattactagtgaaaaaaatcaacataaaagggagggagtatgaacgacagttataatggtttcagagactgaactcatcattcttttttagaagttttgttccctaggtgtacaaattgcattaatttgttaatccaactattctgcacctacagcaagtctgattgaaagaataagccaaacaacatatttgtaaataaaaaataatttgtgaatgaacttttatatacgtgttcttatcgacctaaaagtaaaagctgaaaaaaaaacttcaatgaaaaaactccaaaatcaactctaaatttaagattgaaaatttaaattttggctgataagtataagtataaacgaaaagatggaacgtttaaaataatttataactatttggatgagataaaaaaaagagtagaggtccctttaagagccaaaaatgactttctcatgtcattaggctatctgctcagaactctgaaacaacatgattaggagagggttttttcagacctgcttagcatcagggagtatcctcctcagtgtagccaggtgagcattaatcctctcccgccgccgcctctcagcctcgctgtggatcgtcatcgccgtcgcctgagccgccgcgctcctccccgacgacgatgacggccgcggcggcggcggctccggcgccaggccgccctgccgccgtggcagcacaaccgtgcctctgtacactgaagaaagatcatcatagccaccgtggtgcagatgctgctgctgcttcccttcttgccaaatctgctgctggcatgcagccatctatccaaaatcctcaactatatgaattaatgacgattaactcaataatgctgcaagaagaatcagtagactgttaattcgaccttcaagaacaagaaaatgatgaagtaattagcactgtaattaaacatatatagatacctatatgaggttcgattatttctgtcggtgcaagaatagcaatgaagagtgaagtgaagtgagggctgaagagaagctaataagagggggtacttaaactgctgcaaaaggaagaagaacagaagcctgcaggccctcaccacattaatttgttaattgtaggatagatggatatgctcgtcagaccaggatgatcagatcatatctcacctcatgataaatctatgtatagatgatctatcaatatatatgtgcatgtgtttcaattcattattggccaaccaaccacaaacacacaatgacatgtacacctaggtgcattctttttccacatttgatccccactaggtgatgctcctttggactattcagggatagctcacatcatatcatatactactaaatttcaattagtcactacctagggactatcatgagtttggaggaggattaactactacttaattagtctgagataactgaattttgtaagcttggcaaatgcaagcctgctgtccaactgagacttctttcttggcatcattgcctgaaaagcaggggtctttctgcatctgaatgatttaattaagaacacacgcacgtacgggtgtgactgatgagtaggattacatggtgattaaggcacgcaattagatcaattggctagttatactaatcaaatcagtgacaaacaaatggctagcttagctaggttaggacagttgaacagttagatccaaatccaacagttacagccagccgccatttggtttcacactaggatcgctttgcggcttcacacaggaactctcttggatgcttccttcgccacaggttccaacgtgtgattttgcgcacgtggttaattcattaatccttctgttttcattctcggctggatttttttaatataataataatatgatgaatagtcattggtaagtaggacccacttgtcggtcccttttgttcttgctttcggtttgccacgtgaaaaagcagggcatcggcttcgaggcatttatttatttctcttgtttatttaaaaaaaatgcttgatacatcttaaagcggatggttaatgtacatgggacaaattttgcaatatatatagtatagcaagaggcatgtctgaaagttgcataaatatatagaatcggaattaacatgaggagaaattactctctctggttttaatagatgatgtcactgttttttttcatgagcaccacataatattcactatttgtcttattttaaaatttctgtgtaaatatgtaaatttgtgtttaaaatacctttagtgataacctaagtaacaacaaaacaaatattaattatgcaatctttttaataagacgaatggttaaatgtatatcgaaattaatggtgtcatctattaaaaaccggatggactacttcatttggcgagaaggtcaatgcagatttttaccacctaatatacacagcttgggatttacagacatatcgtataaagtttagagcgatgctttgtttatctctactgatagtattatattaccaatagaaataatttgaaccattcgttattaaaggtaaatcagtaatttactaatacagtgattaggttaactttatcatttatgttttttttcagggctagatagatatgtggtcatttattgcattggtatcgctcctattccatcgaaaaaatcaaaaaagaagggaaaatgtttagtaattgataaatgatgattagaccctttcgcaacttttttctctttttgctat

SEQ ID NO: 49242 - DNA, 3279 bp, Oryza sativa
cccaaatttaaatcccggttcctcccctcccaaacgcgaatgcaccaaaatccccatcactttataggtttagaagttatactatcacgagcaggcattttaacgatagtgtacactttctacagttggccttcagcgatgcatcgaaagcactactactatatgtaaaatgaatactttttaaataatgacacctgaacatgtaaaatgtcctgcattggtaatgtgcctaaactgatttttttttactactatacattgttatattacactattgagaacatggttctataggtgctaatattgtcggcagaatcagtttcaaacgtagggatttttctttttaccttggaggatttgagaaattcaggcaccaatatctttttcaagcgcttattcccttggactgaatttcttgattaaacttcctgattctgtttaacagggattctcacactgtcatctcttgatttccctttatcgtagacgttctcccaaaaaatacaatcacaaaggtagacatctcattcaattcagagaaatatatttttgtatatgtgtgtcgaaacatgaattcggcaataataaaacggggtagcgcacgagacctaaaagtggatggatgtggagacaaatgatttagacaggttcaggccctctcaatgagaggtaataccctactcctgtttggggatttgaatccgccgagtgtgtattgatctgacgatcaggttgtctcatgcccctagaggggctccctgccccccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacagtagcccctgagaccttcacagtcgaaaatataatcttctctcgaactagattactctaaagccgagtgcttcaatcatcttcgccatggtctcccgagtacttttaccaaatttgaagactgtggagggctgaaaaataaagtcaggtgcatcgaatagatgcacctaataggtgtagcccccaactatgtgattagctgaacaaactaaacatatagtcaaggaataaattatccaattaaccgagtggtttttgataattatagtcaaccaagtgacttgatactaatatatagcatatgcggtgtgaatccccgaataatatgatccaagtgatataccgactgcttggcaaaatatgatgcgtacaacctaaagttgacaacatctttgaaagttcacatagcaaaacaattataaagaagcttgaatgctgtgaataaagaaatttccaaagtattgggcatacgccatgcgcacactgctttaacagatgtgcttaagtccctaaaagacacatggtttcaccacacctggaaatatatggcatatatggtataacatccgagtaagtaaactcataaaggatttaccaaccgcctgaaaaatgaccataatatataatcagcctaagccataatattggtcaataaaaatgcacacttacgtggcaaaaaacaatgatattgtatccaatcaattgcttgataaacccaaacagcaccttgactatataaaaaagccagcggggcagctatataaagctttactgtttgacaccttttaagatgcattgtaccaactcttaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctagaccaaaaaatatgccttcgacaccctttaaaggatgacgcatgtaacatgctctcgagtaataaatcttccgggtgatatagaccaggtgtagctcatatgaatagcttctgatctgagtgattatcccttatgagatactccaaaatatatataataattgaatcccgactggcgcaagtattcggttgatagcccttacggggaataataattggtccagtctttgagcatagaaaatagactcatgactatgaatccatgtgggatgtatccggaacaagtccaaattggagatataatcctcacgcttgagttgatgagcccctgagcatatagcttgtccttctgtcatagtcaaaattgtccattgatggtagctgacgcagttggcatagagacaagacgaccaacatagagataatattgcccaccagaggtggcaaaaatattggtggtagtgaagataatgataccaatcaaaagtgatgaagttgcacagccgtggaggcgaagaaaccagtcggcagtagtcaggtcagccatcaatgaagatgaaagcgcccagcgataaagttgtgtagccatggcagcgaaataatcagtcggtgacagacgaggcaaatcaaaggcgatgacaaaatccaccaatcatggagatgaagaaaatagtcggcgacgacaaatgcaactgacatgatgaagatgacgatgtcggtgatccagtcaatagcagtgtcgcaaccaatgataatgacgaagacgctcatcagcatttgcatagtaggtcaaccgtcaaggtgaaataataagtcagcgaaaacataatcatccattagcaacagcggagatgtcagggccgatgaagcagaggtgctggtgatgatgtcagtgacaataatccatcaaattaatgttatggctgttgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcatcgaatagtcattgcttgattgaagatatgtgttgaagatgtccgagtagaaatcctgaatattggagagccacttgttgtagtaaaataacatggcattgcatgccgagatgtcgaggttcacaaagacgtcg

SEQ ID NO: 49243 - DNA, 1725 bp, Oryza sativa
tgcctgcaggtcgactctagaggatccccaagaagatagcatcagttggcgttataacaggccagccgtgcaggcggtgacaccagtcagcggcggatgcagcggccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcattgcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggcccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaacggcggcataataggccagccgtgtaagcggaaacaccagtcgacggcaacgaaggtgagccaacggtgaagatgtagacatccaacaacggcggcataataggccagccgtgcaggcggaaacaccagtcggcgaaggccagccggtcggtgaagacgtggacgcccatgaacggtggtgtgaccaaccgaccgtataggcggggacaccagtcggcggcgacgaaggcaggccggcggtgtagatgccgatgcccatcaacggtggtgtgaccaaccgcccgtatagacgaggacaccagtcggcggcgac

SEQ ID NO: 49244 - DNA, 5327 bp, Oryza sativa
ggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattggaacggtagacccgattgaagatttgagccatcgaaattgatgagattgatctcggggtttcttctgaagttgattccatcgcacttttcgacaggtaattcgacgcaacccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgcccctagaggggctccctgccccccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatacatatatgttatcccctattactagtcggataaccatgccgtgtgggtatggggtacccataatctccacaatgtgtttttttattttttttaaaaaaaattcagattattgcatcatctcgtttatacaaaattgcagaatcccatttcataatctatattgtatattcttttagcttctaagttgaatggacctcatgcatgattaaattttcaatctatattctaactaatgttcactggtcaaataagggaatctacatagtttatgtggactgccggcatatatactatcttcttctaccctataattcaccaattataatcctacaaacctcatttatcaaatccagcgatccagaatcaaccaaaccaacgccttagataagaagctagaggcaaaacattcagccaccgcagccgattgccaggaagtcctcgccgccctttcccctgatcgagtgctcgatctgcctggacacgtgcctacggcaagtctgcctggactcggtgagcagcttttttttcttatatatacttgcagtttaattttcctctctcccactgtagcatacatcatcagtgagattattgatatcagattatgtgcatgtgtgacacaaaatttattatataaatggacttttcatttaattgccgcttcctgaataatgtaaataatcctaatattaaattatcaatggctattagcctattatgcatttgtgaaaaagttactgaagtagagataaataatgaatacaaatgaatatatacttgcagtttaattttcctccctcccactatagcatacatcagtgagataattgaaatcagattatgtgcatgtgtgacacaagaagttaatatataaatggacttctcattcgattcccgcctcccgaataatgtaaatacacacctatttccatgttaacaaaataataaacaaatcattaatgttaacaaaataattccatattctcagatatatcctaaatttatttttcattggttggtgtagctttccagcatataatttgaacaaaaaaaatccatgattaaaaaaaaagaacataagtatcaccatttttaatatatctgtgtgtgtttttttatacattcttatggaatcatctttttcttatcctcgctgttaaattactttggtacttgctgtacaaaataatttgagaagctcaccatgtgtttatggctaattgtccgtactaaaatgggattgaaattggataacatcttcaattgtaatgcaatatgtgtatatgtctaattgttttagcgatatggagtctcataaaatttattactaatgctagaactgacagtctcacctgcactgaactattcaagataccatcatcctgcccttgatggtaatttagaaacttagatccattcacgatttgaagattgctaacgtgatgaagaattccaaaatggaggctgaaccttctgagttaatggcgtctacaattagataaaaccaaccgatatatgaactaaaatgaacttaaaagacttttattgagttgaactgcacctaaaataatatattttgtgttagtatctctgggaaggtatcgatatgtcatttttcattattccactaatattttggacaaacagcaggctcatactgcatactattttgcatcttgattcagcagctagactcgatgtctgtctcttgcagctagacttggtcagccatcaagtttgcagtcttacatgcatgtttaaaaaactgagaatatcgggcacattagcgattcctgataagagaagcttagaatatgtctggggagtgaggatttaaattcttagtttttagcccaattgacaatacaaagatttgtacccaggatatatatcatgaattagccatttttcctttgtatggacctatgtgtaagagatgatttgaaaaatacaacatttgtgatgttatttttcaaatacaacatttcaagtgctttattcccttggactaaatctcctgattcaactttctgattcggtttaacagggattctcacactgccagctcttgatctgcctttatcatagacattatcccacattgtgtactgtaagtatactctgcaaactgaaaagtatacatgttcttatccagttctttacaacctaagattttaaattgacttttttttacataccttaattatatgaaatatcaggtgtgaagccaaaataggagcgacaacaatatgaatctcctgtatagaacacaaagtgaatcattaggctgtttttgtcggtgacctttggaatatattaagaacaattatgattaacttagcagattctatataacaacagtactacctccggttctataactattgacttttgggataaggttgagtctaaacttggacaactttgactatcaatatttttaaaactgctagcaaccatgcctgtgccttgcaacgggcaagacaattgctcttttgtgtattgcagttggtgtacatatcgtgctttgttgttggcattgatagtaaaccaattagattgttattgtcaactcaggattattatgctttgtacacaagaagcttctattgattgatagagtaaatcgataagaatgtaatatgttatattgtgctttgctgttggcattgacagagtaaaccaatcatgatattattttcaactcaggtttgtttattattttatctgttaggaatggatccaaatggttcgtccaatgggttcgcattgccttcagagatatagcaaatgtttcttcaggtgttgtaacacgccagatattttgtactttgttgttgagttctatatacacccatgatgtttatgaactccactatactgtcgtgtgcccgcaacaaataatagaataactcaatactttttaacatattttttaagcgtatattgcccttttatattgtatactgacatgattatatataattaagtcttgtaaagttttattgtgcccacacaatatcattgtattgcactttacatgaaatatattttatgtatgatataaattgaattaaagtttaaatgcacagatcatataaaaatatattttgctaacataaaattttaaaattattatagacaaatagaattgcaccgtagcgtttagcacgggcatattactagtatattataagttcttttatatttgttctctgtcaaatttatttaaattgattaagtttatgaaaaagaatgtagcaatatttttagtataaaacaaatatgctacggaaatatatttaatggtcaatttaacaaaactaatttgagcttatagatgttgttctataaatttgattaaacttaaaaatatttgacttgacttaaaacatagaactgagggagtaatgcatataccttatctacatggatttgtttcttcccttttttggttccttcacttctctgtttctccattgcatattggactggttcattggacccctgaaagggctctaattggcttggactggacgtggccggcttgttctatttcgacctggacatcaatccacctcgatcagacgtaatctttgaactcgtaatgtttgtttacatttctggcacctttcttggtgcttgcattctttatttttttccaatattttatgacttattacctttatagtgtatattgaccaatgccacagcacataaatcaatataaatcaatatgaatgagagggatgataatcctacctgtggtaaagattaccgtgggcacattattggatggacacaagcgtggattcaattttttttgcacgtgggtacatccgacctggggccccaaatcctaacttgtaggcttgagtattcttttatgcctatggataacccacgcccgacctgatatatgtgtttctagctgattttgtctaatcctatatactttagccaaattaatcacatcactcaatgaaaatagaacttagccagcttcgaactcaattctatatctctcccttactcatcttctctcctgtgacgaaggtcgatcgatagagcaggtaggtgtcagcgtagtcttgcttgtgattctagattcttgtatgttcttagtgcctatctgagtatatatatgagctagtggtgcctatctgattgtgtcggttaattatgttgatatgtttaattatctaataatgtgaggatattagttatgttttaataccctattgggtacccaccgggttgccaatgctcgtcgagcatgggcatggattgatttctacccaccaaaactatcgggcatgcatgggtcaggctagagatatctggtctacggtcatatcatgcgtgttcttgctccacccgactcggctcattgccaccccctagttcatagtgcaatggctaatgtgttatgtgtgtatatttgtgatcaggcaaacgcattgcttagtacatatccatgattgagctacaattgcacttctagtgacattttagaaacaagccccactgcttattgtcccatgaagcaataagatgggacacacgctaaagggaaaaaatgataggccaaaacaagcagcatgcgcgcgcagagacagagaaaacaaattattatttttatttaaaccagggtcgcaactcacaagcttatagtcaac

SEQ ID NO: 49245 - DNA, 3459 bp, Oryza sativa
cattattggaaataatgagatattatgattgggtgaaactgtcttggccatctaattggagtatttgggagaggtgtgtgcactgtgaagtcagcctgatcgtttgattcgtagttatctccagtcttgggcagcttaatctggctccaagttggcagcaagcagtccctgttctgaactgttagccgtacgaaatcaagattttgttctgaactgttaggcgtacgaaatcaagattttgtttgggatgggatcgttttcggcaatctcttcaactctgtatatcacgtcgctttttatttggttaagttagtgggatttggtcggattttaactctcacggtgaggaaaattggattttagtggagtatccttttcagccctgttcatattttgtttggaggaattgtcagttctgctcctcagctatcatgggagctttacatttaatcttgtgaattaactaatataagctaacaacattatttaagacatgcgtttttagaaatcggattgttttcttcgtagttggtttttaacaactaaatctggtccatacacgtttctttctttatttatgagtactttcgattgcaataataattaggcaggtggtttgcttgcacggcttgcactggtgttgtacttttcttacgttgttgtcagcaagtacttgcgtttcttctttcgcaatcttcttcgacttatttaggttggacaaattaatttccgtggcatttatactagtcactgttattcaatattcctaataatcgtggattgctgtaccttactccatgtaaatttgttagccactttttatctcgggatagagataaagatggtaaaagaccaagttgcccatactagtaaatcattgatctgtgttgaatatgctcttctatgttccacacagatttaagcagcacttgcgcatgcatgtatgcgaattcaaactacaaaagttaaaaatcctttactgtgtgtgcgtgtgcaccttacaataatcaataaagtgaaaaatcaaaacgcaccttacaactcttgtaaggagggagaaatgtacagcatatagttatgcaataaactacatattggttgtaagttcataaaattgcttttgcagtatcggattactaccagtttgatgatttgcttactgatgaagagaagacacttaggaagaaagtccgtggtattatggagagagaaattgcacccattatgacagaggtatgttgttgctatacatagttttcatttgttaatcccctgcttcttttttttttttgcaaaacatatatatggtatatcttctaggactagtacatttttttcttgtcgtcgctggatggtaactctcccttgggttgactagctgttgtgttacagtgacagttgcctgctcgatgtgtatcatgtcataactataaacccctatgggctttttacatatgcagtactgggagaaagcagaatttcccttccatgccattcccaaacttgcaactcttggcttggcaggagggacaacaaaggtatataaaatactaaatcatctagtacttatgttttacatttgactgtaaaatttcaccagtacgctcgttgtctcattgaaatttgatccttttccttgaatttatcttggcgttacagggatatggttgcccaggactctcacttacagctagtgctatttctgttgcagaagttgcacgggtggatgccagctgctccacatttattttagtacattcctctttggcaatgagcacaattggtaaagctataacttattcagatgattttgtttgaaatgtgttatagactgaccaagacaactattttctgagctcactatttttgtcctttcaattttctgtgcaaatagcactttgtggatcagaggctcaaaagcagaagtacttaccatcattaacgcagtttagaacaattggttgctgggtgagttgcattctcctatttatgtggttagcctttgtagcttttattatagtattcaacatgctgttttacatattgtcatcttaagaagaatgggtcttcttgctgtaggcattgacagagccagattatggaagtgatgcaagttcattaaggactgcagcgaccaaggtttgaaacatagatatcatgaaaattttaacttctaagtaaagaaaaatatctgaatgtttctgcacaaccttacaatgttgtcatgttggtttttaccttggtaggtgcctggcggttggcatttggatggccaaaagcgttggataggcaacggcacttttgcagatgtgctcatcatcttagctagaaattcagatacaaatcaactaaatgggtaatcatcttccgctggactattgttgatatcattttgtctaccactgtacacatgttaattcgaactcatttctatgcccatgaatgtgaccactcataattgatatggcaaacttcctctagatttattgtcaagaaaggagctcctggtttgaaatgtacaaaaattgaaaataaaattggactcagaatggttcagaatgccgacattgttctgaataaagtatttgtccctgacgaagatagattaactggaatcaattcatttcaagacataaacaaggtaacaaagacatctcttttgattgcgctaatcctactctgtgtcagtcaatttgaatacactgccatgtgcactaacctgatttttacttgctgaaactttaactaccggatcaggtccttgctatgtcgcgcattatggtggcatggcagccaattgggatatccatgggggtcttcgacatgtgtcatcggtgcgaatcaccttcttagttcagtctttactagtttcaaattggtaccacctaatatgtattgactttattatttaccattggataggtatttgaaagaaagaaagcaatttggagttccgttggcagcttttcagctcaaccaacaaaagcttgttcgcatgctagtaaacatccaagccatgcttcttgtcggctggcgcctgtgcaagctgtatgaatcaggcaaaatgacaccagtccatgctagtttaggcaaggtttgtacaaaatcacaatgcacttagaaaaatggcatccaccttatgattgtgcgctgttcggtttgatttacttttcgcttgctttcttcaacatctcactgataatacttgaatccaggcatggacatccaagaaggctagggaggtggtttctcttggccgtgagctactgggtggaaacggaattttggctgactttctggtagcaaaggtaaaatgattcagatttttttttcttttttggtaacataatctctttggacttctccaaatccaaacatgataggtttgattagaaagattaaagtaattcttaagattttccgacgggcacgtctttaccgcagtacgtacattgcata

SEQ ID NO: 49246 - DNA, 23251 bp, Oryza sativa
  unsure (1)..(23251): unsure at all n locations
ataccactcaaacatgttagcaaatcaatcttctcttctttcgagagagtgtagcaggctggaggaaggtaaaccctgccggattccgtagttatgggatgtagttccgagtgaacacttatttcttccagatctcgtcgggcgttgagaccatcctttgtagtacctgggttaagcagtaatcccgttaaactctcgcatacattcttctcgacatgcatcaaatctatgcagtggcgaacttcaagatccttccagtatggtagtctccaaaatattgacttctttttccacatgctcctctcttttgtcttttgtttttccacatgttcctctgttttttccttcgacatgctcttctcttttgtctttccaattttcctcttttttccaaactcgttggttattcccatcactaagttgtgcacctctgtccctgttagctctgtcgggggtccggctgtatctctgtgtccattgaaattctttctcatattcctatacgggtaataccttgggagaaatctcctgtgacccatgtagaccgtcttgtgtgaatgcttcaaccatttgcttcttgtttcttccatacactccgaacacgcccatttccctttcacagtttagccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcgatccttgaatgagcatggtaagcataatatagtactgaatctgctgggtgcctcaacacactattgactttccgttcttcggcattccagcgcactagcttagcttgttccttattcgcaaacattctcttcatgcgctccgcaattgggagataccacaccacctttgtcggggcttcccctctttgacttacttccttcaccttcactatttgctcgtttgtatcttgatgccccacagacagggcagacatccaagtcagcgtattccttgtaatacaaaatgcagtcgttcggacatgcatgaattcttctgacctccaggcccaacggacataatacttgcttcgcttcatatgtcgtctgcggtaaattgttcgcctctggcaacaggtcctttaacagctcaagaagttctctaaaactcttgttcgaccagccattactagccttaaacttcatgagttccaacacgcataacaacttgctgtcttgcatccatcatacaagggtatctaacaatcttccaccaaaatactaaacttctcaaaatctctatcgttgtcctctgcgtcttcaatgtcatgcaacattgtagatagacattgagtgtccaaatatatggtctctccacctaaaggagaaggtacgaacatgccttctcgagctgcggcggtgttctctacatcctgatccaacacttcttctgctgcgatatcaggcgcctcttgctctccatgcttagtccagcaggtatatttcttcatgaatccattcattatcaaatgagcatgcacttcatcgctattaacgatcatttgttcattcttacagttcctacatagacacaacatgtgcatgctcatcctactttttctgtcatttttcgcaaatgtgacaaattcagtgaccccctctctatactcggtagatgaacaatgcgcatagtacatccatctacgatccatctgaaatcaacaacatacgaagaaaaatatatgatgatcgatatattaagaatgaatggagaataatgtgttttttaccttaaattttagcaaaaatttaccccccttgccctcccaaccgatttgtgaatagtgaactggtcgggatgaaaagcagttggcggtttgtggggtatttatagacccaacacacctcaaacaggttagattaaaaaatcccgtccaaggtgttggtcatacctttgacgggcttcaattgagttgtccgtcaaaggtattgacctacatatgacgggtcgtaaaaaaaatcgatctgtcacaggtggtggaccaccacctgtgacggctcataatgctactgcccgtcacaggtgagaggataccagtgacgggttggaaggaaaacccgtcacttcctcacctgtgacggcttttccttccggcccgtcacaggtgaggggatacctgtgacgggccgtggccggatgccccaccgatgacggcaaaggtgacggtcatctgtgaccaattcataagcccgtcactggtataccgtcacagatgtagagttgtggcgtagtgtatagaggtgctggttctttggtaaaaaccagcacctatataggtgttggttttatcaccggcactaataacctgggataatcagtcctacttgactggtgtcgactgatcaatctagcaactacggacgattctgatcagccagcaccaactgtcttttttgttgtaatagtgagtgctgcttccggtaaaaaaaaaagaattactgatggtaatttttttctcaagtaagaatttgttctttgttgcagggaaaagtaataatttgttttgcatagcttttatctctcacacagccttgaacgctgtgtcctctttaattgtaatatacatttgttttgaatttcttgctctaatcggttttgtttggtacacctcccttccgatctgcggtttggttcttcatttaatttgttctatttaatagttttccctttagctgtatccacttgctgctaatttactcctagcagttctgtgcgaaatatttgattttctctagaataaattcttcagtagtttagcgtgaccatgtcaatatggatattctttctctaaacaatgggcgaatccccgtgtaaagatatactccctacgtcctacagtataaggaattttgagtttttacttgtaaagtttgaccaatcgtcttattcaattttttttcaaatataaaaaacgaaaagttgtgtttaaagtactgtgaataataaagtaagtcacaaataaaataaataataattttaaaaaaaattgaataagacgagtggtaaaacgttgcatgcatttcaggcagaggatagcacagatgacggggaatggcctacaccgatccatccgttggtacttggtatactggaattgtggcccaaaatctaatatggagcatactctacatttctacaagtacttattttttctttttagatatatacatggtttttacagggaaaaagttcacgtaagatctctcaacttgttgatcatctctgaactgaaatatcggatataacatattcttaatgctataaaatcagatcgtctcaaacgcagtattgctcccggttttgactgatgtgacggctgagacagcgtgagacccatgtgaactcacatgtcaagcgaagcaatcaactcgattgccacggcaactaatgatgccgtcaaacaataggtgtaccacatgattctgttctataagaacgttgcacttgcagttgcagccgttccagctggggatgaatcgctgccatgcctagctagagcggcctggaggacgacagtgggctcgctgagttgttcgtcctgacacttcccacccatgtcgtctcgtcatcatcgtgcaagtgcagggggttctctccgtggcacgtcgtccagcgtgatcgaattaaatttgaaaatatactgtttattcaatttcttctaataaatattcgggatgtaaaattttttgcctaaatataccgtcgatttcgtacaaccgttgcgcgagaatgatacgggaataacgtcgtgggtggtatcacgcagtgaaggcgcgagaccgcacggtctcgtggaaaggtacagcgaggcagaacagtctcgcgcaagcactgagcgagaccggtgccatgctgactcaattagcgactaattatcttgattagcgattaattaataatttattaatttgctaattagaataattagttactaattattattagttaattactaattaagtaattaagcactaattaaatggagccggtggacagtttcgctgtttaattccgcgagaccgaacggcctcgctcttccattgcgcgaaaccgtgcgctctcgtgccttcgccgcgcgagaccgtgcgctctcgcactttcaacgcgcccatgacgtcacacccatctcgatttcgcgcaaccggttgtacgagatcgacggtatatttatagaannaaatttacatctcaaatattcatgagaaaaaattgaatgaaaagtatatttttaaaatttaattccagcgtgatctcccatccagatcctacttttgccatgtctccctgttcttggtcgctgaaaatggcggcgggaagaggtgcggcgtggtccagaagggcggcggccaccctccttttttcctctcttcatcatcgtttcataggataaaaggtgcccagcggaggccgggagacacccgattgacagcggagagaagggcccgtggcgcgcgacggcacaataggttgcttgtcccctgcgctcgatgtcagcgcggtcgccggttccggcaacgtctcctgctcccatacgccatgtgctcgcacgcagaggccactgtgtctccacctcccacgcctcacagtgcgccgatactgttggcccagccactcacttgcacacacggctctctctccctctctctcagtcgatggaactcacacacacacacaaagaagatgcactgacggaggaagaagatgaataaacaagaaatttccgtgttgtacaccagcgcacacaacacaggcactagtatttcacttttggcactgctaacaaatgctaattacattggttaaatagaccacacacacaggttaagccacgtctggccgcacaactcggacagtcactccatcacttaatcgccactaatcacgtctctatacatgcagcccatatctccttacatgcatatcactaacacaaacatgcaacacagctagcagatccactatccatgccactattgcagctacttaactcggccactactccaagccgatatccaccttagctccctacatgcaagcaccaacaggcagattatggactttcttgaccaagctaactcgtgcacgcactaattacaactcacaccaaagataaacaacaagattaagtctaacaccgatctcatcatggcctctctcctcaccggtaccccacctgacccacatgtccagtcgggtgccaccccttcgccctattccagtgccgtgctctgttttcctgctctagatgcacaaccccgaatcgttgccaatcttagagccaccgcacctctccctacctgcctttcgacctttgtcacccgtcgcctgctcccgtcctggatagagagagaaggaaaatgggttggctactggcatgttgggctcacgtgggtataccacgctgactcagtcgggttaacttcaatccagctaatcatgtcagttaaaaccgagaaccaaactagactttcggtaaacggttttgtaagttgagagatatgttatatctggtactgtggttcgaggatgtaattttaacctgacgtcaagatgagggaccataagtgaacttattcctttttgcaaccattaggcaatggctggccaggcctgagatttgtgatccatgattccacgtaatgcatatgggtctccagcttgctgtttaatcgccatcagccgggagcccgggaaaatttgttcggcccaatagaatagtttacggcatggggcagacatcagtgattttggtaaattggtccttttaaagaaacttatttataaaaaccatgttaaaaacgtatttcaaaaattgagcacaacctcaacaccatgtccgatgacgctgagatctaactaatcaacaccatactcggtgatgcagcatgctaaacccccgctgtcactgtaacaccgtgggcgacatcaacgctaacccagctggctgacatgcacctttagttaacataaacattataggcgtattgtgcagccactagtaaaaaaagcatcataggtgccggttcccaattggctattccaaccggcacctattggtcggcactaatacaagcaaccggcacctataggtttgcacgagccaaaaaaaagagccggctcgaatcgagccgaactaataatcaccttcactgcgccatgccccacatctagttgtttgaaatccccaaatccccacatcacagatcatccacaaatcacatttgaaatccacaaatcaccacatcacagatcatccacaaatcacagatcgaaatatattaaaaaaatcatccataaatgaaaaaatatcttaaaagaatctacaaatcatcccaaaaaaatcctcgggcaccgctgcctgcccaccacctcccctcccaccggatccgacggaggggagtgcgcggccgccgccgttgccgtccctgaggtccgccgtctcccatccagtcggatctagaggaggggaggacacgcgcggcggctgccgccgcctccaccggaccgccgccggctatcgccagaggtccaccacctcccctccggccggatccagtaaaggggagggcgccaccgccaccagccgctgccgccgcctctgctaggccactgccgaagcccaccgactcccaaatgccgtcccccacaagctcccctccacgccgccgcctcgcccgtggggtgcccgctgcctcccctcccgccggatctggcggaggggcgggcgtggctgccgcctccggttgccagccgagggggctcgccgtcttcgccgctcagccactgccgagacgcgagagagagaggggagggagagcgtgagagagagaggggagacgcgaaagctgagagagaggagagaggtacgagtagatggataaggcgcatatatatgagttgataaggacgtgcggtaggtgcggtgcttgtagactcggctgtccggttcggctcaaagctataggtgccgggttttttgctagaactggcacctataatgtttaaaggtgtcggttctatgtttttccatcgtatggaggtgggaaaagctccgacacctatgagctgttctctatgaaggtttttgtagtagtgagcggtagtgcatctgtgttgctaaccttgagcgcagggttaagccaaacggtatatttgtaaacgaaaaataatttgtgaataaaatttcacaggctgaaaataaacttccatgaaaaaactcctaaaatcaactctaaatttagaattgaaaatttaaattttgactgataaggataagcataagcaaaaaaagataaagctgctagttcagttgtttttgttttagcaggaaagctactgccacactcaactacgctagggttttgatgcaagacacccaaaacaaaaaggagtatcaacgaaactgccgtatgttttttgagtaaaaaactttcagatgtaattatagtataattgtagtgtaattacatatgtggtttactatattgtaactgcaatatactccttccgtcccataatataagggatttaagagggatgtgacacaaagtgtgtccagattcattgtactagattatgtcacatccctccaaaattaagggagtaacttatataaaacttacattcaactaaaatttggttagctagcactgagatcttatgcaacacttgtaaaaatttctttctagcaatttttctcccttcatgcataaatctcgaggtgatccgatggtttcaaatctgaaagttttgggggcaaaacaaacttggtagcacatccaaacataaaaactcatatttttgttaattattaagaaaccacatccttactgtcgggcctcttttccttcttttttttttaatttttttccctccagcccaccacaccatctcagtccaacccaccccttccacctccagaagctagcccagccagccgctactgcctactcctgcttcggttttctgctgttattttctctgataagttgtagctatgataactctaattgtggagattatggataccccatacccgcatggcgtgtatatctgactgggtatggggtgccatgtatcgatagaatatattcaaagggactcgggttaaattccaaacttgtatgtcaaggaaatactcgggatcctaatcggttacgattgtatcttatctgtaactacctattccgttagggatatgggctgtactttgtaatacggaccctttcccctatataaggaggggtccgggtgcctcttggggacacgatttttctcccagatcatacgatcaattatacactcggcggatcaatccccggacaggtgtagggtattacttcttattaagaaggcctgaacctgtataacattccttgtctctaaacctatccacttttccagcttgatagccaccccttttagtaatgccgaaatcttgtttcgacagttgacgcgccaagtaggggtagcgtcaagttcttcgccgactagggcaatgggtttcgtctccggcatcaacgacttcgtcttccctcctgggcaggcattctggttcggcagcctcaacttcatcaccaacgacttcggcaagatttctatccttgactcggatccgaaccagtcggggagaggccaggtctccgctctgttcgatatcctgaactcggccgaaatctactccaagatcatctcaaccgagtcggcttcaaaccacttggacgagatccaatctactccaacatgacctgatcaagacgatgaggcctatccctcaatcctgatgaaactccccgacgatttggctgctgtcttcaccacaagggtgtcttctccccgtaggtctaggcgggatccagcctcggctccgatccagtctagctccagggaagtcggtgtcatactccaacctcacgggacagtttcgacagaagaattggatggctatcttagctccccaggtgtcgattctcgaccgacagatatcctcgagtacgatgacttcggctaccactacgactaccacaacctcgacgacttcgacgaaggctacgaagacaactacacgcctctcttctttggcgttttcatggccgacaatgagacggaagaatagcgtcaagcctgagaagcagaagaacagcgcacacaacaagaagccgcgcgtcgccgactggaggaggagcgttaagcacaagagcgagaacggctgcagcgtgagcaacaggagcgcgaacaggccgcgaaggaggctgaggaccggcgacagcgcgccttggaggctgggcaacgagcacgagaacttattggacaacaagacgttgaagggacggcggtttttcgcaccccgcagcagaacgcggttgcagcgatcacccttcttgacactctactctaggaagacgcacccaatcacgtcgtcaacatcttaaaccagaccaagaccatgatcgccgcctcagttccagtgaactcctcaagcgtccgtacaccgactggcagccgagttccgcctctttcatctcaagactatcaccaaccaagcctcagcattgccggcgcaggatctagtcgcaggagcagcaatcacggtgaatgatctgttcactcgcctcccgaccgacacagggagcgttgggtcgaatagccgcgctctccacgtcgaaggcgtcccgtcgatcttcgtgatactatcaaccagcgacgtgcggagagaggccacatcccccaccattcactagatcgttacaacgacgatgtggatggagttgccgccttcacaagtgacctgcgttgagtggattggccggccggcttcaaaccgactggaattgagaagtatgacggcacgacaaatcctaagtcaccgtctatggtcttgcaattcgcgcagcaggaggagatagcaaagccatggctaattatctgcccgtggccctagcggactctgcccggtcctggcttcacgggctaccccgtggcacgatcgggtcctgggcggagtttcacgaccacttcatcgccaacttccagggcacttttgaacgccctggtacccagtttgatctttacaacgttatccagaagtccagagaatcccttcgagattacatccgacgtttctctgagcaacgtaacaagatctctgacatcaccggcaacgttatcatcgccgcctttactaagggcattcgccatgaactcttagtcggcaagtttggctttaagcctcccaagacggtcaagcagatgtttgaaaaagccaatgagtacgccaaagcagaagacgctgtcattgcatccaagcagtcgggcagcacctggaagccaaagaaagatgtgccgactacagggggagtggaagtgccaatcacaaggatcgcaagcataagcccgaggaacttgtggcaactactacaccatcctcccgacagcattcacgcgtcaagacattcgacaagatcatgaactcccaatgcccgcatcatccgaattcaaatcacgcggccaaagattgcttcgtctacaaatagttcacagagcaatacgccaagaatgcacgcaagacgactgacggagatcaaagtacgtcgaagaaaaaggatgatgaagatgatgcctcgactagttttcaagactcccgtaaagaactcaaccacatgtttggtggacccctggcttatgaatccaagcgaaagcaaaagctgaccgaacgggagatcaatgctgttcagcctgatacgccccaatatcttcagtggtcagagactgctatcaagtttgaccactcggatcatcctgaccgagtggtccacccggggcggtacccttggtactagacctagtggttcgcaacgtcaagctccgacgatccctcatcgatggtggcagcgcactcaatatccttttcgccaagactctggacgacatgcagatcccttggacagaactaaagccgagtagtgcgccctttcacggagtcatccccgggctatcttctactccactcagccagatcactttgccggttaccttcggtacacgggagaacttccgcacagagaacatttgcttcgaagttgctgatttcgagacagcgtaccacgctatactcggacgcccggcgttacccaagttcatggccgtcccgcactatacctacatgatgatgaagatgccaggtcctcgaggagtcatatccctgcggagcgacatcaagcaagccgtcacctgcgacaaggaaagctgcgagatggcacagactcgcgagatcacgctcgctcgagaggagatccgactagctgcatcaatagcaacagaagaagaagtgcctgcaaccaagatgccaaagagcggagaaggcgacgccaagactaaagccgagtagtgcgccctttcacggagtcatccccgggctatcttctactccactcagccagatcactttgccggttgccttcggttcacgggagaacttccgcacagagaacatttgcttcgaagttgctgatttcgagacagcgtaccacgctatactcagacgcccggcgttacccaagttcatggccgtcccgcactatacctacatgatgatgaagatgccaggtcctcgaggagtcatatccctgcggagcgacatcaagcaagtcgtcacctgcgacaaggaaagttgcgagatggcacagactcgcaagatcacgctcgctcgagaggagatccgactggctgcatcaatagcaacagaagaagaagtgcttgcaaccaagatgccaaagagcggagaaggcgacgccaagactaagaaaaatcctctagatccctcttatcccactaagactgctgtaataggtgctgagttagattgcaaataggaaagcgcgcttatcacctttcttcaaaataataaagatatctttgcgtggaaaccatctgatatgcctagtattcctagagaggtgattgagcactctttacatgttaaggaagacgctaaacccattaagcaatgactctgccctttcgcacaggataggaaggatgcgatcaaggaggaattgaccaagctgttagcagcaggcttcaccaaggaagtcctacatcccgactggctggcaaacccggtcctggttcggaagaagacggcacaatggcgtatgtgtgttgattacaccgacctcaacaaatcttgtcccaaagatcccttcgggttacctcgcattgaccaggtagttgactcaacggccggctgcgagctactcagtttcctgaattgttactcaggatatcatcagatccgtttaaaagagtccgactgcttgaagacttcattcatcatgcccttcggggcttactgctacatcaccatgccttttgcattgaagaacgcatgagcaacttatcaacgcatgatctagaaatgtttttcaactcagattggtcgcaacgttgaagcttatgttgatgacgtagttgtcaagaccaagcagaagaataatttgattgcggatctaaaagagacctttgcaagcatccgtgccttcaggatgaagttaaatcctgaaaagtgcatcttcggagtatcgtcagggaagttgcttggctttatggtatcccataggggcatacaggccaacccggagaagatcaacgctatcctcaacatgaaaccgccgagttcccaaaaagacattcaaaagttaactggatgcatggtggcactcagccggtttatctcacgactcggcgagcgggggatgcgctttttcaagttactaaagaaaaccgacaatttccagtggggacccgaagcgcaaaaagcctttgaagacttcaagaaacttctcactactccaccggtcttagcttcaccacatctgcaagagccgctgttgttatatgtgtcggcaacatttcaggttgtgagcacggtcatggttgtcgagcgtgaagaagatggccatgtttatttcgtcagcgaggttttgaccaactccaagacaagatatcatcaggtgcaaaagttgttatatggtgttttaattaccgtcaggaaattatctcactattttcaaggtcattcggtcacggtggtcacatcgtttccactcggggacatacttcataatggcgaggcaaatggacggattgcaaagtgggccttagagttgatgtctttggatctatccttcaagccgcgaacttcgatcaagtcccaagccctagcagattttgtcgccgagtggactgagtgccaagaagacatgcctttagagaagatggagtattggactatgcattttgacgggtcaaagaggctttcaggcaccggagcaggagttgtcctgatttccccaactggagaaaggctaaactacgtattgtggatacacttttctgcgtcccataatatggcagaatatgaggcgcttcttcatggattaaggatcgcgatatctttggggatccggcatctgatagttcgtggagattctcagttggttgttaatcaagtcatgaaagagtggtcctgcctcgatgataatatggctgcttatcggctggaggtacgcaagttagaagataagtttgatggcctcgagctaacccatgttcttcgacataataatgaggcagccgacagattggccaattttggttcgaaacgagaaataactccttctgatgtgtttgttgagcatttttatgaaccaactgtaccaaggaaagaaacaaccgaggctgtggacactcaagaagtaagcatgatcaaagccgactagagagagtcccttatcaagtttttgaccaagcaagaactccctcaggataaagacgaagccgagcggatctccaggcgcaacattacgtcatacatgagaccgagctatacaagaaaagtccatcagggattctgcaacgctgtgtgcctttggaggagggaaggcaattgctaaaagatatacactcgggcatctgcggcaatcacgctgccgcatgaaccattgttggcaaggcctatcggcagggttttttctggcctactgcggtatccgacgccgataaaattgtgcgaacatgcgaaggttgtcaattttttgcccgacagactcatttaccaactcaggagttgcaaaccatcccgttatcctggtcgttcgccgtttgggggctcgacatggtcggcccattcaaaagggctaccggtggtttcactcatctttttgtagctattaacaaattctcaaagtggattgaggccaaaccagtcgtcacgattacagcagacaaggctagagattttttcatcaacatcgtgcaccggttcggggtacccaatcgaatcatcacagataatggtactcaattcactagcagtgtgtttaaagatttttgtgaagacttcggcatcaaaatttgctatgcctccgtagcgcatcctatgagcaatggacaagtcgaacgcgccaatggtatggtacttcaaggaatcaaagcgcgagtcttcgaccgactgcatccctatgctgctaaatgggtagatcagctgccatccgtactttggtctctgcgtactacgcccagtcgggccacgggtcagtcaccgtttttcctggtatatggtgcggaagcaatgttgtcaagcgaggtagaattcgaatctttgcgatttctcaacttcaaggaggagcgctacggagaagactgagttaacgatctcaaccgactggaagaagcccgtgaggcagccttaattcagtcggctcggtatttacaagggttgcgacgttatcacaaccgcaatgttcgatcgcgggctttcttagtcggagacctggttttgaggaaaattcaaactacacgagatcggcacaacttgtctccattatgggagggaccgtttataatttctgaagttactcggccaggttcttatcgactcaagcgtgaagacggcactcacatcgacaactcttggaatattgagcatcttcgtcatttttatgcttaggcattacttttgtatcttttctccctctttgactgctaacatcaagttgctccttgagttaccagtcgggggctactataatattaatggagcgtgattcttatcaattcaatttgcttacttgatttatcattgccttgttcgattttttggcctagtcaatgaggactgaaagttttcaagaacttttacgggttttaggctcaataaggtttgacaaaaacttttaagaaatcaggagttgagtttaaattatcaaacacagcataaattcatcagtattgtacaaattgtgcctccatcatcataagttacactatacaatgtcaatcagactcaatttttccattatcagaatcatcagacacagtcggcctgagattgttgtctagaaacctctcaactgcatcaacaacgatcttgtcagcagccttctgtgcatcattgatgaggtcaagggcgtcttcttcacttgtcccgtctgcaaagcattcgacagcgtcaatatcgatcctcgggtttaaggacttggtcattgccaataccatgctcgcccccatgcatccagcttccttgatgtttttaaagtatgtatccggagcagctcttagcttgtcgaagatttcaacagcatcgaacgaactcggaccattattattaaaaaacatggcttggatgagtggtgtagcggcgttggcaacttcatccctagctccttcaagcttcttaattttgttgaccaagacgtcgaattgagcctgagatttaattttgcgatctgcataaatggttcacatcaataactgggcacgaagacaagagtggttctggagtttcaactatgaatacattcgacgtctttcagggctgagtcccactgtttggtcaattcacctttgtctttttccagagctttgattcgcttttctaactcagtgatcttggcagcttgcactataatattttccattggtcaattacatacggatagcagcttggggtaagtcaaacaggaataaaggttacctttggatgaaccactcagctcgaaattggaatcttggagctcggcgattcggtcccgaagatcatgtttggttttcctggcaagctccctggtttcacgaagttgggatctggtcgcttccagggttccaaggtgaggaaccagtttctcgagggttgcagtttttgcttcattcctaagatggattctctgcattgcaaattcatctctatttagtaaagtggccgacaggatgagtaaagctatgtgcaaagagacatacatttacaagacgagtggcctgattgagcgtctttgcaagcaaagacccttcctcgtcttctttctgcttatttattacaatcccttgtggctgcatttcgtcatcccaccatttgactaagataggtgggcgagaatcttcagccgactgaatccgaagaacttcttcttcatcaccgatcattgggcctttacatattcacagatgatgataaagcaatcgaagaggatttgtcagagcaaaatgaatttagaagagttgattacctgttatgatctttggttgaggacgagcaggcccttgcaccctatcggatgaactagacttcgggtcggtgtcggtatctttttggggagggctgcttgctcgggcctctgtttccgggatgtcctcatttcattctgtacccaactggtttccagtcgggggctcctgatcagcttcggccgactggttcccggttgggggctcgttgctggcctctatattatcggttgctggttgattactactcgggcgattttcggcggtcagcccagtttctgttgtaggaccagtctccatgctagtcggttcagagtcttttccagaaggatcgatgtcagatggcttcctacagatttgagatatgctattaacactactttgatggtgtatgtttagcgatacagggaagattattaaatgacttgtacctggatgacttcctgatttttggtattggacgactggatgttttcttcttcgggttagcttgctttggttgttttccagtcacctctttgttgccagctttttcaacattgtcaccctcatcgtcactcagtattaatttcctttttcgagagttagactagttagttggctttgagatgcttggctgagcatcagactagattttcggccctccactggcttgacctgcttgccggtggggtgagcggcgttgagcgattgggggatcagatttcatcaaagaaagttcctatgcatgatatttcaagttttcagccaaccttgcaaaagacaaaaggataccatcagaaaggccgagatgtctgttacatactggtggaggagggttgaaagcattgtatggcactactggaagcaggtgtgagtagctaactgcgatagcgttagagaagattttgtacattctctccttcatgattttaaactcaagagattctggatcttcacggttggggtcattcttgccatcaaattcgaaggtagtgcgagatctttctttgattggtgccagccggctcttgatgaaatgccgagtgatttgttccccttgcagaccctgttctttaagtttcaacatgcgttccattagagaaagagcttgggcagcctcatctcccattggaagcgagttccaggtgtgttggtatgttggatgaaggcaggagtactcggggagcgctcgctcaggattttgcccataaaaccagtttgcatgccagcccttgttcgaggttttgaagggcatggagaagtatttctggcttaaggttccccttaactgaaaacctgcccccccaacgacgcatggcttgctcttgtttggctgggacttcaggaagaagatgcggcggaataaggcaaaatgtggcctaatccctagaaaagcttcgcaaacatggatgaaattggcgatgtgaactatggaattggagtttaggtgatgcaaactaatcccgtaaaactccaggatcccccggaagaatcttgaggttggtagagaaaaaccaccatagaagaaatgagaaaataccacgacctcgtgtgtgtcaggggtcggaaatgcttcgccatatgccagacgccacccgataatctccttagccggaagaacgccatgtgctaccatctccttcaaattctcctctgttacatcggagggagcccattgactttcgaagctttctctctcctcagccatgggtgcgagatggatgatgagatttggggcgaggacggcagcgagtgaagaggagattggtgcggtggatgtgcggaagatctatgcaagagcactaagcttcgagaagggtggaatggtgtggatttgcgaaccctagtctccgtcggcgcagtgtttgtactgtagcgggaagtggggaaaatggagaggatcgcggcggggaagacgaaacggcgccctattttagcattttttttcgctagggtatcgggaggtgctaatgggcctgggcctaagcagtaccttcagcccaattttattgtctgcgtggttggttgtgatccttagggacttaggcatatgtttttgctttggcaaaatttgctcacgacagaatagcccagtgctgctcaaatcctttttgatgcagttagataattctttggaatttctacaatgcaaataaaaaggtgcccaacagaaaagtattatattaattttgttggcctttttaggctacaaagctattcgggtcttaatgagatgactgattttaaatggtcattctcttagcatgttatatgcttaccttgataatggtgtgagtcatagcttaggctatttagactcgtcatttatcatgcttcataccacatttgatggatcttttttagagtttttactcggatttttatcatgtgtgttgatttatagagctttagagtgtttctcactcgggcctcttctatatttcttttttggcgcattaaagctaaagcagtcggctggatgttttatcagatgccgcatatgcttagctatatgatcccttgggtgatttggttgagaaaccactcggatggatgttttgatgcattttgactatatgtttagtttttatttaactaatcacatagttgggggttacacctaattaggtgcatctagtcgatgcacctaattttttctattttcagcccttcacagtctttgactttagtactcgggagaccaaggcagaagaagttgaaacactcggattatcgttttgaattacgagagaagactatttcgtcgcctgtaaaggtctcaggggctacggtggagattatggataccccatacctgcatggcgtgtatatctgactgaatatggggtgccatgtatagatagaatatcttcaaagggactcgggttaaattccaaacttgtatgtcaaggaaatacgcaggatcctagtcggttacgattgtatcttatctgtaactacctattccgttagggatatgggctgtactttgtaatacggaccccttcccctatataaggaggggtccgggtgcctcttggggacacgatttttctcccagatcatacgatcaattatacactcagcggatcaatccccggacaggagtagggtattacttcttattaagaaggcctgaacctgtataaaattccttgtctctaaacccatccacttttctagcttgatagccaccccctcttagtaataccgaaatcttgtttcggcactaataaagacataaataattttttagcttttattactatctctattccaaaatatagcaacttttagctatgaatctggacacacagttatccagatttatagctaaaaatgcttatattttgggatggagggggtatacaatgtatcaactatgcatatgtgtactaactactaatatagaaattgatactgcaaaaatacattacgtttccgatcgacaaaaccgggtgccaagaggcacccaccgtgacctttcttaatttttgtttgacaatttacatgtcttaagacttctctctgagtattgaatgacttaattagacgaaagtctttcaacatggcaattaagtcgacaagttgtcacatgcactagctactggttttgttctcaacgttttcacgaccaataactcctccgcttttactgttaatggcagcatgatgtatcgtagaataaatgtatctattaattttatagtttttttagataataattttatggttatttaaaacatttaaatttgagactcgaatatactgtatcataaaatatggctacattttcaagtttagtctagctatattttgagacaaagatagtatatataacttgtaaatacatcctacaatcatgcattttaatttcaaatttatttctatatgtacaaccagacaagtagcaggtatagtacattatatatgatcgattggattcaacggatccaaagcaatagatcacccctaattacaatagagtactgtaaaagggaaatgtttcatatccacacaacccttctcgtctcgtgtatacaatgtatgtacctattaaaaaaacatcaccaaaaattgtagaaaaagttgtatatgtacttttagtagtatcatatttatgaatagagtctcatcttcaaattcattccatatatggtgttaaacaaagataaaattttgatcgatttatacacttaaaactattaaggattttatcttttacattacggctaaaatataataaatttgagattaagactttatacattaagtgtaatgctattaaagtacatgttaaatttatttttagatttgttgatgaaatttgttagttgatgtgcacggtatgtatatgatacattcccctataaaacaagccttactaaattgcaatatgcactggcggcgtcgtcagcactattcttaaaaacgtggtcaacttgactaatcataattccaaattgtctagaaattccatgcatgttatcttagattgatcacatggcttcttaattttcaacgtttcaaaatgaccgtcactgtttgtgatataaactgctaagacttttactcttaaatttctagagacctatcaagtatgaagtatcaagcaataggtaagtcgcatattcccacagagttttagctcaagacgatgacgttcgtggtaaccaagtcgtcgccgtcggtgctcgtccgcccgtcggagccgacgccggcggcgaccatccggccaacctccactgacatgacacgcctgggcatgtcgttcacgtcgttccacgtgttcgagcgcggcgtcgacgagccggcggagaccatcaggcgcgcgctgtcgcgtgccctggtccactactaccccttcgccggccgcctcgccggcagcggcgacgacgtcgtgttctcgtgcaccggcgagggcgtggtgttcgtccgcgcgacggcgaactgcaccctggaggacgtgaacttcctcggagcaccggtggtcatgtcgctcgccgacctcgccgtccggtacggcgggccatgccgggcggcgtccgacccgctgatgatgatgcaggtgacggagttcgcgtgcggcgggttcgtcgtcgcggcgacgtggaaccacggcgtcgccgacgcgtgcgggttggcgcagtttctacgcgccgtcggcgagctcgcccgcggtctccactcgccgtccgtcgtgccggtcaggtacgacgagtcgctgcctgacatcccgcagcttgccaccatcctcctcaagcggctagccgccggcgtaaaatttgagcacgtcgacttcgcctactgcgacgtcatcatcccgtggagcttcgtcaaccgcgtcaaggccgagttcgggagcaggcacgccggcgaccggccttgctccgtgttcgaggcggtcaccgcggcgatgtggcagtgccggacccgcgccatcaatggccacggcggcggcgccctcgcgccgctcgtgttcgcggcgaacgtgcggaagcacgtcggagccaaggacgggtactacggcaactgcatcatgtcgcaggtggtggtcgccacggccgacgcggtggcgaacggcgacgtcgtcgacttggtgaagctgatcaaggacgccaaggagcggatcccggtgctcctcagcaccaagacgcttgggctcgacgacagcggcggcggcgagctcgtcgccgcgctgtgcgggtacggcgcgctgtacgcgtcgagctgggcggggctcgggctcgacggcgtcgacttcggcggcgggaggccggcgcgggtgatcccctactcggaggtgaagatgctgccgtccatctccccgggcgcgccgtgctcgatgatggacggccatggcgtcaacgtggtggcgtcgtgcgtaacagacgaacacctcgaggggttccgggcacaattggcgaggctctagtgatctgccctatttcaaagagtatcctaaagcgatttcaaattttcaaatctttacttttatgaattaagttttgcagatactttttatgtctttgctccagtgaaccgctcgctttatgaaagaagaagaagaggggggggggggggggcttttaactatttgtcactcttacgagtggttcttaacgatttgccactaggcccacatgtcatagacatataagggcccgcatgtcatagacacagtgtggcaaatcgttaattgccatgtcacaagagtggcaaatagggcggcgggctaatgggcgatcgctcgatcccaatccccccatacgctctctccccctttcctcctcccattcttctcttcctactacaccatacatttaaaaaaataaaaaaacaaagttgaaaaaaattatatatagaaatactatattaaaaaatatttgaatttaaattcaaatttgaaacgggtaggtaaacttttgacttataaactttgggtgtacaaagtaagagataatctctgatatgccactgaaaattggtctgatcccttatatgccactgaaaattggctcttcccttatatgtcattggtccaaatttgcgcaccctctcaagccactactgtcagttgaccgtgtgtt

SEQ ID NO: 49247 - DNA, 10126 bp, Oryza sativa
atttggatcaatggcatataagggaagagccaattttcaatggcatataagggatcagaccaattttcagtggcatataagggattctctcaagtaagagagataattgaattcaaattcaaatttaaatcgggtatgtaaacttttgacttataaactttgggtctataaactttaggtgtataaactttagatgtatagaaatactatatataaataatatttgaattcaaattcaaatttgaatcggatataattcatattcaaatttaaatcggatatgcaaacttttgacttataaactttgggtctataaactttaggtgtatgaactttagatgtatagaaataatatatataatatttgaattcaaattcaaatttgaatcaggtgtataaacttttgacttataaactttgggtctattaaaatttaggtgtatgaactttagatgtatagaaatactatatataaaaaatatttgaatttaaattcaaatttgaatcggatatataaacttataacttataaactttggatctaaactttagatgtgtaaacttgaggtgtacaaactttaggtgcataaatttactaaaataggaaagtaatacggtgcctaaaaaggaaaccacgtggaggagagggggtatcagttgatccgatctctaggggcgatcgatcgccccatagccttttcgagaagatcatggattgacatgtgggccggcccaacttatacaattttgttttactagcaaaagtgcccgtgcgttgcaacgggaagcgtacagataagaaaaatatgcaatcaattaaaatacaaattcgttgaaaatttttggtatttttaagtagatatgtgtataattaaataaatttacaagtaaagaaaatttgagaaataaaataacatggttgaatttaattttattaaattctccatgattagttacgctctttagaattttattggaatttttagagcttaattgctaattttaataatacaaacatcatttaacaattatttaatttgaaaaagaaaaataatccttcattttaggtttgattcgaaataaacacattaagtaactataatagtaaatgctactgaaaaaatgaagtactaaaatgaacttcttctctttttcttcggcctgaggggcctaaaatagacttatttttcggtccttgccggtcggcccacggccttttcctcatgcgcgggcgcacttcccctccccaggccgcaacctggggttgggccggaaaagtggcctcgctctcgatccctcttgggccgattttgacccggccaacgccggccgtccgatctctagggttttgatcggacggccaagcgtcgagatcagggaaacaaaaccccctccctctccgcagccaccgaaaaccctagcccatttgcttctctcccttctctctcttcgacgccctccctccgcgcccccgatgctcccgtgcccaagcggcggcggcggcacctctctccccaagcgactgcggcggcggcgacgcctctctccccgagcgactgcggcggcggcgacgcctcaacccccgtgcccaagcggcagcggcggcgcctctcccccagagcccaagcggcagtggcggcgccctcccctcgagcagcggcggcggcggcgccctccctccacgagcggcgacggcggcttcaccaccaccagcggcgcggcggcgtcctcccctaccactggcggcggcgggggcggtagcgctcggggaggcgtcggtggcccgctggcgtccagcggcggcggtgcccctcccctctgccggatccaacgggaggggagctgcggcggcctggcgtccctgcgacggcggcggcggctgcggttcgacggtgacctctcctttgatctttttttttggatatatttgtgtgtataatgcttcctccgattttattttatttgtatgattgattgaattccgattgggatttttttgggtgggagtgatggaattccgattgggatttgggggaggcgagggggacgaaaatcaccatacctatgaggtgacgaacggaaaaatacgaatatctatattagttatagatatggacttggctgactggattgcactgggaccaaaactactttatatggtgtttatcggtaatttatcttgtttaaaaagtttagtggcgaatatcagttaagtggttaaattggaatgctaaatcaatatttagcgactagcctcgtgccccccctctctcccccacgtggttcgtggttagttccgtgcagtacgagaatacatgtatgtaaaaaagaaatgtttatatgtatataaaatatatacgtatgatttttttacatgtatatataatattttttatacgtatgaaatttttacgtgtatatataatatttttatacattgaatatctatttcctactatcgggagtagttatcccctggtagtctaacgttcatctgcttcacaatatatcttataccggatatggtttatgggaatctatactttatataaagttgtagcaccactaagtgtaaagctcaacatgtaactatactacatcatcacccactaacaataattacatatttagcctcatgcaaacatacaacatcttctacaatttatttgattgggaaaattgcatccatgcctccactttcagccccaactgttgttttacctccactttttaaggtttaaacttttattgaaaacgaactagacatttgccctcacttttgacaactagtttgatggtgttagttttagggcaaaagcacatttatacccttggctatttgttgtattttttgcccttacaataaaccataatacatagaaatcatagatatagtagcaagcattacttagtgtcacatagtcccaaataacgaatgtaatttatccaacgaatcaaactgaatcaagggagaaccacaatgataagaatagatcaaattacatgttaatctcttcaagtatgctccattgaaaggatttcctccattgatgcccttcccctaacctttacctcacatacaccgagcctctgttcttcctgcctccaacagagcccaaccgccgccgctgcctgctgcgtcagaaggcctggggcagatgcctgccttgctgcgccggaagccctggtggcccctgccaccgctgcgttggaagccccgccgccgcttgccttaccgcaccggaagccctgccgccgtctgccttcgctgtgccagaacccccgtggccgccgcccgccccgccggaaacctgtcgtcgactcgagccatcatcgcacatgccagaaccgccagtgcctggccgctgctcgccgcgcacgctagaactgccaccgccttgctcccgccccacggccgccacctggctgctgtctcgacggagcgctgtccgacgctcgccaccgccttgcgcatgcctgcaccaccgccaccgcctctaggtctagggtggtctgggtgttcataggcacaaccacagtcggtggggaggagagggattccatctatatccattcattcagggtagaatggtaaattgatatttcataaatctttttttaatttccatttgtaattctaaacacttaaacgtgggacccaccaaacatgcgttacaagtgggggtaaacggctggttcgttattaaaaattggggataaaattgcaaaccctaaaacgtaggggtaaaacaacagttggggttgaaagtaggggcatagatgcaattgtccttatttaattctacaaatcgtagatgcaattgtccttatttaattctacaaatcgatatgtaagtatatccaatcatcacccctcacattatttgcacaatattttcacaaatctatctatcatttttatttttatgatatttaacatatacttatcaatatgctttatattaaagcgtaagtatcatttatttgttttataataagtgctgataaatcctgatgttttgtttttttttctttttactaatagcttgattctcgaaaaaaatatattaaaaattgtttagtaattcctgcagtaaagcgtaggtaatcacgatacaatgaccggttagcatgcagacccggtcatccaactaaataaatttagaacatagtttgtcagtttattaaattgtttggttaatgcaattaaccaagtcacgtaattgggaaatggtttttccaacttcatgattagcgggctacatgcaaaacagaattttaaacttagtgggaaaggaatatggtgaccgatttataatttcttctcttccgctatagaacaattcagttattttattgcgaaactcataacatgcaaaacttatgggttggtactacactttcggcagcaacataccgaggaaattatagtaacgtaaagcatgcagtagtaacggtattgctacagtacttgtgcatagataaaattttaagtcttaatctcgtgcaaagtacatgtgctaaaaagtgcatgtgtatggtcacaagttgacacaggggctaaagtacttctctttgtccacacaaagacacatacaaagacacatagtagcaagtttttcaaactgcttaacggtgggtttcatgagaaaactttttatatggaagttgctctaaaataccagataaatatattttccaactttgtaataattaaaaacataattaattatacgttaataccacctcatatttcgtaaaacacttaatcttcatcttcatctatatgagtttaaacaccacctaaatactattgatatttttagaattctaatcttttaaacaataatatctctgacaccatatcttatatttgatggtggaaatgttatatttttttagaattctaatcttttaaacaataatatctctcacaccatcaaaatttgaattcgttttcgttttttgaactttctcgaaaaaattccattcgacactttccatttctgaaaatatgttcggaatccgaaaacgtttcggaccgttttcatcccatcggtgtgatgtaatcacatattgtatgttttgtatgacctaggagtcgaaatgctttttgttcgtgtgattaactggtggaaaaagttcaaaaacgctatcgcacgagcggtcgtgtgcggcgctcaagggatcacttctgttttccaattttggccagtggtccgatccctctcttttcctatttaggccgtgttggtttccttctgaaattccttcccggcttggcatgtgtttggtttctttattgggcttggccttagtttttctagagtgagctgaatctaagtgggtgtactatgggcctgtttggggagcttctagtagctgcagtttctcctagaatctccagttaccagaaactcctccaaacaatctagctttttacctagattctgagaatatgtagttgtagaatctgaaaaatgaactagaagcctgaactgggtttcccagcttctccaaattctcactagctagctagcttctcagcagctgcttcttaaaattttaagctctctaaacaggtcctatatatccatgtgcatcgcctagtatcgggtggaaggtcggacaaagccaaaattcttttattccattttttaatttggtattaaatttatacaggcaaagtatatatacgcacatgtgcagaacatctacttatcagtaaaaccacctccacaaccacccaggacattatttgcaccggtcttattagttggaggagttgatatagctggttttgtggatggtggacgggaatcgtactaaagcaatagttgagggagtcaaagtatactttttccttttttttttaagccagtataatgcttgtgggcttaaaggcacatgggctacttggcctgcttaggcacacatggatgggctcaaaggcacatgagctgctttccgttttgggagcacttggatatgctctttttcatttagaaaccgcacatctctgcacgcgcgtgatcagtcgcgtcgcgcatcagacgcccctaaaaaagttggcttcgtttggtgatgggcttttcaacaatgataacgtggaatagtctacacaatcacatcagaattgaaatattgtttggattattggaattgaaatatagtctacacacaatcacaaccgttaattgtcgcccggtactgtgccatccacctttgctggctttctctgcggtgagcaaaggaagagaggagaggggggagaggaaaaagtggaaaagtgaaaaaatgtggtataggtgggatttactttaagcaatttgtatcgtggaacatgtgttgatgaaaaacacgaggcctgggagatcttcttaactccagtgcaggtccaaaactcaccttcgggtatgctagcatgccagttgatttgatcctgcaatcagcaagaaataaaggcaaagaaaccgcggttaaatccataaatgacagccgatcggctaggtgccgatgatatatcatttatctttgagccgatgtcatatatgtatcgatcggcagccatgagtaaataagaaggaactaaatctactcgatcggctgtagatattaacaatatatactccttatatcgatatatacttaaatcaaatgattgggatatatcggtcgccatgccgagacagtataaatcacttagattgaaatatatattaataataagactatatatgtttatagcatagccgatcagatagatctagcatgtatcggctaatactccgatactactctatattaagatattaaagcaagcagaatatatcaaacaaaagcctaatacacttaaatgccacaaaatcttaatataaagggcagatttaacatgtcagtaaagcatatataacaagtatagttaaatcaggtaagatcggctgaaaccccgatactaccctaatcggcaaccaagaagcaggctagagattgagattctaatcacgactcataagatcaaacaactgatgcagctataagtatgaaaagaaggacaatatctagacaatcaagccattggaagtttcatagagtggtagatatcatgtacaatctaaaccaacatcgatatttaacctaatcggctgacctctactagtagatgttagctgattgtaggttagatgatgatattgctatagattatataagatatatgacaactcgacggattacataaacaagattagagtattataaagatggaagcactaatcctgagaacgcaagccgacaaaatcagttttacctcttgttgaaaatcgaaaccgatgcagctcaacccgaaagtaagaactcgtcgaaataaaacgaaagtaaaaagggtggcgatgcgccgagattgtattgaacgtgtgtgttaattgattacatggggtacggggtctatttatacccgagaattacaaactatgtccatatcggacacgactcctatctctaacaaactctaagatatcataagtctttgcagacttttgcccaaacatatctctaaggaaattacataaaatatcctaattaatagatacaattaccttctcaagactctatccatgcgtggcaatcatcttgaagcatatcaactcaacccgatgatgtacaccaagttgtattgttggatttagctaaatcggctaacctcgtccgactcgaaatccgccgatcttagccgtagccgattcggacttcagccgatcttactctgttccccgatcgatttccatctcggattctacttttattccatctctatctccgatacttagattaccaaatttggtcgttaacaacatgtagctaacattgttttttttcttaggtgaagggttccgcaaaatttcgtttcacattgtgaacgtcctgaaaaagttggcttgtttggtgaagctaaggtgcttttcgacaatgacaacgtggaatagtctacacaatcacatcatgaattgaaatattaattatttggatctttgtattattctcctaattctgtccaggtacatagaatgatgtcactagcttcagtgcacgacatcaactaattaataaatgtcaggctactttttaaaataatattgcacatataactttcatatttccttacctgtacatacaagtgtaaattaatttttgtgaaaactattatcaaactatagcaaaacaacgtatccaacaaatttcatcataaaggcacaagcatcttattattagattatcaattatatatataacacaaataggagcttgccgcggtggttggtgcggaggtggtgaagcgacgacggtgcccttgccgactgacgcctccaattccaagaaccgccgagctcctgtcgtcccccactaccgcaccgttgacctcaccgtcctccactactaaccatgccgtccgccggtaccacgtcaccgacctcgttgtatcccactaacagccactgacctcactgctgtactggggtgcgggaggggaggggtgatgcatcgacgagtgctaggccccaccgccgcttttctcggtgccatcgccgcttgggccgctcggctcggcactatctctgcccagctttctctgcaatggggaaaggaagagaggagagaggcgagagaaaaaaaagagaaaagtaaaaaaaaaggtattgataggacctactataagcaacttacattgtggaatatgtagctaacattgttcttcttttggtggcatgtgaggttcagaaaatttcgtgtcgcactataaacgtcctaaaaaagtacaaaatcttattattagatttatcatatatatatatatatattcaaaacatattatcgcaaaaacactagctgcaggctgtggctgtgctgccctgctagctagctgtggttgggctagcacgaaaccatagagctggttgtggctgtgctgcaacaatgtcagcgagcacgtgaataattaatatccatacgttcaccatccttgtgtcgccaatcgccattgctgtccaattgaacgaaaaaaaaatgcttgtctccacgtcgaaacaaacacggcatcgaaaccttgtagaagcatcgctatacaaccaacaacacaaacaaaactgtcctcgtaggaacaaccatcacttaaaatttgttgatattggatatccatttgttgatattggatagttgggttaaaacgaaaataaaggcaccggccagggaggaatcgatggatattcaaatttctgcatgcatgtccggccggtactctattttcaaacttttgcatgcatgcacaccagccggtgaggatttgtttgaagatttggagatgttctgtaatatgtaatgatttggatatgggaggggatggtgtgaaatcaatattcaatattaaaagcagaaaaaaaagaaaaaatatctttagtcccggttggtgatgggagcatgacaccaaccgggactaaagattgatttttagtcccggttatttgaaccgggactaaagatagcgatctttagtcctggatttgtagtcccggttggaaaaccgggactacaggggggttacgaaccgggactaaaaagcatttctccaccagtgtgccatgccacgttaaaaatttcagatatactgttttcttagttagtagaagtatatactcttttcactaactattagtatttgttttgtcactatatactctactttgtttagtagtagtatatactatttttttcaatatatactattctttacttaatagtatacactatattgtcaatgcacaactgcacagatttggtgcacaattgaaggaggccatgcatttggtttcaaaattgacaatgtacctatctaactttcctcttttttcaaatactagtacagattagtactagtatatgcagtatttgtttttgtattggtatatactgttttttttgttactagcagtatatattatttttaaagttacggtatatactatttgtcagttagtagtagtatatgctctttttaaagtagtatcggtatatactggctatatttagttgcagaacatactccctccgttttttataaaagaagacgccg

SEQ ID NO: 49248 - DNA, 6934 bp, Oryza sativa
cggcgtcatctatttaaaaaacggaggtagtagtattttaaaagttcattgcagtatatactatttttcagttagtagtagcatatgctgtttttttaagttagtatcggtatatactagttttactcagtaattcaaaagctaactgcagtatatacttattttcagttagtatcggtatatacttcattttaagttagtggtaggtatggggttgatatatagttatgaatcagaacacactgagtatgactgcgaaagaagtatcaattcgctgattaagatttacaaacaacatcactgttacattcagaattatgcaaaacaaatttaatgctctggccgtatactgaatgaacagtatcagtacttcttttccagatcaaaaccaggagaacaagaacgaaacataatactcctacatcgattttaaaatgatttcttgttgcctgacaacatcaatcacccgggtgccgtacgtggccgtcgacgccgccaccaacagataggcagccgtggagcagcagttatgccatggcattcactgaaattcatgagtcgttcgagtcgacgctgcactgcacatcgatatactctgctatcggccaccatctgcatacaaaagaaatcatgtgcttaatcattcaaggaaagaaagccagaaaggcagtatatactatacgtgaatagcagcacggacaagcagaaaaaaggagttcaattaacagatgcatcacgtacgtacgtgtttttaccggacgccggcgttgatgcgttgtcagatttcatcggctggggcaaaaccatagcttaagggaagaggatgaccttacaggggctgccgtctctgatgacgattcgcttccagcaagcgacgtacgaataggccaggggatttgcaattataacactgtaaacattaacctttgctataatggtactggacccacattttatagacacagatagatccatttgtcatccactcgaaatgtcccaatattgtaattttcaggaataggccatagggctagcgaaatcaatcttccgccgcctgctgggaacgacgaagtcgccgtgcccgagagttgaagcacgttgtgcctgccggtgaagcgcgccaggaacgcgccggccgtggtgccgccatctacgcttctccgatggggtggatctgtcagcacgccgaatctccgatgagcatgttgcccctgccgccggctggatagaaccggaatatatatgcgagcagttctacaccgatgccagatccgatcatcaagggataatcaaatattccagcttttctttttagaaaattcaaaatcggtctgctgggatccgatacgcaggaacatgtgtgcaatcgatcgataaggtacgcggatggacggtggatgcggaccaggagtacgtactcccgggagtacataaacatttttcatatatatatatatatatatatatatatatatatatatatatatatatatatatatataaaatcatgagcagcacttaagagtccggtcgtctcaagttagcatgcgagtttttttaaacaaatttcttatatggttccttctgtattaccaaaagtaaacgatgttaaaaaccgactcaaatacggatatgtattttcaaaagcaaacgaacttaaaacccgctcatacatagatgatatcaaaaaattccggcaaaaacatcttcaatttttacaatagtagagatagatttatatccaaaagtattttttcataaggcgttaatgttgtggctattgataatatatatactatgtgaataatcaaagtacaatattaaagatagtataaaaagacaacacgctataattttttccgagcgggtatatttgtgttaatttacctttatatatgaacagccaatatgcttagcatacgtgagtagggatgaaaacggatcagatacggtcagaaactagctctatcatattcgttttcacattttttttaaatcggaatcggaatcggaaacccggatatgaaaacgaaatcgaatattgtcggatacagatatggtgcgaatacgaagcgaaacgaataaggtgacgaatattaatcggaacataaaacccctcaaactaagcatcacaactcaaaaaagaaatataacccgttattttttctaatataacatatcaacttttccaaattttagtgttaataattttgttatatccgattttgtggttgagggagaacgattcaatagtttatcgcactcatatgggcgtcttaaggagctgtatgtgaaaataatatttaaaactagtttatcgcactcatatgaacactaaattggatgattctttttcataaatatttctaaaatcatgctctaacgtgttattgtgttcttactgctattattttggccatagtttcttgtgactttgttttatcaatttaaaatttgaatttcaaaaaatagcaacttcagataatattttgaagcagtaaataattttagctgaaaaagtcatgaacataagagttgtagaattcatcaaaagctacaacttttattttggtcatttcttcatccgataaagggatagtaacattgttcacagaatttatatatctctcttacagcttatgaaaccatatgtgtgatatgtacattttgtaaacaatgttactatcgctttgtcggatgaacaaatgactaaaataaaagttatagatcttgatgagttatataactttgttcttgatgactttttcagttgaaatcattcaatatttgaaaatattgtttgaagttatcatattttaaaattcaaattcaaattgtttaaacaaagtaatatatttgaaaaatgacccaaacaaaagttgttgatcttgatgcgttgtacaactttgttgttgacaatttttccatttgaaatcatttactactcgaaaaattatttgaacttcttatattttaaaattcaaaatttatatagttcaatcaaactcgtatagagaaatgactaaaagaaaattggtagatcttaataaattctacaagtttgtttttgacaacttttttcatatgagttcatttagtattataaaatttaattcgaagttaagggagtacatacagacttattagctaattcttaggcccgttggcccatttagatagagggatatataaacctaaccctacccggccactcccacagtaccactctcccagccgccacccttcctcccatgacagcgtgcgccggatggcatggcgacaccagccttggggtggccgacgtcgtgggctccgcggcgcgaggcgacggcgtgcgacggatggcggcgagcggattcgacggtgccggccccggagcggcccaatctgacgtcgtgagacgatggtgacgactggggcttggctgcgcgaggcgacggcgtgcggcggacggcgacaccagcctcggggtggccggatccggggtcggcggtcccggagctgcaggatccgacgtcgtgaggcgacggcgacggtaggggctcggcggcgcgaggcgacgacgtgcggctgacggcgacgagcgaatccggcggcgccggccttcgggtggccgggtcacgacgacgggctgcggcggcgggctcgactgcggcgacaactacgatgcgcggcgatggcgtcggtgggcggcagcggcaggcggcggatccggtggcgccgccctcaggaggggtcggatccgccgccctacggaggtgttcagctctcggccccgcgacggccagcggcgggcagcagcagcggcgcggatctggcgccggccacgcggcggccggcagtgggcagcgcgaaggtggccggctaaggttttaagggtttcttttttttttttgttgaaaaatctttcttttgctaaaataccggaaatccgatgaaaaatcccgcatagtttccgtcggatatcaaccttactatattagttttggtatccgagaaaaaaaaatccgaattcgtttccgaatccgaaaaatcctggatagttccgaccgaatttttttgaatctaaaaattggttcggacagacggaaacaatccgaaccagtttcatccctaacgtgtgttagagggtgatctcctccttcatggacgcgggaggcccccctttttttggttcggccgggggcagctgtaacatcttgaaaattcccaacaataaaaatcactgaaatttcgaactttttaaaactctttgcatcatgctggaagttatggttgttattgcttgccaaaccataaatcgacgcaatggaaaaaaaatcaatctaaagatttatacccgagcaatagttacgatttacaacgatacgatatttattatcaatcccataaaatatttatgcacatgaaagccaggccaaataaagtacaagtcaattattaaaccctgtggtataaatcacaaatcaaatattaaataatcaaaccatgttgatagcctgatttcatatttaacaaaaggaaacaacatagttgaatataattcacttgaatccaatctcacatgaaatatataagtacacatgaaatgatgatcacatcaatggccccatctataatagagtatctcactagaatatataattaatatttgaaacaccttattaagctcctcatagcatgaaaatcactcatataaaataatggtcatataaataaactaggctttatacataaataagaatatgtgagtgtttaattaaacaattagattaatgttgtactaagtctcaatttatatttatagaatgagtagacccacgtaaaatgcattgttatacaaataagttcattcaatgtgctattgtaataataatggccacattaggatattttaaattaattttagaaccctcaaagcctccaaaattatctaggttaattttagatttaaacctcatttaaataatacaataggaaaatatataaaatatgggtaatattaaattttggtcaactttcatctaaaataaaacatatattgggtaaaactctaattgtgtgaaatctagaaattatgggacaagttttaatagaaaataggcctcaaaagtggataattaggaaaaagtcactgtgcctcgccgccgctgagccgacgcgccccgccgccgcgatgtgcctcgtcgccgcgccgtgctccgccgtcgaccccgccgctgcgtctccgtcgaccccgccgccgaaccagtgagcctccccctcccccaccgcttgccgtcgcgccgtgccgcccgccggttctagccgaggccgtgagagagagaagaaaacagagaggagagagagaaaagagaatggaggagagaggttagagtgggccccacctgtcattaattccatccaatttcccttagaaaaataattctgtagaaaagaaattcaagaccttgaccccacctgtcagtcactatagcttgtggataaggttgtattataaataaatgaattaggaacagtaccattttgcaattattagaactaattcaaatttgaatctttatactagcataacttattcatttcagctccgatttgagtgaaacttgaatctaaattcatctaaattcataagctttccaatgatatataattcactatttgataaaatatatttataaatattaaataattaatatcaagatgatgcataatagtcaacttaaaaatatgctaataaataaaattagtattgtacagtagggtggatgtaataatatttgtctctaacatgtttgcactgtaacaaccacacaaactaattttatgtgatgtctcaaatgaatggatgtataggaaaatactagtacttatttaatattcgatggccatataattaaatccatggcttataggttatttaaatcaagtatagccttatgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagtaacccaatagaaccagtgcttaaacttgtcgtatcacatatacaatatcactcatagaaactagctaatgtataattaaactacaatatattcaggaatcacttggagcattgggtagtacactttctaaataagctcatgtacagtaggcgaccaaaaccttatacgttgttgcacacatatattgtacatcccattatagttacacaattaatttatctttttcatatattaaactggggagtatataacaaacatgaatagtagataagtactaattataaatcttgacctcatatgttcatagttcaattgtaactccggattgttcattaagagataatctgtaactataatattataaacttcccgaatttaacatatagagcatggataattattagcccttttataatttgtaatggcaagtaaaatatgttcataattaaagtaaagcttccatcaataaaataataatacaaataattcactgtaattgtttgattgatcctaaatccatctaacaacagaacctctagtatataactgtcctatttatatagatgcatacatagccataatccttcaatagccatttgatagactaaaccaccgattagccaaatatatatgtatcccataaatgctatgttggttaagtcctaaataggccacgatgacaatagaaagattaagaaactttagccttagcatgattgggatccattagcaaacacgaatagtacattttgttgcgcatatttgattgttgtttgaatattggtttttctcgcgtattatagaccttgtgtatcggttagtcgtgaggcaacgt

SEQ ID NO: 49249 - DNA, 1559 bp, Oryza sativa
  unsure (1)..(1559): unsure at all n locations
tatagacctagcggattagatagccgagcggaggcagtatccctgcatagatggttcacccctgagtgaggcaggtgcgctatgatgggacagccgttgaggtagggccgagaggcgtgccctacatcggtgtcgccattggtaggactgccatgagtgtgtgagagagagaacttaacttgaaccataatttaatatgtgtgagacttctctttcccggaagcgccagaactcctcacactgctagaaacatggacgcctagagtgcatgaggatttaagttcatggagcgggtactgccagtgcaagcttatctaaaagctttgccgtgacgtgtctcatgtgttgggacgaggctcatgtgttgggcagtcacggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacattctgagaggagggaaggtggacatcctcagaaaaccatgacgattcaatggcgggaagctatccttgggatcacaatggatggtggacagaaccgtcgttgtttaaagtgaacactggtgctaaaatttgatcagtctatgctaggttttaggcttgtgaaaagaattgtaaaattagctttatgcaaaagaacctgaagccattccttgaaataccctctatcatatgcattgttgttgtggtggcttgctgagtacggttggtactcacccttgataattatatatcttttaggagagtgttgaagagaagcccttgtcggtacgcttgcgtatccaacaagatgatcggagtgcggtcttgttctaggtctcgttccccagtcgactgcttgtggcatgttaaccgggcccttatattatttggtcttctggtgttgttctctgatagttattggcctacctggccctaatgtaagtatttaactcttttagcctgaattcattcgtgatatgttgtgattcaactatgtatgtgtgtatcaactactgatccagggattggtacggataaacacagatgatttccgatttccaaaatcgggggtccacagcagcgggtgagatccgaggttttcgagacaaaagagacacaaggaatttatacaggttcgggccgctatgaagcgtaataccctactcctgtgtgtatgatgattcttctgtgcttgcaaaagcctctgaatctccgatgtacaagctagggttagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49250 - DNA, 818 bp, Oryza sativa
ataggccatagggctagcgaaatcaatcttccgccgcctgctgggaacgacgaagtcgccgtgcccgagagttaagcacgttgtgcctgccggtgagcgcgccaggaacgtggtgccgccatctacgcttctccgatggggtggatctgtcagcacgccgaatctccgatgagcatgttgcccctgccgccggctggatagaaccggaatatatatgcgagcagttctacaccgatgccagatccgatcatcaagggataatcaaatattccagcttttctttttagaaaattcaaaatcggtctgctgggatccgatacgcaggaacatgtgtgcaatcgatcgataaggtacgcggatggacggtggatgcggaccaggagtacgtactcccgggagtacataaacatttttcatatatatatatatatatatatatatatatatatatatatatatatatatatatatataaaatcatgagcagcacttaagagtccggtcgtctcaagttagcatgcgagtttttttaaacaaatttcttatatggttccttctgtattaccaaaagtaaacgatgttaaaaaccgactcaaatacggatatgtattttcaaaagcaaacgaacttaaaaaccgactcatacatagatgatatacaaaaaataccggcaaaaacatcttcaatttttacaatagtagagatagatttatatccaaaagtattttttcataaggcgttaatgttggggctattgataatatatatactatgtgaataatcaaagtacaatattaaagatagtataaaaagacaac

SEQ ID NO: 49251 - DNA, 2300 bp, Oryza sativa
caagggatgtcaagattgtcaaaagtttgaagcatttcaaagggcaccagcatcggctatgaaccctatcatcaagccatggccattcagaggttggggaattgatatgatcggtatgattaatccaccatcgagcaaaggacacaagtttatattggtggcaaccgattaatttaataagtgggtagaggcgattcctttgaagaaagttgattctggggatgctatccaatttgttcaagagcatattatttatcgctttggtattcctcaaactattacaaccgatcaaggctcgatctttgtgtccgatgagttcgttcggtttgccgatagcatgggtattaagttattgaattattcgccatattatgcacaagccaatgggcaggccgatgcatctaacaagagtttgatcaaattgatcaagagaaagattttcgattatcctcggcaatggcatactagattggccgaagcattgtggtcctatcggatggcttgacatagttcgatccaagttcctccttataagcttgtttatggacatgaggctgttgtaccatgggtagctagtatcggctcaagaagaacggagttgcagaatgagttgtcagccgatgagtattataatatcatgaccgatgaaagggaagatttggttcaatcaagattgagagcccttgcaaaagttactaaagataaggaacgtgtttctcaacatgataacaagaaagtggtagccaagtctttttcgaaaggtgaacttgtgtggaattgattttgctgatagggactcgagacaacaaattcggcacgtggtcaccaaattgggaagggtcgtttcaaatccataaagttgtgtccaaaggagcttacatgttgcaaggacttgatggggaagtttatggacgagcgttaaatggcaaatatttgaagaaatattacccaagcgtttgggttaatgcatgatcggctggtattgccgatacatgatagccgatgtgttcacatcgccttgagatggccgatatagttgtatcgcccttagttattttcatattgtaatccattgtgttttgccgatgtacaatggccggtatggttatatcgcccttagttgttttcatattgtaataggttgtgttttgccgatatacaatggccgatatttttatgtcgcccttagttcaacttataattttatcaatgccttcgtcattataaaattaggggggcacatatacatgtaaaaagttgcaaaattttgagcaaatataggaagtcatattaattgacggatgaagtatcaagagtttcttagccgattacaaaattttcctaagtcctattacatagaaagtcgctgagataaatatcgttgtattgccgatacagcacgttgtctgatttgttccacttcttcgattgcttgggcatcttgtgcatcggttccagggacgattttcaaggacttagtcatatcggcaacatttctgatagccgattttagccttcgggagatcggctagtttcttttgctccaaatctagctcggcgttacattcttcgagttgtgctatgagttcaattttggacttgatcggaccttcagacaagagatcaagcttggacttttattcatgcactaactgccgattgatttggattgtagcctcaatatccttgcactcctgatgatcggctaatctttgcttggctttctccagcttgaattggtgttgctcgagatagacagctagagtaacaacgtcggctagctcatccggaatttgagattggatctcatgtagccgagtcctgattgacccacaatcgaccactagattgtctagtgatgatgcctctagccgatgagagatgtcttgaagttttttcttcacatcatcagaaagaggggccaaagctttgttagtggtgtctttttctatttcatcaaagtaatctttgatatcaaaagaaaacagatcggctagggcctgcaagacagcaatttgaagacagttagatatcaaatggatatagccgatctaagaccttgtgttaaagaaagacttactgggatggcaggagcggctggttgttcctcttcctcaacattatggcttcctgcaaccgatggagttcggtcacttgacgtttgttgtacaggaggcgaagggggaggaggaggctgaaaggacagacaagtgttagttcatatgggctataattagaatttcgaaagacaattttaccggtggagctggtttgagagttgttgctgccgatttcttcct

SEQ ID NO: 49252 - DNA, 41361 bp, Oryza sativa
  unsure (1)..(41361): unsure at all n locations
gtagccgatgactggaggggttaatccaccaccatttggcaagaggcctggagaaaactctatatccctgccactgttgcttttgtgtggaggagaagattctgttgtctgcaagacaaagaaaagtcagtcaagatttaagttggctaacaattattcaagcgaaattaataaagtaaaggtgtacccgagggacaacatcagagaacagatctgtcatatacatagaagccgactgatggaatatatgttgtttccacgctccccaccacctgtcaaagtttctgctcctaaaccttgccagctctatgctctcaatgctgcccaaaggaggccctgggatattgagtagccgattcatcatcagggttgatgaaatttctcctcagcattggattttatcggcaaagaacaagccgattggtagctgtcccattccaaactgtctagcagagctcattgggtggtaaaactcataaaaaacctgtatgtttcttccttgatgaatgccaataggaaggatgcatgggctgatagcaactgagaagacttctctggacttttggtatctctcatgattgatgccttcaaatctgaaatctgctaggagttcaagacttactgagtcttcataagggaaccaaacccaagcatctttctaaaacccttcataaaagctgcggaaccaatccttgagcaactcagccgataattttgctccagcatcggctggtgtggatgcatactctccgtaggacatacacctgtgatgggtgcgttcttctccatcattgtctgtaatcggctccaatcttgggaattcagcttttgtcacagatggtcgattgacagctttcatggctaccagatttagccaagtttgcagcagccatcatggtcctcctgcaccaacgattgagccgacagcaatcttggctgatgcattgttcagtgtttgatataggtagccgagaaggatcttgcgtagaggaaattgcctttttgattctagggcttcggctaaaaactgctaattggttgtagggccgcaactagatccacagaaaaggaacttttcaagtcacatcagtaggaaggccacatgttctgggggagtgacaggtcctttgcccatatatgctgccacataaccagaccaaccacctatgctctaggtcctgaagacgaattggttcttggtgttcaggctcataggattagccgatgaagttacatctaatccagtaatcatggttatgtcgatcagagttggggtcatcggcccttggttggacatgaaggcattgatggtgttggacccgaaataggtgacagcggccatcaagggttcatccttggctgaatttgctatagtgagggcgagtgcctggctgattcgattttatcccagtgagcctgtttgctagccgatacccgtttgaaccaccagcccaacttttttcgggtgaagttttctcaagagatggccaagacttgaaagtgtttttccagtgacctagattggggttggctaatctaaaggcgattctgttggttccggcaatgatgaattcagtggggtcgagctcgccaatcaaaccaagaaagtagtggttctcgtgtgatagactgggaattgctactagattggacaagtgctgcagacgcagatgagaatagagaagaagaaaacaagatgagaacaaggagaaaatgatctacagcatgagagaaggggatctagccgatggatacttacctctacctactcggccgacggcgtggtcgacgggctggcggaagtcgacatcaccgggagcggaaatctggtcggaaggggaattgcctcgaaatcgcgtggtgcgtcaaggggatcgccggagagagagaagacggagttggcttgagcggtgtaaacggaagtgacggtgtgaagtttctcgggggcaactgttagtatttaaagcagagcgataacggtcgaagaaacggcaagtgcgatattctctcggagtggagatatggcaaatccgaaacactatcaaatattccggacatggggggcatgtgttaacgaccaaatttggtaatccaagtatcggagatgaagatgggatcaaagaataattcgagatggagatcgctccagaagcaaagaagggatcggctgaagtccgaatcggctgcgaccaggatcggtagagtccgagttggacaaggttagccgattgagccgaatccgacaatatgacatggcatacgtcgtcgggttgagttgatgtgcttcatgaggattgccacgtatggatagagtcctaagaaggcaattgtatctattaattaggatatttcatgtaatttccttagagatatgtttgggcaaaagtctgccgtaaaaacttatagtatcttagagtttgttagagataagagtcgtgtctgacatggacatattttgtaatctcgggtataaatagaccccgagccccatgtaatcaatctaacacacgttcaatataatctcggcgcatcgccaccctcttactttcgttttgtttcgacaagttcttgctttcgggttgtgctgcattggtttcgatcttcaactagaggtaaaacttgttatggcggcttgcgttctcgggattagtgcttccatctttatgatactctaatcttgtttatgtaattcgtcgagttatcatatatcttatataatctctggcaatatcgttatctaaccaccaatcagctaacgtctgttactagaaagcagccgattaggttaaatatcgatgttgacttagattatataggatatctaccactctatgaaacatccaacggcttgattgtctagatattgtccttcttttcatacctatagctgcatcagttgagtttgatcttatgagtcgtgattagaatctcaatctctagcctgcttttggttgccgattaggatagcatcagggtttcagccgatctgacctgatttaactactttttctttatatgctcgattgacatgttaaatccgccctttatgttaagatcttgttgcatttaagtatattaggctttcgtttggtatattctgcttgctctaatatcttaatatagagtgatatcggagtattagccgatacatgctagatttatctgatcggctatgctatgaatatatatagtcttgttgttagtatatatttcgatctaagtgatttatactgtctcggcaaggcgatcgatctttcccaatcacttgatttaagtatatattgacataaggattatctacagccgatcgagtagatttagttctttcttacttattcatgactgccgatcgatctacatatgacatcagctcaaacataaatgtaacgtcatctgcaactaaccgatcggctatcatttatggatttaaccgcggtttcttttactttatttcttgttgattgtggaatcaaatcaactggcacgctcatacacctaaaggcaagcttttggacctgtactggagttaagcagatctcccaggcctcgtgtttttacatcaacaattacatatgtgattgttgttgttgaccaaggaattattttttgttgatttgtgattggattgcacatgacgaatggagctggctcggcttgaagctggcatctctatttttttttaatcgggaagagtacaaatatgtctgttctaggttattggtgctgaccaattagtgctggctgagaaaccgacaactattgccggttctcaaccggcacctatgaaagtttttgtattagtgttcataccgtattttttggagtaaggacaaaaatcctatagcctttggctgataagtacacccagatatatgtcagatcttctttccgaactcttcctctagcttggcaatgccagcagtagagggcgacggcggctgcagggacatattattcaattccgcgggagttttaaaatttaaaaggggtggaaacatgatttcggcaataataaaaaggggtagcacacgagacctaaaagtggatggatgcacagacaaaggatttagacaggttcaggccctctcgatgagaggtaataccctactcctgtttggagatttgaatccaccgggtgtaatatagatctgacgatctagttgtctcatgccccctagagggcctcctgcccaccttatataggatggggggcaggattacaagatagaaaccttaaccaacacggtatcggtttcctaaatctactttacaatcttatcaagccaggactttaggccgttccataatatacagggaaacgtaatacccaagtcatgatctgttacatatttcatagatataagttatcccatataactagtcggataaccatgccgtgtgggtatggggtacccataatctccacagtagcccctgagaccttcacagtcgaaaagataatcttttctcgaactagattactccaaagccgagtgcttcaatcatctttgccatgacttcccgagtacttttaccaaatctgaagactgtggagggctgaaaaataaagtcaggtgcatcgactagatgcacctaataggtgtagcccccgactatgtggttaattgaacaaaccaaacatattgtcaaggaataaataatctaaccaaccgagtggtttcgataatagcatatgatgtgtgaatccctgaataatatgatccaagtgatataccgactgctttgtaaaatatgatgcgtgcaacttaaagtcgactacattattgaaaattcacatagcaaaacagctataaagaagcttgtatgttgtgaataaagaaatttccaaagtattgggcatacgccatgcgcacactgctttaacagatgtgcttaagtccctaaaagacacatggtttcaccacacctgaaaatatatggcatatgtggtgtaaaatccgagtaaataaactcataaaggatttaccaactgcctagaaaatgaccaaaatatataatcagcccaagccataatattggtcaataaaagtgcacacttacgtggcaaaaaacaatgatattttatccaatcaattgctttatgaacccaaacagcacctcgacttatataaaaaaagtcagcgggcagctatataaaacattactgtttggcaccttttaaaatgcattgtaccaactcctaaaaagttgagtaacggcggtataaaaggattttaaggtattgggcacataatcacgcgcacttttgcctaagcaaaaagatgcctaagtccctaaaagaacgtgacaggccacacctgaaaatatgggctgcagacatattaggcctaggccaaaacatatgccctcgacaccctttaaaggatgacgcatgtaacatgctcccgagtaataaatcttccgggtaatatagaccaagcgtagctcatatgaatagcttctgatctgagtgattatcccttatgggatactccaaaatagatataaaaattgaatcccgactggcgcaagtattcggttgataacccttacggagaataataaatagtccagtctttgagcatagaaaatagacccatgatcatgaattcatgttgcatgtaaccggaacaagtccaaattgaaggtatgatacttgtgtttgaactagtaagcccctgagcatatagcttgtccttctgtcgtagtcacaattgtccattgatggtagctgacgcagttggcatagagacaagacgaccaatatagagataatattgcccaccagaggtggcaaaaatattggtggtagtgaagataatgataccaatcaaaagtgatgaagttgcacagccgtggaagcgaagaaaccagtcggcagtagtcaggtcagccattaatgaagatgaaagcgcccagcgataaagttgtgtagccatggcagcgaaataatcagtcggtgacagacgaggcaaatcaaaggcgatgacgaaatccaccaatcatgaagatgaagaaacattatgggtacaatccaccaatcatgaagatgaagaaaatagtcggcgacgacaaacgcaactgttgtccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtatttgtgtagcccccgactctttgattagttgggaaacaactgaacatagagtcgagaactgtagcttcttgtcgttgaatagttattgcttgattgaagatatgtgttgaagatgtccaagtagaaatcatgaatgttggagagccacttgttgtagtaaaataacacagcatcgcatgccgagatgtcgagattcacaaagacgtcatggttggtgaagtagcaaaacttgtgaagtagcagcaatagagtttgctggtaccgaagataataaagatgaagtcgctccaccatgatgacaaagttgcgttgccgtgatgaagtgaacacgagtcggcggcaacagaagcaaaccggtagtgaagacgcgcagttgtgaagataaaagcaccagtcggcggcggcataaccagtcggcgacggaagacgatgatttccatcagtagtggtagctgtataaacaagacgtagaggcgagggcactagtcagcagtagacgagacgaccggcgatgaagaagataaagccaatcaacactggcggaatcatgcagccatggaagtgaataaactagtcggcagcagatgtagacagcttgcgttgaagatgataacgcctattagcggtgacggcgacgtggccagccgtgaagaagatagcatcagttggcgtcataacaggctagccgtgcaggcggtgacaccagtcaacaccagtcggcggcggacgaggcggccggtcggtgaaaacgtagacgcccaacaacggcggcataataggccaaccgtgcaggcggaaacaccagtcgccggcggacgaggcggccggtcggtgaagacatagacgcccaacaacggcggcataataagccagccgtgcaggcggaaacaccagtcagcggcggacgaggcggccggtcggtgaagacgtagacgcccaacaacggcggtcataataggccagccgtgcaggcggaaacaccagtcgacggcggacgaggcggccggtcggtgaagacgtagacgcccaacaacggtggtgtgaccaaacaaccgtataggcgaagacaccagtcggcggcgatgacggcaagccggtggtgatgttctgactgatccattcctggagcgtaagagataagcttaaagccatgaatcccttttgtgcatatctggatctggatcctgcagaacaaacatataggatgagtaatatctgatataaatataatactcgagaaaaaaatcaagtatttaaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgactgacatgagttcgtcattaatggaacaaagtttcgcggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggccagtcgtgtaagcggaaacactagtcgacggcaacgaaggtgagccaacggtgaagatgtagacatccaacaacggcggcataataggccagccgtgcaggcggaaacaccagtcggcgaaggccagccggtcagtgaagacgtggacgcccatgaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgcaggcggaaacaccagtcggcgaaggccagccggtcggtgaagacgtggacacccatcaacagcggcataatagaccagccgtgtaggtcgaggcaccagtcggcggcggggaaggcaagccggctgtgaagatgaagatgcctagcaatggttggaaaatgctaggatatgtcctcacacatgtttgctcccaatctgctcgcacgcgtgtatatatgtgcatacggcagagtgcaaattatgagtgtgagcagctcgctccagccagatcagggcgacgtcagccggatggataggccaacgatgattaatttgcatgtccatgcatctgaaagtattgcactccactgtgcttgcatctgcccctgtaaccaacagtccttcagcatgatgccgtcgtcggaggtaatcatggagccgtcaaacgccagtatatgcacgcgagagaaaacgaagaatcaaagggcagatcaatctatgattaaaaaaatcataattataataatagattggaacgataaattagccgatgccggatagcagtttttatccatgcatgcatgtgtttatgcgtgtagatgcagagccgatccttgcgtgtccaagtgcatgtgcggacggatgattgctatcccggcgagtagctgtcttcacacggctgatagatggctgcggtggatgacgcactgctacacgcctccgccgaggcgccgagtccgcgtcgaactcgaagcgtccagtttgatctcagcaatcaatctcaccgagcataacagaaaacggcgatgacgacgacgactggatcggaggctcgattgctatccggtgcgtgtgaacatccatcgctccagcatgcctgtccagatagcagtggtgactcccgtggccgacctccatgcagagcagtacgatcaagcagggttttgcaggctggtagctggagacgtggccgatgatctcttggatacagatgatttttttttggctacggactgtatagcagctccagccggcatcttggcgagctgcatcttgaggattcaccaccattggtgacgtcggagattggagtgatccaacttgctgaggttgattttccttgctagattgaatctgattcggcgccttctaattggttccatctcacttctcgtagataactcgacgcacccctacctggcgcgccaactgtcgaaacatgatttcggcaataataaaaaggggtagcacacgagacctaaaagtggatggatgcagagacaaaggatttagacaggttcaggccctctcgatgagaggtaataccctactcctgtttggagatttgaatccaccgggtgtaatatagatctgacgatctagttgtctcatgccccctagagggcctcctgcccaccttatataggatggggggcaggattacaagatagaaaccttaaccaacacggtatcggtttcctaaatctactttacaatttatcaagccaggactttaggccgttctataatatacagggaaacgtaatacccaagtcatgatctgttacatatttcatagatataagttatcccatataactagtcggataaccatgccgtgtgggtatggggtacccataatctccacaagaggtaccttaaaacaccactgaataaaaattaatttaaggggcatccacatttattcaattttggaaattacaatcgtctaccgtacgtctacgtgccctgtcctgggccatgcgtgctgcacgtggatttaaccatttcctagtttaattacttcggaattagtgcaagaaattagttatcgttcccggcctgaattggttaaatatgcaactctagaggaattgggaattgggatcacctgcagtggctatagccactacaacctaagcacttttgcagccaccattggattagaaaatgatgttgtagatctaatttggagtactgtttacagaagatgatacaaagctttctcctgtagcaggcactatagccgttactgtttatagcggtaagccggtatccgacaaggtgataaggtggactgctccaccattaatgttattactagtagcaaagaatactttgttgacagattaacctacttgcacagaaaacggagctacgaggtggtatgcaatgcaccagaacacgtatgctggatgaatatatatcatgttacctgtgtatcctttattagtttctccctccattctaaaatataaaacattttcagacttcgacgtagtctttaagatagtactagtttaatcaacaatatctacaaaaataagatattttaaataaaaagaattgcatattatgatagtttgtttaatgataaatctagtagcattaattttacgattgatcttttttatatttttgctattaatagtcaaagttaaaaatgtttgatttgacactatgctaaaaatgcttatattttgtgacggagggagtataaactatgtactagttttttttcggtattcaaaatggaactttgttacccatgttgaattattttttcatttttctttttgatattgtaatggttgtatgcgtctgtagttggtgcgcgtacgtgtgcataatgcatgtaccatgtatgtggttacactttatattatatatggatcaatgtcttatgtgcacgtttggattttattgatcattatttttcatggtaacacataagattaaatctacagttattatattgtaatccatctaatcgatgccatctttctagttgttatgagagccctacaggagacgtgtaattagaataggtatttatatactgaatatataatatttgctcgacatataaaaccttagaaatggaaccacatttggtccaaattcgatgaaaggattttgttgtgtttgaaagcaataagacgtacagtactcctatattttttgtgtgcgaatcatgaacagaaaaaatatacgaggcgacaaagcatctattgatctactaccgagttttaaagttgttttcacctaacgacgtcgaagatgggaactgttgcgtcagaaatttagagtcacacttgtgaacttcaagggaaaaaatatactttcgtcaataaatgtatgcatggggtagtcatgggggaagatggatgcatgactgtatggatccgagaagagtgagcaaggatcacgttgaggtccgtccaaagtcgaatggctcagcgctgcagcagctcagatatcagtacgccggcaggttacccattgccgatctgctggcaaccacactagctagcatccagtactatcctttcgatagcatgcacagcatcccgagagacccacaagagtgttcactgttcattaggctgttctctgctcaactgaccacgtgatgtgcacgggacagaattaaaacacaaatgcatgtttattatatgatttatttacgatgttcgatgacatgcctatttcccacagttaaaactgttgagttgtgatccaaatttatttacctttaaaataggccagcttctgttggagcgaaataaaggtatagatcgtaatacattttagggtttcaccttttatatatatatatatatatacatctcgtaagctgccatgcagcgttgtaacatcacctgatatagtgaaaaattttgttggctggcacacgtggttttttctcctgctttcgcagggttttccacgttaaatctcgtgtcttctatgatcgatctattgttttttatcgtttgtttgcctatcgtttcctaacaagtggtatcagagcttattctcatattagggtttcgcgatggcatcgatgaagtatgatctagcgctgctagactacaagatgagattctcgctttggcaagttaagatgcgggctgttctggcgcaatctttggatcttgatgaggcgctggaaagcttcgggaagatgaagaatactgaatggaccactgaggagaagcggaaagatcgtcaagctctgtcgctgatccaacttcatctatctaatgatattttgcaagaagtgttgtaggaaaaaactgctgcagaactttggctcaaactggaatcgatctgtatgtctaaggatctaaccagtaagatgcatatgaagatgaagttgctcaagcacaagttgtaggagagtggttctatgttgaaccacatatcggtcttcatggagatcgttgccgacctagtatcgatggaggtacagtttgatgatgaagatttaggtcctctaatgttatgctcactgcctagttcatatgcaaattttcgtgacacctgttggcaacttttttgacaagttgacaagcacgatcgtagcacctaaagctttgtggtgacagtagaatcgccaatcaccctaatctagcaaacactagattaagatgggttttgatatgctaaattggctagcggagccggtctagatgaaaccatggataactacacgtctcgtgggcaaaacggaaggttttcaggacaaatctacaaagaggtgtcgcactctcgcaacggcggtggacgatttacagcgcaaatcgacaaagatggacaaactaaactagaactagaagcaaaagtaaagaacgattcgattgattgatttttacaatgaacaagccttgtcccttatataggggttggtcttgccctctacaggtcctcctccatgtccaactcgggatagaaaccaaaggaaacccgagacataacttcccaagcaaggaaaactcgagacccaacgaaacagtctcgggctcggactctgccggtcagaccgtccacatgccggtggtctaactggggttcaagccgcggtctgaccggcctatacacggcggtcagaccggcctcccagaggaaacaccggtagatcgtccaactttggcaatttccctattttaatcntaggtgccaaatttgggtgtaaacaacaccatactataaagccgtgatgatctaacccttgcggaagtttatgaggtactccaaaacagggagaagatgaaaggtatggtttagtctcatgcatcgttctccaagggcgaagcattgcagattagtggcagatctgagcagagaacctacaacgacagcaatgatcgtgacaagagccagaacggtagaggccgttcgaagtccagaggtaaaaagttctgtaagtattgcaaaaagaaaaatcacttcattgaagaacgtaggaagctgcagaataaggagaaaaggaaatctgatggtaaggcctctgtcgttaccggtcctgaaaactctgattcaggagattgtcttgtcatttttgctggttgcgttgctggtcatgatgaatggatacttgatactgtatgttcatttcatatctacattaatagagattggtttagttcttacaagtatgtgcagaatggagatgttctgcgtatcggagatgataacccacgtgagattatgggcattgtctccgtttagatcaagacacatgatggcacgacacacacgctgaaagatgtgagacacataccagggatggcgagaaatctcatctctcccagcacacttgatgcagaaggatacaaatactctggttcaggtggagttgtaaaggtataataggtgatatgaattctgctaacttatatgtcctcaggggaagtacattacatagttctgttaccactgctgctgtttctaaaaatgaacctagtaaaactaacctgtggcatatgtgtcttggacgtatgagtgaacttggtatggcagaattgatgaagaggaacctgctgaatggctgcactcagggtaacatgaagttctgtgagcactgtgtttttggtaagcataagagggtaaaattcaatacctcaattcatcgcaccaaaggtatacttgattatgtacaagctgatttgtgggggccttcacgtaagccctctcttagtggtgctcgttatatgcttaccattatcgatgattactctagaaaagtgtggccttatttcctgaaacataaagatgatacttttgttgcttttaaagagtggaaagttacgatagaaaggcaaactaaaaaggaggtaaaagtacttcgcactgacaatggtggtgaattttgtttggatgcttttcatgattactgtaggaaggaaggcatggttaggcatcacaccatctcatgcactccacaacagaatggtgtggctgagcgcatgaacagaaccatcatctccaaagctcgttgtatgctgtccaacgctcacatgaacaagcgtttttgggcagaggccgctaacaccatctgctatttgatcaacaggtcacctactatcccaattagtaagaaaactcccattgacgtatggtttggtatgcctgctgattattcacagatgagagtttttggatgcactgcttatgctcatgttgataatggaaaattagagcctagagttattaagtttttgttccttggttatggttcaggagtaaaaggatacaagctatggaatcctgaaactaataaggccttcatgagcagaagtgttgttttcaatgaatctgttatatttaatgacagcttgtctacagatgtcataccaggtggttctgatgaggagcagcaatatgttagcatgcaggtggagcacgtggatgatcaggaaactaaaattgttgataataatgttcatgatactgttcagcactcacctcctgttttgtagccacaagatgaacctattgcacatcgcagaacaaagaggagttatggagctccaatccgtcttattgaggaatgtgatatggtttattatacttttagttgtggtgaacaggtggagaatattcttgagccggctacatacactgaagatgttttttttgcggggatacacttaagatgttgtttcttgtgatcgtgagaagtggatctaagctatgcaggaggagatgcagtctcttgagaagaattacacatgggagcttgtgcacttgccaaaatagaagaaaactgtccgttgtaaatggatcttcaagaaaaaggagggtttatctctcagcgagcctccgagagttaaggcaaggttagtagcaaaaggtttcagtcagattgctggtgttgtttataatgatgtgttctctcgtaaagaatagttcaattcgcacattctctagtattgtttgtatgcatgatcttgagcttgagcagttagatgtgaagacagcattttcacatggagagcttgaggaggaaatatacatggaccagccagaagggttcatagtaccttctaagcaggattatgtttgtaagttgaaaagatccttatatggtttgaaacagtctcctcgtcaatagtataaaaggtttggttcatttatattgtcacatggctttaagagatctgaatttgatagctgtgtgtacattaaatttgttaatggagcacctatatacttgttgttatatgttgatgatatgctgattgctgcccagagcaaggaagaaatcagtacattgaagaaaccaactgagtagtgagtttcatataaaggatcttggtgctgctaagaaaattctagatatggaaatcactagagacagaaattctggtttattatttcttagtcagcaaagttacattaagaatgttcttcagcgttttaacatgcatgatacaaagcctgttagtactcctactgcacttcattttaaatcatcagctttacaatgtgctagtactgatgaggatgtagaatacatgtcaagagttccatattctagtgcggttggttttttgatgtttggcatggtttgctcccgtccagatttatctcatgctatgagtttggttagtagatacatggctaatcctgacaaagaacattggaaagctgttcagtggatttttaggtacgtcagaggcacaactggtacttgcttgaagtttgtcagaactgataaggggcttgttggctatgtggattcagattttaatgccgatttggataagacaaggtcactcacaggttaggtgtttactattggcagttgtgctgtgagttggaaggcaacattgcagcctgttgttgctcagtctaccactaaagtagaatacagggctattactgaagcatataaatattcagtttggctgaaaggattgtttttgctgagctttgtggagttgattcttgcattaacatgttttgcgacagtcaaagtgccatatacctcactaaagatcagatgttttataagaggacaaagcacattgatatcaagtaccattatgttcgtgatgtagtcgcgcaaggtaagcttaaggtatgcaagacaagcactcatgataatcatgcttgtcggtgatataggcctgggggtatgcgaaatacgggggagttaccttcccgtccagccacgaggccctacagcctggccctccccccacacctcggaagacgtagaggcagccagggggcctcggggtgccacgtcacgcccctcgggccctcgcgctacctcgccccgaggccctcgcccagctaccacatggcgaggggagcgagtgcggcggagactcaggctgaaccgccatcaatgcgcggcgccccaaccgtccctcaccgcatttaatgtagtaagggcggacgtgcggtgctgcccgattgacccacgtcaatttggcgtgattagactgtgatcggcctgtcgccagtcacatccgatcggacgggcggccgtgcccccacgttccaccctgtacccggcggagtgggggcaggtatgccccgtcccattgaagcgtcatccagagctccacccacgtgagaaggactgccacaagtcttcattcatttaagagggaatgacagggctgtcccccgtgtcaggcggcgggcagcgctgggccctactcgaggatggacggctgcttagcttccgggcgaaggcacggatcgtggtctggtctaggtagagtgggtccccctcccgtgaaagagtaggtagaggtggtgcatgtggtatccccttgaactataaaaggagaaccttgcccgccgagaaaggggacgactctcagtaagcttagacccgaggagaggaagagcgagagtggtccctggagtttaggaacctttgtaacactcaaccataaatcacacgcaggagtagggtattacgcttgatagcggcccgaacctgtataatcttggcacccgcacgcggtctcaaagatctccaggcggatacacgatctcgacaagcgtgccttttccccccggccgaactcacaaaagggggatctcacgatcacccgctagagaggatccgtcctcgacaatgctgatatgatgacaaagcctgttcctgttgctaagtttgagctttgctcaagctaagttggtagagtggtttagcccaagaggctatttggcaccgaaagtgtttttgtctttgttgtgttcagggtaaaggattgattcatgctgcaagaaggaatttgtctcaaggtgtagtttgctgggttgtgatccaaattcatttgcacttaataaatgcacttaataaaggccagcttctgccggagcgaagtgaaggtacggattgtaatacattttagggtttcacctcatatatatatttacatcttataagccgccatgcggcgttataacctcaccccgatatagtggagatattttgctggctggtgcccgtggttttttctctcctgctttggaatggttttccatgttaaatcttatgttttctatgattgatctatcttttatttgcctatcgtctcctaacgaaaacaaatcgactcatatgatgtgattaacgactatatgcagacaggctaccgcatatatagcagataatgacatatatttcatgcaccaatgagctagttagtagctacgggcttccacaacacattgttacattgctgatccatacatcgatcccaaagctagctagctcaccttcagaaactacaactcctcccggccggactctgttggtgcgagctaggcagcagctcaggctcagcccctttatttattcagatgagcaactacgtacacaacactgctctgcatgtcgatcgccatgatcagtgattttattgaaaggcagctaagctgaaaagccctgtacgccgagaggcatacaaagcagaaaacgctcatggcgacgatcgactcatcgatctacacaagctcagccactgactcgatgatcccttcgaaagagacgctctggttgttagccaggatggccgccatgccgtcgccacccttgtagcagccgccgctctggcagccggagccgcagtagttgccgccgaggccgcagtagccgccggcactgcagcagaagttgttggggcacttgtccccgccggcctgcttgccgcaccgcttctccgggcagcacgcgccgctctggcatccgttgccgcagaactcgctgccgaggccgcagtatccccactggctgcagcacatgttgttggggcagagctcgccgttggcgttgcggccgcacttgatgtcggcgcggcacggcccgttctggcacccggagccgcagtactcggagccgaagccgcagtagccgtactggctgcagcactggttgttggagcaggtggcgccgccgccctggctgccgcagcgctggctggagcagcaggcgccgctctggcaccccgtgccgcagtagtcgcggccgaggccgcagtacccgaactggctgcagcacaggttgtgcgggcagatcatgccgtcgttctgcttcccgcacgtctgcgcgttcgtcgccgcgacggcggcggcggcgaggaccgccgccgccatcgccatggccttcgtcgtcgtcgacgtcatggtcatcgtacgtctcttccttgcagctccgttcttggtactggatagttagcaaaatgtagctcgatgagtgcctgagtggagtagctgagagtgaggcctctttatatatacaggcggcgagagatgagacgatgaaattaatcgatggatagctaccacgtgtaagatcgatcgatgagctgcaggggggccgggttgcacatcacatgcgagcttgactgctcgtgatttcatgtggtatattctacggctgcagcgaggcatatccgttgcgttacgtggcgttcatgcgtgatcaaagtcagacaacgcctacgattgtggatcggatgcaccgagatccatgacaacgtgtttcttgtgtctctttgcatgcatctccatgcaacggtgtcggttttctgcgtgcatgccattcatgagcatatattttattatattaagtctgccagtgtatttatgaaacttcatttgatttcattttatagtagtatagtatagccaactactagcttcaatttatttataactaaactaatagcttattaataaaactaggaagttagcccgcgcattcgcgcgggcgggcatcataggctacggttgagacacttatgagtgcggaatactaatcaaagaatatctggcatgcttcaaaagtataatttctccataaattttcttctcagcattgcttaggtaaaatttctaacctattagttagttgtttcaattatctaacgcaattgttatggcagtagccttttcaatctaagtgaaatgtaagaagcaaaattttctaacttttttctccaattggttagatttactctctaataatatttttctattttatttaatacaactgcaaatataagttcaaaatttgtgatattatgaataatgatagagcattacacctttcatctcaactttgagaaaatttcaatcacccttggtgatatattaagtagttaagactgatgtgggtcctcattctttattaacaataaacacatgaattggatggtatggatttcttcaataagattccgtgctgtgaaacacatctatgaatgtatcatgtagagtatgcggggcttcacgcaccgatcgtaaacacaatcgtacaactaaatatatctaactgtgcatgcatcattatattggaatgtaatgtattacatgcttctatgatttgtttggttactattgatttagtttagctatatatgtttatagagtgacttataatgatataatatatgctggcaattttttttctcgtatttcattgctatttggatgacatgcaaagtgcatgggtcaactgtggatcgtgatgtgcacatgtgaggggagcagaatgtgaaggggactttgcgtttctaatttttagtatacgagtgaaaactaatgattaggtgctttattttttcttagtttgacggtttaaggttttcctcaaaatatatctaattgctgaaaataattgatcgctcgaaaatgattagaaaatagatgtagtaagtgaaaactgatgctaagatgattttcttttaatcttttcttagattttttttctaatttaacgtgagatgtcttaagagttatttagatggtttttaatgtatctttattacatataatgatttaagattatatatgtaacctttttttgttaatcattcactgttatttggttgtcgtataaaggataaggatctgtgatgtaattcatttttatatactatggtaatatagatctggatttatttatttaattataaataatataccagtttaaaccaatcgaatgttatatattagtttccatgcaaattaaggatatggatctataatttattccaaattttgtatagtaaaatatgagtaatatgagtattggattatttagctaccaaattataaattagtagttcaaatgaataaaaaattagatcgattgtttttatattaatgtgttagttagaaaataggaaaaaagagatcaactgaaaagtagagaggtactcaggagaatcgcatatatgcatgcatacgtacggcagtcgacaggaggatacgtacatgcgtttgttttgtttgcagatgtattcaatcggtccactatcaggacaaatagaggaagagcgtgtatatgtttaggtgggctggtgtgggagaggaaaaggacgcgaattgtggagtctttttaaggataaatctaatattctatgggtccaccagtttattttattagattgccacttgtcagtttaggagcgtttataggagaccatgtggtggcttgagagcgtttataggaagtttaatagactttcagtatataatagatgatagatagttacctataaacatatcttaaaacattaatatatggtcccacctcccatacactcataatgtattggagtccgtgctaagctggctgtaaatttatagctcgctttccttctctatcttgtcatctctcctccacatgtgcttacagctgacttgtagcctactattgtactcgctctaaacccatgcaagtaaaatcagtattagagctatccttacaattaatacgtttcttacaaaccgagctaatctagtcttgagttatttccccaactttcggaactcatattcctcgagttccacgcgcatgtttttttaaacggctaaccattgagttttttttaaaaaaactttctatacgaaagttgtttaaaaaaatcatattgatccattttttaaaaaaattagctaataattaattaatcacgcgctaattaatagaccgctttgtttttcgtgcgccgaaaatatgttcccaacactagaaaacaaacacagcctatgagtttatttgttttaaccgtaggaaataggcatatcaaacatcgtaaataactcatataataacctgcatttgtgttttgtgtccggtgcacatcacacgtggtcagttgagcagagaagcctaatgaactgtgaacactcttgtgggtctctcgggatgctacgctgtccaaaggatagagtactgggtgctagctagtggttgccagcagctcggcaatgcgcaacctgccggcaataagcagttgcagcgctgagccatggtgactttggacggatctcaacgtgatccttgatcacttctcggatccatacaatcatgcatcaactcccccataaccccatacatttattgaagaaagtatattttttcccttgaagttcacaaagtgactctaaaaattatttctgactcaaacagttcccatcctcgacggtgttaggtgaaaacaactttaaaactcgttagtacatagatgctttgtcgcctcttatattttctgttcatgaatcacacacaaaaaaaaaatgagtacgtcttattgccttcaaacacaacaaaatcctttcatcaaacttggaccaaatgttgttgcatttctaaggttttatatgtcgagcaaatagtatatattcactatataaatacctattctatctaattacacgtctcctagggctctcataataactataaagatctgggcatcgattagatggactataatataataactgtagatttaatcttatgtgtttccatgaaaaatagtgatcaataaaatccaaacgtgaacatgagagattgatccatatataatataaagtgtaatcacatacatgatacatgcattatgcccacgtacgcgcaccaactacagacgcatacaaccattacaatatatatcaaaaataaaaaagaacaaataattcaaacatgggtaacaaagttccattttgaaattaccaacaaagaaaaaaaactatataggagtagtttatactaatcaaggatagataacatgatattcatccaacatatgtgttctggtgcattgcataccacgtcgcagctccgttttctgtgcatgtaggttaatctgccaacaaagtattctttgctagtagtattaatggtggagcagtccatcttatcaccttactatgtgtttaccgctataaacagtaaccgctatatagtgcctgctacaggagaaaactttgtatggtcttctgtaaacagtattccaaaagatctacaccatcaatttctaaggttgtgtatagatccagaggtaaatttttttaccgtgtcacataggatacatagacacacatttgaagcattaaacgtagtttaataataaaacaaactgctgaatctgcctgtaaactgcgagacgaatttattaaacctaattaatccgtcattagcaaatgtttactgtagcaccacattatcaaatcatgtaactattaggcttaaaagattcatctcgtaatttacacgcaatctgttaattagtttttttttctatatttaatacttcatacatgtccttagcgatactttttatgtcttcactccagtgaaacgctcgctttatggaagaaggtcatgattgacatgtgggccgggcaaacttattcagttttgttttattcacttggctgactggattgcactaggaccaaaaccactagtactttatatggtgtttagcggtaattcaccttgtctaaaaagtttagtggcgaatatcagttaattaaggggttaaattggaatgcaatgcaaaatcactatttagcgactagctagccttgtgtctaggggtggatagcaagccagcttggctcggttcggtaaagctctttaggataacgagctggctcggctcagcttgttatcccaacaagctaaaaacccagctatgtgcttcaacttcgggaattccagtagtacatctcttggatatttgttagatatttatggtcaaagcaactggctccacagggaagatctgtctgaattcactacaacagatgatgtcaaggatctctaaggcaggcaagtgcgagtctggagcaggccactataatggaagcacaaacatgagccttgggcatgagtgcaggtgtatactccatagctttgcaaaggagaccatgtcccaaccaggacttgttcttcctctgctccaaatacaagttgccatcatgagctcagatgctgaaaaggcctccagtgctcggaaggtatccaaaacataatctggggagaagattgtgcctaatttgcagaatctctccgcttgacacatccttagacgagaccttcctgttgctcttgtcaacgttagtctttcagggataactttggagattgaagaattgtcatgcgtttgcaatgactcaacatagtccatcacaaatgctatagcgttgattacctgtggactgactgcattgacataactttctattccctccccaatctccacatgaagatcttgtggcttaagctgtggtgcataaatgccactgtagttagaagtttttcctcaatgttgacatcactatagctatagtaagtcttgatgattgatgacctttgtgaagctgatccgacaatatgttgagtacttgagtgctagaagggcccattatccccttgttttgagttgtatctttgagggcaggagagatgcggcctctcccctctacccgtcggcgcctctccacttccgaacgctgcttgacctctcccatattccccgccccggcgatgatatcctatcgcatctcccctcccactgccaggagctccgcggcagctatgcaaatcgagtggcaagctccacattgggcagagcggtgatggcagcgacatcctctccccttccccatcccacggtgacgagctcggtgcagttgccacatctagcccggtgtgaggcggtgggggcgaagttggagctcggtggtgcatatcgggtcggcgggttgacgagctacttggcggcggcaaggagcgggggctgcagccaacatcgagcgttgagctatttcgcagcggtcaaggagggtttgttcccgttctcctcctccttgctgcttcttccgatccggcgaccttggtggtggatgtgctcagagcggcgtccttgacggtggagcagctgcgcgtggtgagggactaggcatggcgaggggcgggggagctgctttcgaggaccgatctatgatttcatgtactatgctactcccttttctagtttttgcaggcgaggaactcgccccttagttgagggacgagaacctctacaaaggtctaggggcccacaccctctctcccccatggcatcaagtagcctacgtggcgcaatgaatccacgcgacatggtggtgcactgtgaacggcctaaatagaatatacacatgattttgcttgaaattgatcgtttagagacacctagctacagaaagaaaaccatacaaatcttggatgaggttgcctttccacaatgcacaaggtaaagttcaatataagattttaccttacagttaaaattgtcaataattgccgatggctaacaatgaatgactttgggaagagccctaggtttaccatctccatatgttccgttggtgttgacatcgctcttataagccactatatgctctatttgggcttaagaagattccatggtattgtcagtagtcatatacgcgtttcattagtccatctctaggaaataagttttcataagatttcattctatgggattctagaaaaactctccgttccatatatcacacccatttgaagaggatatcttctcatagttagaaaatctagaatactagaccaaagtacaaatattttgcctcctaaacatacacatcacttgctagcagtacctatggaatttcgaccatcgccatccctatggatctactccctccatcccattttaagtgaagccataagtttccatgtctaaatttgattgtccgtcttatttgaaatttttttatgattcgtatttttgttgttattatatgataaaacatgcatagcactttatgcatgacttatgctttttttattttttttaaaaaaaaattcaaagaagatggacaattaaagttggatacgaaaactcatggctgcacttaaaatgagacggaggtagtactatggtaccaatattatgtttggggttcctctccctctgctttggcaaccgggtgatggtgagctcaaacaggccaagaatcctaatttgtgcgtgcgcgctggcagcgcgcactctcggcccatacggcccacgcggcgcgcgcgtgcaattttttcttcgctaaccaccaccattttcttttttttcgctttcttttttttccgtgatttttttcgctttcctttttttttttgcgttttttcctgattactttttaatcttccagcagcaagtgttttcaattttttttgttgaaagatgaattaaaaattttcaaatctcgagttgaaagttttcaaatccgagttgaaagtttttaaatccgagttgaaagttttcaaatttcgagttgaaagttttcaaatccgagttgaaagttttcaaatcttgagttgaaagttttcaaatctgggttgatagttttcaaatctgggttgaaagttttcaaagttgagttgaaagtttttcaaatttgacttaaaaaaatttaaatttcgagttgaaagttttcaaatctaggtttaaaattttgaaactggacttcatatgtagatttctttttaatttgttagttaaaaaaatcttatctactaccatcattatcctaaattgttattatctaatatactagtagattagtataactacttaggccgaaaaaacgagcgtcagccagctagccatgccctagacaggctcggtgttaatggcaaactggttccatttatcaaatctataagagacttatagatacactaattagtgtagctagaagataattcactgagttttgaatatgtgtagctgacaagcgacaagtgaatctcaatcaagcaatcgattgaaatatagctgaaatcctctatatattttcaactcacagtgaatgacagatgggcccctcttatcagtaaaagagaccttatacctagcaacatttttggcctgcagataagcagcagagagaaggaatctttcatgtcgcaccatctatcatcattattgcaaggataagataagtagagaaaaactccaaacgcaatgagagatgagacatgagagattagccacgcttggtccccatgcaaagcacaatcgtccttgcgcgctctaatcatgcatgttactagctatagcctctatcaattaaacaaacaccgatcagaaaagaaaaggggatcatgatatttaaacaaagctagcagctagcagcagtagaaacaagaacaaaaacaaacgtctcgatccaggacaggaatgaaatctatcaatccatcggacatatcattcaggcctgggcatcgatcgatcgactgatcatcctcgtcgtctatctcgttggattcatgctactaatattattcagagctttgctccatcactattctttcagagtttcagacaacagcaggtgatgcagtacagttaattaacgatgtaatagcttaggcatcagtgcagttgtatactccgcagcttttttgcatttcagtatacaagctagtatgcaagacattcttttttgcacttcagtagatatacaagtgcaaacaaatttcgacgtttcttacccttcgtctaccttgttctccagtatagctttgtacttaataacgtactccctccggttctataattcctgatattttgaacaatgatatggtctcccaaatatatcattaactttgtttttattataatatataatgcatgtttacttttcttacaacactttgaatgacaaatctatatatgttgttatagttcctttaaacaaaataattttaaagttattgataatcaaagttacaaaagtttgatctcaatattgtccaaaacgttaagaaatatgaaaccggagcgagtattatacaacccctactacagagtactccaacagggttgtataatctaaaagtaaagtggagatactgagatttaggctctgttcggcaacttgggttgggaacccatgtcccccgcacgaaaaacagagaggtccattagcgcgtaattaattaagtattagctattttttttcaaaaatggatcaatatgattttttaagcaattttcgtatagaaactttttgcaaagaaacacaccatttattagtttgaaaaacacgcgcgcggcaaacgagaaggggagttgggaaccggggcaacaaacaaagccttttattttgcatcacaagttttcgcaaaccacttctattttgcaaacatgccaacactacgtgttggattttaaaatggtttcgcaaccaatttttccacatcgacaaacaagtttggtgtgagtgggatcattggtactaagcccgagagcatggcttccgtggaaccacggggtgaagcatcatcaacatcctacatgagtaatgcaattattgggtagatctgtcggttcgtcacacgaaccgaggccagtcaagttaacatgcacactagcaatgcaattttgcaataagacattttggaaagtagaagcaatatgatcaaatggtaacttacatctgtcctcatctttaaaatctttaaaaatcctcatccaaaataaattctgttgtagtcaactattcgcaaaagagaaaaaccaagcaaactactaaaatgaaaatagtattattaataactactagtccattaggtagatctcaatttagaaaaaaaataaagacttgaacggagtagatcagagttacggataggaaattatgaattttttaatttaaaaataatttctagatttaaaatgggatttatttaaaactggaaaggaacatgtgtcctcaccttagagagggttttttggctttaatgaagatagttttgggcgcaacgtcttgctcatgctgattgtgcagattggatcttgcgaaggttatggtatagttactatcaatctatgtctaagtttccatgttcgaaaatgaatagtaattggcgtcaatcatttggaaacgattatggagcgctcctttttttacaagacatttctgaatgaacatttaaatggaagaacaaaaacgagccccacttgtgcagatggattctaatcactcaggtggatgtccacccgtttattgcatgtcaactaaatgattgaaaaaaattcaaaaaaaattgacaaggtagatttatatgaatagagttgaattcaactgtgagtatatgtatactaattagagttaaaaatttgttatttttgttacaacttgtagaagttgaatttaatgtcgcttgtttgtggcgtgacatattacatatcaatctatcttgtcattttttttgaaatttttgaaaagagggtattttaaggggaactatttaatttgctgatctgcaagaaggaatttgatgtagctagtagctactgaacttgtgttgaagatatgcattggtctttgctcttttgttcttcgcttgagcctggagctaacgaataaagatgaaagctaggaaatgtactcttgccacacacacccaaagaaaaggtgaatccattaacttatcgatgatcaaatggttcagatcagtaacttcttcatcgttagacactgagggcttgttcggatcacaggataggaaaaacataggaataggaaaaacacatgaataatataggattgcatatgcaaaacgtaggattgaaaaacaaaggaatttgatggtaataagcattcggaacactacaagaaacttgttaatccatgacgaattctcggtgacggatttacagatcgtcactgacaaacgtaatccgtgacaatattttgttttttgtcacggatgagcccagtggatattcatggcacactaactcgtgacagttttatcaggactgtcacaatgtatgattttaaattcgtcatactctaggtagcccaaaacaataaaaaaataaaacatatttagcgcaaagaaaaataaaaaatgtgattgcaagaagaatcaaacccaaaatacgatttgttaaatttgaacaaaatagttttgttaatatgttatatgtatatgatgcataatatggcaaactaaaaaaatatggtgcgcatgggtaaaaatctgcaacatgtgggatttgaacccacactaagctgaaggtaggaatgtgtcttaccatttgaaccacttgttctattggtcccaatgtgtacttaaaatatttttatttgccttttatttgtcccaatgtcactcgagttggcccaggatgttgcccatagcgtggcccagcaactcagagttggcgtttcaaaaaggaaaaaagaactcgaattggtaaaatagaagttcaaaaaggaaatattttttaaatattctacgtgatctaaattattctttgaaatttaccgtgaattttcgaagctcaataactaattttaataccacaaagttcatttactctattaaaataaatagaaaacaaattaaaatttctctctctgcacttgggccttttttggctcaagtattaaaatagaaaacaacttttgttttggtcattttgttatatgactttgtttcaataaattgaatttgaatttcaaattatgacaacttcaaacaacattttcaaatactaaatgatttcaactgaaaaagttatcaacaacaaaattgtatagttcattaatatctataacttttattttggtcatttctttatccgacaaagtgatattaatattgttcacaaattttacatatgtctcttatagtttatgaaaccatatgggagatgtgtaaattttgtgaacaatgttactatcactttattggatgaagaaatggctaaaataaaagttatagatattgataagttatacaactttgttgttgatgatattttcagttgaaatcatttagtatttgaaaatgttatttgaagttgtcataatttgaaattggaattcaaattattgaaacaaagtcatatagcaaaatgaccaaaacaaaatttgtaggtattgatgagctatacaactttgttgttgatgactttttcagttaaaatcatttagtatttgaaaatattatttgaagttgtcataatttgaaattgaaattcaaattattgaaacaaagtcatatagcaaaatgaccaaaacaaaagttatagatcttgataagttatacaactttgtttttaataattttttcacataaattcatttaatatgataaaattcgattcaaagttttaatactttgaaatttccaggttaaatgaccattttgtccaagtaacttgtataataggttttcagataccagggttattctagtaaaatcgcatcaaaattgctactcccctcaaccctagccgattccaaatctgagtccaaatctctttccgcaaaccctcgcgctcgcggctctgatccagcgcttgccaacagctgcgtcggcctcggcctcctcggcggcggcggcgacgggcgtgggtggggtggagcctgctgtgacgctcgaccaggtgccgcggtggagcgaccccgaccagcgcctctcctcctccttttcccgcaccgccgccggattcgacgagagccccgcctcgtccttcctctcgttcaccgacgacggcacgaccgatgtggtcgggggccgtggcgtgtcgcggttccccgtcgaccacgagatcaactcgaagatccacccgtggaaccttgaggtcgatttccacccgtggattctagcatgctttcccctactgatctacattctgtacttgtaatttgtatatgtagttcttttctctacaaattgacattcagatcaaaacattgtaacaaacatgcatgctaggaacacttcatttgtgcacttctgctgggagaggcagctaggattatcagtttattaccaaatatagtgcatctaataagacaccatatgaagtaataaattaaacatattgcttatcatttgttgccttctgcttgtacatgtgtttttttaggtaaatctgcttgtacatgtgtagaagcatcacatgatttctgccgtataggaagttaggaactgtctatatactcagtggaacggactattaattagtataccatgctatcatccatgaccaatattctcatctttatggtcatgcatacaaatctatatgtttaagtactatatgcctatatgcctatagtccgtagaaatgaagcatgcataggaagttactcgtatcataactttagtgtctaaatttagtgctatgctcctatgcattctagttcactttcctgtaccactttacttgctctcatattttttttggtttagtctagcgtcagttgcttgtttgcttggccaatgaaatgaggtgggttggggatagggacattgagttctgttagcgcaatatattatggggacacagattggtgttgcaaagtagccctatcattcaaaaactaatatcttgtctgtagattgtttcttgttgtttctctagctcataaaaaaaaatctaacatttggtattgtactatcaggttgctgggctgaaactttgatggagtggccaaaatgctttggtggctgctgggaattgtcatgtgcttttgaacaggttttaattatgttgtatgagatatgctaaaaaaatgttgtatgagatgtgaaggttgtaatgtgtttttagaatatttatgtgccgctgatgatgagagaatgtaaattgatgataggtaattgattttgctaaaattatggatgaaatatttgtattttgctaaatttagcatcagccgaattttagttgggctgaaatattgcagtagcccaatttgaactgggctgaatgataattaaaaggccgtaaaaacaccacaaaaaaacaaagtggcccaaaacaaaaaaaatccagttggtcataaatgggccgaaagctccaggaacccgaattggaccaaaaacacatgggctaaatcntacgtggcatcaatgacacatcattgtccaccttggcgaacatgtggcacatacgtggtgattcgaatccgtgatcctacgtggcagataatctgtgacggaaaaacatcctatgtgtcagctatccgtgacggttatttttcgtcacaggaaatgggcttggctggactaactaggcctcgggctctatcgtgacggtttaaaaccgtcaccgattctgttaatctgtgatggttttcgacaaaccgtcacgcaagtcaatccatgacgctcaatccgtgatgatttctgaaaccatcatagatgttgtttggtgacgatttttcagtgatccgtgacggaaattttccatcacggatcaacaagattcttgtagtggaatacaggaatatataaaccataggaattttctaattaatattgatctcatatattatagtataattatagtataattaagcaataaaatattagttcccatctagtcactccaacgtgattagcatctaccctgtggtagctaatgataaaaatgaagtgtgagtggatgttcagaatcccgtgaaattcttgcattttcacagggttgctacagtattcgtacaaaattcctacgcgtgcttcctatgaaccgaatgcatgaacatagccaaatccaaaggatttgccaatcctaaaaaaaatcctgtgtaatccctccattccgaaaaaaccctgaagttgtaaagaaatttaattactctcaataaggaggtgtttatattcggtcggtcatgtgctttttagtttgagaggatgttggattgaaaattatcaaatactactcctttcatttaatttaaatgtagagggaaaaacattttccgcacaaaacgtttacacatatctgttaaaaaaaaagctcttgcttttataatagtaggtagttcattattctcacttggtaatacgatataaattcttgagaagcaccattagagcgaactaggaaggtaggcaggtagcccgcacattcgcacgggcatgtaccgtatgtaggatagatttgagaaacttataagggtggtatactagcgaaccaatacctgcaacgattcaaaattgtgattttttcatgaattttcttcattaccattgcatgacaaatttaattggtatttataaaataacatactggaaattggggttggtaacttatggtatctaaatggtacctaagacacataactcttgaagttccataagaaaagagagaaaacttaagttataaaagacattacatatagaaccatatataattaatagctctaccgatttatgtagaaaaatcgacaattaatttattatttgatggataattcctcataggaaattatgaatatgtgtaaagtatagggatacaaattagagaaaatagtggaagttacgaaaaaaaatctgacctttggatatttagatgatctaatatattgtgcacattccaactaaccaatattcgccttccctcaccacagatggtggacatgccaattcgtgcctctagtagcatgctcgcatcattatatcgagaagacaaaaaagtgtcttgcatgtataggcataatatatgtaactatctcatgcccctcttttcatccaagaaaaaaattatatacccagcatgcatgtacactgggatgcacctggctagccccccaatttgtttactccatggatctaatgattagataatttaataaaaaacatacaattaagtatctgaaataaatttttattagtacaatatccataaggacaccccctgtagaccccccctcttcccttcttcttttcttggtgaattatttaatttaatgtccaacttccatggtattaaggtttcccaaccatcagcaccgaacatagcctaagattgttcatttacccataaaaaatcatatctttatgaaagcataaagcatcaggattaagtaaatagcctccacatacatgttgagagatataattaagttggttgagagtcaataggtccattgatgctataattatggttaacacggtttataggtatgggtccattgattttattaaaacaaataaggtggatattttgacttttagtgagatttttttaggatttctttaagtatacaatggttcaaacagatcataaattgaatatataatttaatattcacaactaatgaagattctttatttatttataaaacataccaagatcaacatgcatgagggatattatcttgtccatatttgcaagtgcatgcagtctttggagtgcgatgaaattaagttagtaatatagaagatattagatacccgtaagcctttacttaatttccatagagaaaaaagggaacacaacaaggaaaaagcttgcttgcccttttcatgcttgtggatggaaaaatgtccggccgttgggcaaactcgtccggtctgatggtttttaagttctttttttttaaaaataaatgtaccggtttttgatggtaaaaaattttgggtcccccaattaattaaacccaaggtctttttttttccttaaattttttaggatttacctaaagccccccttgtctttttaaaagcgttttaccttatttaagggctttttagtttttattattggatggatggatttatttttttaggctggggaaattaactttgtaatatatacggccattttaaaggtttggtcctttttgggtggtcaaccaaagaaaaatgatctatattcaaagttaggaaagtgtttttcttatatatagatttgatgggttcaccggtttaaaccatccaaatacgtaaactaatagttggtgtacatgtcggagttatacttttttctatgacaaagtctctcgaccccaatatataaacttctagtaagtggggacaactctcttgttaaatttgttccaacgtcgtcggcgcaagtgtggcgccagctttgtggttctggtcatgtctgatccatgcttgcaagggagagtccttctctgccatggaggatgccggaaaccccacaaccgactccaagttggcagtggtgctcttcgtctagagtcacaaaaacggaacgagaacgatgctcctcaaaggcttctcccggcgggtaaagacagagaagtgcggcgaggaatttgtcgactcagtagtatagccccgatcgagagatggttttgacctcagtgcggggggtagaggtgagattgaagttgccgagtactcgctttatttagctgtcgcagcgcccctgtaagttcgaaaaaagctgcctcaacataggcagctatgtgcttaggcggtggggcttataattgtagtaaaaacggtggcgacaccgatcagctgtatgacccactgtagtgcaaatctggcacacagggttctcagtagacttatcagtatcagtgaagtcataagtattggtacgcccccctgtctaacttagtagctgacacagcattgttccaagatgcaagaaattattttctttacacttcagtatacaagcgcaaacatattttgacgtttcttacccttcttctaccttgatctctagtaaagcttcatgcttaataatgtactcactctggttccataattcttgacattttcgacaatgatacggtcaccaaaatatatcttttactatgtttttattataatatatagtgcatgtttacttttcttatattactttgaaggacaaatctatatgtgctgttctagttcctttaaagaaaatacttttaaagttattaataatcaaagttacaattgtttgacctcaatcttgtccaaaacgtcaagaaatataaaagcggatggagtattatacaacccctacagccttgctacagagtagtctgacgaggttgtataatctaatagtaaagtagagactctgagatttaggatgagactctctttcttataccaatccttggaatcggtccatatatgcgagtacaaagggtctcgctttatatcgcaagttttcgcaaaccacttttattttgcgaacatgcaaacactacgtgttggattttaaaatggtttcacaacccattttcccgcatcgacaaacaaatttggtgtgagtgggaccattggtactacgcctgaaagcgacaaagggttggggttatcaacatcctacagtagtaatgcatatattgggtacatctgttgatttgtcacatgaacaaaggccagtcaaattaacatacgcactagcaatgtaatttcgcaaagaaaccattttggaaagtagaagcaatatgatcacatggtaacttacttctgtcctcatcttcaaaatcttcaaaaatcctcatccaaaataaattccgtcggtgtcaactatgcgcaaaacagaaaaaaccaaataaactcctaaaaagaaaatattattattaatataactactagggccatttggtagatctcaattcagaaaaaataaagacttgaacggagtagatcagagtcatggatagaaaattatgaatttttgaagttaaaaaataatttatagatttgaaaaaggatttatttaaaactggaaaagaacatgtgtcctcaccttagagaggttttttttggctttaatgaagatagtcttgggtatgacgtcttcctcatgctgattgtgcagattggatgttgtgaaagttgtgatgtattactatcaatctatgtctagtttccatgttagaatattcaaatggaagaaaaaaaatgagccccacatgtggagatggattttaattacttggatgaatgtccacccggattttacatatcaactaaatgattatgaaaacaattcaaaaaatcgacaaagtagattaatatgaaatatatcactccacagacatcggctcggctcgtttaaaagcttgagctagctcgttaagctcgcaagccaaaccatccaaaaaagctaccattattgcccctagctctcaggaacaaccaacatcaagcatgcataatgatagtatgataaattgttacatgaaaatatcaaagcaacaaatcacattcacatataagtaatctaccaaaagtctaggattaaacacatttcacaagtacataaaccacagtcacaataacacatactgagttactgacatacatcatcagttcatcacatattgacatcacattatcacatattcatagtccacagtccacactcacaagttacaagacataggcagccacatgcacacagtccaaactcgcaattaactttgaaatagttcaacaaaagattgtaattaaacataggtttagtccagtacaaatgtacaataatccatacttcaagttcaatagttcaatacaccaatatttagcataagtgcgtaactagtaaagctgcagcctgcaaggttcatcattttcatccaacacaattgcacataaacacaaaacacaaatagcctggcagctccctttccctcatagtcccacactccctttctcccatagggtgtaggcttgtagcctgcaggtaaacagattgtagagtatgatataaatgggtgaaagtcagaaacttattagatgaatataaattgtccttactagttgcttgccaccacacaattggggaagtccactatttcgatgccatcatctccattttttccctgtcaaaacagtccaaagtgaacaatttatataaaagacttgacacaaataaagaagcaaaaataatcattacattacataccacactattgtcattttgagaggctcttatccagcttgaagcacaaaccaaagcctgaactgcttctggcttcaaagaactccggtagtcatcaagaattcttcccctagtgctaaaagtggactctgatgacaaactgctagctggaacagccaagaacctctttgccatgttggacacaacaggaaacctttggtcatttaccttccaataattgagtaagttgaaagtgctatcatcgagggacacatttggttcatctagatagatgactaactcagactttgaggattctttagcatttgactgcaaaaaggactagaatcgacttggaataattgaagccaatgaggtggttgtagagcttgaggatgaggccgagcgaccattgtgtgggctgttcccaccttggttgtggcgacatgtcacctcataatttttgcagagtttttccatctcatcaactatggcagcaacctctgttacacaccttgtctcatgaaaaagttcactgaagcaccatttgatgtacctcatttagaacctagggtcaaggattgtagcaatggtgatgatattgtttgtgttctcccaatatttattgaatttttcaaacattgcattagccatagtcaccagcaatacaacattaggatcaggttcataatgtccagactgttgccgtaaccttgcagcttctaacagtgcagattatgcttgtgctctagatgctaatattgcaatcttaactttagctatgtatggatagaaaatattggcagtggggtaggttgatagtggggtaggttgatcctgaaaatgcagtggttgcactagacattgttcctaagattagctgaattttctcaaacaaatcccattcagattgtataggtagccactcatatttggtgtctgattcagcataataatgaaaagcatttctatactcaatgcatgtctgtagcatccgataggtcgaactccaacttgttttaacatcaatagacaaccctctaccaactttaattgagtaagtgttgcacacacccacaaatttatacatacaggctagagacttcttaaagtacttcacaatattcctaatattggtaccaaaggttgaattggttgcaggccatcattaacaaccaaattgactatgtgggcagcacaacgaacatggaaataatctggatcaaactgagcattctttctggtagcaagcttagacatcaaatttgaaacagtggtgtcattgtttgaagcattatcaagggttattgtcatgaccttatcctctattttcaattcaaccaagcaatcaaaaatagcctgagctatgacaatagcggtgtgaggaggctccacctcaacaaagtttaggacacggcatagcaaaacccaatgaacatctatgtaatgagccaccaaacacatatactgaaggttttgatttaatgtccacatatatctgtagttaaacttatggtctcagcctccctaagacttttcctgagatgttccttttcagattcatacaatttcatgcattcatttttatggccttgcgactagtgaattcatagcgaggattcatccacttcatcaaggcattaaaccctttatgctcaacaattctaaatgggtaatcatgttgaattatcataagggcaatcaaaagtttagtgtgatcatgatcatactcagtaggatgcaaaaccatagaaccatcagctaaaggaaaataaagtgtaccttgagctttagcctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49253 - DNA, 726 bp, Oryza sativa
ctgtttcctgggactggtatcgattaacaggttaatttggagcgtcacgggctagttccgctcggggctagttcggggcgtgacaatatgtgtctgcatagtctccaatattatactttgtctaagttttaaacaaactttataatttgatcattattttttataatatattatcaatagtgtgaaatatcatatgaattgtccaattagattttgtatctattgaatttgtgttgtatccgctttacgcgatgtgttacttacgtgtgtgggaatggaggccatcgctcggtcgcacttacaaataaaaaataattgatgtgacgaacggaaagttgcaaattttttaattaactagttaagaagttggattcaacggtacgtaccgtgttcagaaaatggaagcgtgtccataaaaatctaatagagctagtgattaaaaagaacgaggcgaaacttataccctagcactatactgtacgttttgccccttaattaatagaactgaggtacaaacgagggtcagtgtgcaaggtcggaaatgatcctcgcgtgacttcgtcaagtcttcagttcctaattataacatcgggcaaaagttaagagatcgattaggacagtgtgacatcacggcccaatttgaattagaaatgtgtggtacatgcatgtaagctgtgtatgtatgtttcataccacattgctagtttagtaaaagtggaatcaact

SEQ ID NO: 49254 - DNA, 725 bp, Oryza sativa
ctttttaatatatgtcatctaccaaatataatctaatatttttccggaaaatgttttaatcttttctctcaattataaatcatttgtaaattgtttaattaatttggaatagtcttttctttaataggtttaattggaatttaatcttgtaaaatttgtaattaattcatatgaaatcggaatgaggtcgttcaagtctctaaattcatctaaaatcatgatctacatgtttgtttactttatatgtactgtttatttggagtttcttagtctttttcctcgttttgcatgttagcttgtcgtttccgtcgtttcgaaggttcgtgagtgcgtcggaagtattcaagaagattaattgaagaccctttattgcaaggcaagtcacagatcccaaacataattcctttgagcatgttgatcctacatttaaattctctatttattttaattgtgcatttattttcgaatgtcaccgggtggtgagcctttcccatttaattatggccgaagatgactttatttacctatgggttataatttgattagctagaaccttatatattggtttggttcagctagatgcttataatagatgcttagccgtgcttagaaacaatagctcactaatgggataaatcatgcttcactatcacttatggatatttaatggaagctcacgatggttaatcgtgattggttaattaattaatatgccaactaaaact

SEQ ID NO: 49255 - DNA, 754 bp, Oryza sativa
  unsure (1)..(754): unsure at all n locations
atatcaatcctctgtagccccgattgctgcagtacagcacccgcacgatctccagctacacatccatctgcgcacccttacgttggtatactccaccagctcagatcgccggcattgcacctgatcagaagccaagcctccataactgcaggaatcaagcagcaataaaatccggttaaaacacaagaatccaanntttgncccccatcactgcataggaacagtgatcgatactctgcaaacagagctactctcgttctccaaaccgggcgaaatgcttcaggcacctaacaatttggccaagttaagcaccgcgaagacttgggtgacccgagttggagacttggagtcaacaaagcaaaattatcttttctttagcaaaaagaggataagaaaagaatataaacatgataccggtttccttaataaatctggaaattacctttggaatatccctgaagagtgagggaacgagcggtagcactaacctgctagaaaaatccatgtagctattgccggagattatggagggaatcgcctgtattcctccgccccgcccacccattcttctccggcgacggcggcgggggtcgcactcgcagcggtttccccacccgtccagactatggtgggcccaaacctaattttatcttggaataagttcactttgtgaccctgaaaaagtgatcgaaatctaatccgtgaccctaaaccacgaaaccggatatctcgacccccaactctcaaaaccggt

SEQ ID NO: 49256 - DNA, 1250 bp, Oryza sativa
ttctggcacatgcatgaccagctggcaatgacacaacgggagagagcaaggagggcaccttagcttagtgctggccagcctagccctagaggtggctagtcctgctccatcatcggctcgtgcgatgacaacggtggtcatccaccatcgtccccatcattgtcgccgcgtcctcccctgcgttggctaaggctcgagctcttaccgtctcgagctcggcacagaggacagtttcagcgatgcggtcagtaggctagtggtgcgataatggggaagcaacatcccacggcggtgctcaagtgatcgattaccctctgccgctggcctactaggttctacaatattatttttatttaagctaatcataacatgtgggttctgttgagttcttttatttatttttctaatcatattctctcatagacatatagcacgatgaacaatgtcacatagacgccaaatttatagtgaggtaggcagttaaattaatagctacgtggctctcaacggaaagtaagtacggcagacagaaggtgccacatagacgccaaatttatagtgaggtaggcacttaaattaatatctacgtgactctccacggaaagtatgatagacagcaggtgtgacaaccatgtccatcatcccttctatccccacgtttacttacatagatctcttggtagaccagggatgaactggacaccaattgatagatttttatttagtttaagcttagttaattaattcataggaatcccctctagtttaagcctaccatttgtatggtagaatcatgtttgtagatatacacatctattattcgatatccttgaaatactgttaggtggagtgttgcagcggtattcatacacttggatttattggtaactgtaacaaataccaataataaccaactacaaaacccagacatgggtatcctaatatgtttcactctaatatttcacctcaaaacaatattactcagacacatgtttaatttttttttgcggggcagacacatgtttaattaaaaccaatttacactattttggtgtcatgtagagctttctatgattatatacttacgtatttatatggagagatataatatgctagctaagctaatatctatcgataaaggtcaaaagaagaacgatctgcttctttaggagtagtgtatcggccatcaggtcaggatgcaaccaatcccattctagcctaacatgtgtagaactgcatatcaatcaacc

SEQ ID NO: 49257 - DNA, 1563 bp, Oryza sativa
  unsure (1)..(1563): unsure at all n locations
aaagtgaaaaccagagttatagatttttttttaaaaaaagtggaatctagtttgatttaatttttttcaatttggctgtttattgagcggtttgtcaacccaagtaggctcgaaatctcaaaaatttgtgaaaaccaagcggtttgttactcaagctggtttgaaacctcaatatttcgtgaaaaccgaatggtttttgtcagttttatggaaccttgagggcaacaagcatgtatttgtacatatacaaatgttttgcagatttagcacatccaccaaaaatattattgtcgtatacaaatatatgtatagaacgatatgacagcaataaattatacaagatataaagtcatttaatgtttcttaaggaagttatgtcatttaatgttggaacatatatctaaaactacaacaataatatgtaaatggaaaaaacaataaaatgtgtaaagatttgggatgtttaatctatctaaaactacaacaataatatgtaaatggaacaaaaacaataaattgtgcaggagatggcataaatgcaagaaaccatcagtacatctccaagattaagttggttgtgcatatatataaacatgagcagagggccatggcaacgagcacagtgaacttgaagagtggaaaatcataaatacatataggaggagaacttaattatcttcttaataatggcagttgcaaggaggatggtgtcctccatctctgtggttttcttcatgcttcttctgatcgtggcagattccaccttctcatcctgctatgcattaacacgtatgcagcaaagctattaattttactctgcattttttaaaaaatatccaaactacactgaatatgttttctctgtataatttgaggggttcatgatatgcctttttcccccctcttttaatttagtttgcaattagtggctcatgaatcatggatggttgaactgaattgcgtttttgcagctagacaaacgtgcaatgacctaggagatttagcgtgcactgacgagacgtgcaagaagatatacggagacagattagaatactactgcaagccaggcgtcacccctacggtatgctgctgtatgaacgtcacagcatcagttcccagtggtgtcaagaatcaaaacggcgatacgcttcttaattagttataattgatcatgttccatgtaaagttcgtcgatatgtttggagtttggtgccaactcaataaataaacatgcatacataatttgggtttgttaataaaccggttactgaattggctttgnnnnnnagtgttgcacaaagtgttcccctccagttaactactccatgattgcgtactagaggcagcagagaagagctttccaatgcaatctgaaacgtacgtgttcttttgccttgttgcttccgacgtacgttacgtgacatgttcaatgtctgaatctccagcaattcagcatgaaacacagcccgttctcgttcatgtagcaacgaagnnnnnnnnnnnnnnnnnnnnnnnnnnnnnnnnnnnnnnnnnnnnnnnnnnnnnnnnnnnnnnnnnnnnnnn

SEQ ID NO: 49258 - DNA, 724 bp, Oryza sativa
gaaaccgataccgtgttggttaaggttgctatcttgtaatcctgccccccatcctatataagggggcaggaggccctctagggggcatgagacaactagatcgtcagatctatattacacccggtggattcaaatctccaaacaggagtagggtattacctctcatcgagagggcctgaacctgtctaaatcctttgtctctgcatccatccacttttaggtctcgtgtgctacccctttttattattgccgaaatcatgtttcgacagttggcgcgccaggtaggggtgcgtcgagttatctacgagaagtgagatggaaccaattagaaggcgccgaatcagattcaatctagcaaggaaaatcaacctcagcaagttggatcactccaatctccgacgtcaccaatggtggtgaatcctcaagatgcagctcgccaagatgccggctggagctgctatacagtccgtagccaaaaaaaaatcatctgtatccaagagatcatcggccacgtctccagctaccagcctgcaaaaccctgcttgatcgtactgctctgcatggaggtcggccacgggagtcaccactgctatctggacaggcatgctggagcgatggatgttcacacgcaccggatagcaatcgagcctccgatccagtcgtcgtcgtcatcgccgttttctgttatgctcggtgagattattgctgagatcaaactggacgc

SEQ ID NO: 49259 - DNA, 4554 bp, Oryza sativa
tgatcaaactcttgttagatgcctggcctgcccattggcttgtgcataatatggcgaataattcaataacttaattacccatgctatgggcaaaccgaacaaactcataggacacaaagatcgagccttggttcgttgtaatagttgaggaataccaaagcgattaattatatgcttttgaacaaattggatagcatccccagaatcaactttcttcaaaggaatcgcctctacccacttattaaattaatcggttgccaccaatataaacttgtgtcctttgctcgatggtggattaatcataccgatcatatcaattccccaacctctgaatgccatggcttgatgatagggttcatagccgatgctggtgccctttgaattgctccaaacttttgacaatcttgacatcccttgtaatatttgaaacaatcctcgaacatcgtcggccaaaaataccctgcacgccgaagcaaccacttcatcttatgagccgattgatgagttccacaaattccttcatgtacctcgccgattgcaaccttagcttgatcggcactcaaacatttaagcaataccccatcaatcgtccgataataaagctcatcatccaacaaggtatacttcaaagccttatagcgcaatttctgagaagccgattgagatggattctgcaaataatgatgcacatcataccttccaatcatcggctgttaatgtggcaatttctactttgacatccttgttcatcggcttatatcccgatgccccttgggccaaatcattagcctcaacattctgttctcgagatacatgctttaaagtcaccagccgaaatcctttcattaactctcggcacttttcattgaaaccattaatgtatcatttttgcactcgtattctcccgccaattgactgatcgctagcaaagaatcacccataatctcaacccttcgagaaccgcttcatactcagcctgattgttggtcgcatagggtgtaatagtgtaagcaaactcgaaacttgccccctaaggggaaattataaccccgccgataccacaatcatgagtgcatactgacccatcgaaaaacaaagtgcagggcacaatctcaaccgagccgatggagtcatcacgatgatcaacaataaaatatgctatagcctgccccttgatcgccttcggtgactcataccaaagatcaaattccgttaaagaaaatattcactttccaacccttcctttcaaaatcggagccgataacatgtatttaaccacatcggccttgcatattacagggcattcattggacaatagataatgtcttaacctcgtataggaaaaatacaagcacaagcacaacttctccacaggagaatatcttgtttccgcatccaagagccgacgacttaaatagaacaccactctttctttccccttgagctcttgaatcaagaccgagccgattgacttctcaccggccgatagatatagtcaaaactggaggagagctaagatattctttaatactatccaaagccttctgctgctctgccccccaagtaaattttagatcggctttcaaccgcaacaatggtgtaaaaggttctaatcttccaaacaaattagagataaaccttctaacaaaatttatcttgccgatcatctcctgtaattctgtcttgtcttccggaggttgaatcttcttaatcgcattaatgctcctctgagttatttcaatccccctctcatgaacaagaaatcccaaaaactggccaaccgatacgccaaaagcacactttgtcggattcatcttcaggccatacttcctaatcctctcaaaaaccttcatcaaatcggctatgtggtcctctattttcatggacttaacaaccacatcatcaatatagacttcaaccaaccagccgattagatcatggtatatataattcatagcccgttgatatgtagctccagcacttttcaggccgaaagtcattacaacccactcaaacaagccgattgcaccaggacacctgaaagctgtcttatgaatatcttcttcggccataaagatctgattgtagcctgcattaccatccataaaatttaatatcttgtgccctgaagcagcatcaaccaactgatcggctactggcattggatactcatcctttggggtagctttgttcaagtcccggaaatcaatgcacacactgactttgccgttcttcttgataattggaactatattggaaacccactcagcatatcagcagggacgaataaaaccagcatcatataaacgtttaacctcagccttaacaggttcgagcatattggctttgcatcttctcggtggctgcaggtacggtctaaccccctgtttgataggtagccgatgttcaacaattgatcagctgagtcctggcatctcataatactccgaagcaaaacaatctctatattctttcaagagctctatcaacttggttctaaatttcggagataaattcttactgataaatgttggccttggcctatcacccggacttatatcaacttcttctaaatcatcggccgacatgaaaccctgtccttgcttgtcatcgagatcatctactgtgtccttggtgtagacgtttgaaccctccacgacgccctcaaaataacaacttgggttctccatctttaattggctgtatatcacaatcggacacctttagaaaatctcctccccaaacctttctagacaagcaatcaataccgtccatctcctaaagagctaaatcggcactggcaacgttaactgacctgtcggctggcacgatctcaatcttgtcgccttgccattgaatcaagcattgatgcatggttgaaagaatataacaattagcatgaatcaaactccttccaagcaacaagttgtaggagcccttcccatcgatgacaaaaaatgttgtagggacggttttgctgccgactgtcagctacacattcaaaactccttttgtttccgatggattgccaccaaagtctttgagaaccatattcatcttgatgagatcttcagtatttctgcctagcttactgaatgtagcatatggcatcaaattcacagcagctccaccatcaaccatcatcttggacatcggcttcccattgacatagccgttattaatgtataatggcataagatgccgattctctgtcccttccggcttctcaaaaactgcttgttctggtgacaaccaacctagccgaagcttcctcaacttcatcaacaccggcttgtttggctccgaattccgcaggtaacgtgaaaaccatgttaaccgatgcagtcacaacactcttccccttagccaatctttttgcttcattggctttgggttcatcggctacagcagctagattcttaacacgccactcctacctcggctttgtcttctgcagccgatggttgatctcttgctcaacctcctgaaagtgctccctgttcctcaacctttgaacccttctcttctgattctttgtaaaaatactagaaggacaccattgagttttcctgccctcatcgtcctcttggtcacgatcttggttcactgggcccaatctttgatgaacaggaacccttgtttgcctcagccgattgcttctattgtaagattggctcgaactttctacaatattgctgccccaggacaatcttcgatagatggcagcctcataccttcattccagcaaaatctgaaaaattcacaactccagtgggggtcaaagctatcatcatcttcataaaatttctcttcatgccgatcatgtctcttctgatatttgttgataatccttgcagaattgagttgcttggaccgataatccttcttatcggctgtcttcccagttgtatgaaccatgtttacttgaaaaggattacgctcaattttcatcagcctcttggagttatcaaacttgatcttaccatcttgtatagccaactagatttgttgtcagaacagcttgcactcattagtagtatgagatccagtattatgccatttgcagtatttccttttgcctagttcctcagccgatggaataacatgatttgcaggcaattgaatttgtttctcccgaagtagcatatcaaagattttatctgccttggtgatatcaaaatcatatttctcctccttggaagatggcttcacccacagacatgtagtaaccttttgtttctgatccattcggctgctgctacttcggactcatcttcataatcggaatcagaagcataattgtaagaataaacactattcatctttttgacaatcttcttagcttcctaaaaccgttgttcatgcactccaactttctgggccagatgagccaagctttcgaagtcctgagccgaaaaattttctctgatcggatgcaataaaccctggaaagccagatcggctaattgagaatctgaaaaggacaaactatagcatctgttcctcatatctctgaatctctgaatatagtcttgaatagattcatcatgcttc

SEQ ID NO: 49260 - DNA, 1833 bp, Oryza sativa
caattattagtagaatgagacccagagttatgccacttgcaataccttctcttgcccaattcttcagacgatggtatgatgtgaccagcaggaagtttaatctgtttttcccgaagtaacggatcaaaaatcttatcagccttggtaatatcaaagtcatacatctcttcttttccagaactctttacccactggtatggtataaccttcttgcttctgatccactcggcagctgctacttcggaatcatcatcatcatcggatccatacatgtaaggatagacatgattgatctttttgaagtttttcttggcttctgcaaacctctgttcatgtagagttaccttctatacaagatgtgacaaactatcaaactcctgggataagaatttctccttgattagagctatcagaccttgaaaagccaaatcggctaactaggcatcagtcaaactcaaattgtagcacctattcctcatctctctgaatctctgaatataatcctgcacaggttcatcatgcctttgtctaatcgctgttagatcagacaatttcatctcatgaactctactatagaagtaactatggaattgcttctccaaatcggcccaactgttgattgaattgtatggtaaagaagaaaaccaagtaaaagctgatctggacaaagacaaaggatgaacctgaccctcaaggcgtcaacagccgatgcctcaccacactgagctaagaatcggctgacatgttcataagttgagacattgtcttgccttgagaattttgaaaaatctggaactttatattggttaggcagctgaaccgtctcaaaccactcagggtatggatgccgatataagtttctagtgtccttcggcttaagcccgaattgctccctcatcacatctgcgatcaagtcgacccatggtctctgctgaggcaccccctacgcttgttgtggtacgggcttgaattgattgtattgaggagcaaactgaggctgagccgatcccccttgctgatactaaacctgtggcgatggagactgatattggtaattcaaattgcccccttgataattctgaaagtttggctgtatgttgcgcaccaaatgttcgggaataacttgagctatcaccgattgatctggttgcacattatgaagaacttgagttacgacgtgctgcctcggctgattatcaggcgtcctgaacctagccgatgcatttagcgaactttgctgctgaatcggctgactaatctgctgccttagtggcgtctgctgaatcggctgttgttgtactaggtcgacagtaggctgagttggtaaaaacatagcagcaacctgttcctgagttagccgattaatattttgtcctgcatgcgcggctgctctcttgtcaacaatcgaggattggtcagttgccttgacgccgatgatggtgcagcaagtacaagcgccgataccggtgctgtcggctgagctggtggcatattggaggtactcggctgactgtttgggaccaagggccgatagtttgggaaaataacccctggtaaatagactggtcctgtggcctgatactcagctattgaaccatcaactattgacttcaccatgtttgataaggtattgactaatactccagattgattgatcaaagcatgttgcacggcgtaatcaatccgattttggaaattattaaactgtagttgtgttatattgccatctggactgagatcctcaacttgcaccccctgagagccgtcacctttatctcctgagccctctgcagcgcctttaccgcatgattcagttgtaccggccggaacttg

SEQ ID NO: 49261 - DNA, 2200 bp, Oryza sativa
ccttcttttgttccggtgttagtttgtctatagtgacagaaacgatgtttccctcatggacttcaaacccactaggctttgggatattagtcttggaagggacctccgacttgccacccgaagacggtgacggtggtggtttttcagccatgagagaatgttgttgcaactctaacttctaatcagtcccactgggcgtgccaaaagcgtgttaatgtaaaaacacgaggcctgggagatctacttaactccagtgcaggtccaaaagcttgcctttaggtgtatgagcgtgccagttgatttgatcctgcaatcaacaagaaataaagacaaagaaaccgcggttaaatccataaacgatagccgatcggctagttgccgatgacgtatcatttatctttgagccgatgtcatgtgtagatcgatcggcagtcatgaatacgtaagaaagaactaaatctactcaatcggctgtagatattaacaatatataatccttatgtcgatatatacttaaatcaagtgattgggatagatcgatcgccatgccgagacagtataaatcacttaggtcaaaatatatactaataacaacactatatatgttcatagcatagcagatcagatagatctagtatgtatcggctaatactctgataccaatctatattaagatattagagcaagcagaatataccaaacgaaagcctaatatacttaaatgcaacacgatcttaacataaagggcagatttaacatgtcaatcgataatataaggaaaaagtagttaaatcaggtaagatcggctgaaaccctgatactaccctaatcggcaaccaaaagcaggctagagattgagattctaatcacgactcataagatcaaactcaactgatgcagctataagtatgaaaagaagaacaatatctagacaatcaagccgttggatgtttcatagagtggtagatatcctatataatctaagtcaacatcgatatttaacctaatcggatgccttctagtaactaacagccgattggcggttagataacgatattgccagagattatataagatatatgataactcgacaaattacataaacaagattagagtgacatcaagatggaagcactaatcccgaaaacgcaagccgccataacaagttttacctctagttgaagatcgaaacagatgcagctcaacccgaaagcaagaacttgtcgaaacaaaacaaaagtaagagggtggcgatgcgctgagattacatggggctcggggtctatttatacccgagattagaaaatatgtccatgtcggacacgactcttatctctaataaactctaagataccataagtctttgcggcagacttttgcccaaacatatctctaaggaaatacatgaaatatcctaattaatagatacaattgacttctcaggactatatccatacgtggcaatcctcatgaagcacatcaactcaacccgacaacgtatgccgtgtcatattgtcagattcggttcaatcggctaaccttgtccaactcagactctgccgatcctggttgcagccgattcggacttcagccgatcccttctctgtttccggagcgatctccatctcgaattcctctttgatcccatcttcatctccgatactttgattaccaaatttggtcgttaacagtaatgcatcacaatctccggtcagcaacaacaacaacaatgcatcacagatcaacaacaacaaccacaagtcttgggtcaacaacgatccaatccatcacaaatcaaagatcaacagaagcaagatgcacgtactcactccgccgtccttccttggtcccttggtcacacgccatcgtcgtcgccgccgccgccgccaccaccgtacgtcgccgtcaacccaccaccccaaccagatttgggcgccattggtgggaggccgacagagaaggagaggaggagggagacaggatctgcgccccgtctcccgcgaggaggccgccaaccaccttccttggccaccgctgccaccgcacatcgccgccaccaacccaccaccctgaccaccccctccccagatctggctgcttccgatgaggccgacggagagggagaggaagaggggaccggatctgcgcctccccattcgccatggggaggcccccggtcaccccggccgctacttgccgg

SEQ ID NO: 49262 - DNA, 5589 bp, Oryza sativa
cgctctctcgcgcggataaggaggagaaccagacacacgcgtggataaggagatgaggccggctcagctcggtttggtatgggtgccgttttttaattaactagtacctatcatatattataagtgtcggttcttcttaaaaaaacgggtacatatagtattggtactggtttttcctaatgaactggcacctattatccttaaaggtatcggttgtatatttttttgatgtgcggatgtgggaaaagtcccataggtgccggttataaatgaaccggcacctatatggctgatctctattagggttttttagtagtggaaaaaccaatatccaactgtgagtcagacttacatgtagtcaaattttacaaaatactgatagtatctaactgacattacgaatggtgtaatgttatttctttagtttaacaaagctgcaatataatggtatagatccaattaacccgttaaaatagtggacatataatatactagaatgatatgcgcggcgtgtcgccgcgcacaatgggagatgcttaaacttgttatgaagtataatgtttgaataacttgtagagacgaaatacatatttatcgtgggtaacccagagtttattatcgtatttgcgttgaaacattcagttatgctgtatatatcacagttaaatactaactcaaattttatcgatttcctttcggaattaattaccaagaacagaatcctgtacatgacaaacaattggctctctcctctagtcctaccacatctcttgctcccaagtcccaatttgtcctcttcctgaatcagacaagtttatgtaattgtgttcagtaattatgcatactccacagtaaagatccttgccttgaggcttcagcagcagctggcttacagaaacaacacagatcccaagagaaaatcagtacctcaaaaattcagagaagaagcaagagaataagacttcatcacttgggtagcctttaaaagactgcttccagcctctttcggaagcaatgcaggtaaattcagcttatatagttgccaaataatatgattgggatgtatggcaatgaatccttcatgaagaggcttatggaaaccgaaataaatgcaacaacagatggaatcaactgagtaaacaaaaaattgagaagtcagtcatcccttgaggaaaaaaattgaatatcaaattggattaatcaaataatggatctgaaaaacttcggtaaaaaaaaaaagatgtgaacaaacctttgctttaatattcagcaggaaaagagtaatctcttgatcacgtaaaaaattgcttgatgcccaccagaaatcccgaaagaactctatagaaccccgaaagaactctatagatcccagaaagaggcgtgcatctgcagaatcaaatattttttcattgtcaagattcattcatgaagaacaagtcataaaagtaattcattcatgaagagcaagatacaaaagcaatttcttcgtgaagatcctatattgaaaaaaatcacagaagttatttgattcattctgaacaagctagataacctcataacccatgtttcatcatataggttactgatcatatcagaaggcaaaatgggagttagagccatcatttcgtattatcaattaatctatactaatttcaaagaacttaagcatggagaagcaaatgaatcatgtatttattggttaaatagaagggaacatgcgcggcgccacgccgcgcaaccagtatggtgacatgatgtgctaatctgatgcattgccttacttaaacgtttttttttcaaatctctggatcatctttgcaaaatgagacagcgagtcaggtatcaataatcacctacagtggcattgatggtatcagctgatacaatctacaagtagggcattgcaaatggtggggaggtagggttacatatagatttcgactgttttcatcagcaggattgcaggaccaagcatgctcagaatttccagtgaaggaggcccttagccatggtgccaacaggttcttcttcgctctaatttcgccttgctcacctaattgcttgttcaatacaactgtaacatgttcatacaccaaagcggaacattcctccgatgatccgatctttcaattttgcaataaaatacttacattgattataaaattagcactgaaaacaaaaattaaaaagtagtaaataggtgatagcaaaaatataatttcaaaactggagggggaaatgcaatcggttacccccatcagaattcttctccaagacaatgccatctttagacacttgatgcatatcccattgatgagaaacaaatgaggtaactttatttaggagggatggcctgtcatgtccagttgatacttgcaagattgcgtaaaatatcaacagtgccccagggagaaatatacttggattaatggaagacaacagatacatttgcacatttttgtaagtcactgacaagtttggaaatctttcagtttgtaagtctgactgaaataatccttcatatcaataatagacttaaccagttaacctggtagcaatctagtagtacccatgtcatgcaaacaacctaagatatcatttcaaaaagacgcgatctagtgaaattcaggcacaattctcaaaaacatagaaaaagacaactattgtagtatatagaaagctggagtcaggaatgtgatgtaggacaagctccctaccttataaatgaactcaccaaagcaaaattaatttagttcagtggtttcagatttacctatcaaaatagttgagcaaaggcaactattctgtattcaggttagcaggctaagtatcgtgcataacaaaaatcatacatcgcatattgattcagacagtgcggcatagtcgcagggctcctcaaccacccagcgcgatggccgtgcagtccctgaagcactcataccctgaattagaccctaacgctagcgccctaacaaaaccctatgctgtacctggacatggatcgatgggcaaccagaagatgcgctgctatcgatagcctggcccatggcatggcaacgttctccttgggaaagtggcagcctcacaacaatgcttcatctactatctaactgtctgacgattaggcaacacacgatcgactgttcttttcagtgcccacttctccattgtcatttcgcaatattaacacatcctaccaatgcccaaagtgtgtcatattcttgaactatgaaaaccaaagttaacaaaaaagagaggagggggaaggaggagctgtgagacggcaattttatgaaatttaggcagtgagtagccaatgctgatgagaaggcatgggtgcaatataatcttcatggaaagctatgcaagcaagcatcatattatcgaaaagaatattgtcatgattaatatttgtgatgaacaattagctatgcaaatgatttaatcgatgaattggtttgaaaaaatgtgtggatgttggtgtaagtgcgtgtgactaatgtggatcaggttgtgatttctgtgcccagaaatggttgttttgtctgattgtgtgtaggtgacttgaggtcagccttggtcaatggtgaggaccgggactatgttcaatgaggaacagatgtgtagtgcggtcgagataccatataagaaattgactagagtcaggattcttggaggtcaacttcggtcaacggtggggatcgggactagattcatggaggagttgagatccagaaggtcaaggataccgggtgacgaagttggatacgagatggtatacggtggatggacatcgtgtgggagagatcttcacaacgggcttcacgaggtgtgtgtgcaagtgtcggtgttagcgaaggaaattacgaagaaactggaagaagaaaagatgtgctacagtacacgaggtactgtagcggggatgcatgtacgtgtgctgtacatgtgtgatggcggcaagcggcagtgcctcggctgggatgtgcacgtgggcttgcttgtgttgtagacaggccggcccaggtggtgagttggcggcctgcttggaggaagggtcagcgcgtggaggaataggaaggagaccgagaccgagccggcacaggagcgttcggctgtggttttggagaataaggaaattgagggattaagtcctattgtaaatagtagttctacatctactatgagtaggaggttttttatgtataaatagagagggagggtgaggcctcctaatattggttctagagagactagagttgagagaaagttagggtttcgagtttagtttgagattttggtgaggagtgctgtttgtgcactttgtaaacactagttgatgcaataaagtcaaaaagtttcaatctacatcttcgagtttgtcatctaccggtatttctatgtcccgatggtctaaccgtaggtgtgcacgcggtctgaccggtgggatagcggcagtctgaccgcaggtgttcgggcggtctgaccggcggcaggtgggcggttcgaccagcggcgactagacctcgtcaccgacttcgttcgagaataatctttaattctgtaaaagattttgggtttttggtttttcctaccattcacccctctctggtaggtttgtttggtctcgtatgatcctacaccaccgtggatcagtataatggagccaaagaaaagctcatttgaaactcacaaactctctctatttttcatcacacagtaaaacaatctaaaatacagccgttcctgttcaaagaaagagcaataccatgccttctcaaggaatgcaggtgagtggattttgctctctccatcgagtcaacacaagcagaaagcaggaggggaaaagggggagttggtggtgggggtgaaggatggagtaccgtagcgagcacgaggtcaagctcgaggcggcgaaggtggtctgaatctgatgcactgcgcactccaactcgtcaagggctcgatgctgagcaagcccctcgtcatctcgcaggtgagggaggattgggcggcagcggcgtgatcgaggcaggtgaagtcgtcgccgacggccggcccggtgccggggttggaggaggccatcgtcgttttcgtcgcagccgccgtcagcatcatcatcgtcgtcgcagccaccatcactgttgttgttgttgcagctgccactcgctcccgctcgcctaagccagccgccctcgctctcgctcgtctaagcccgccgccgccgctcgcgatgacggaggcaggaagatcagcatgctgccggccctcccgctcccgccatgccattcctgaggacggaggccgctggatccatgtgccgctaaggctcccgaggacggggggcgatggatccgcatgccgccgtccttcccacttgagcctagcagctccaaaggacagaggccgatggatccgcgagccaccgtcgctcccgaggacaggggggcagatctttgcgccgccgtccttgcccctacactctccccctttccaacggcgtggggtatggaggtggagcggtggagacacgaggacgggcagcagagagcgggggaggacggatgacttcgtcggcggcgggtggagggc

SEQ ID NO: 49263 - DNA, 9558 bp, Oryza sativa
cattcttcgcaaccgtttaccccggattttggaagaagggaaccccccctggtttcaccctccgggcaaccaccgcccttaaccgcctttgccattgccgggaagtgccgccgccaccgcccttcggccgcaggttcggccgggatttgcccccaaaaaagaaaggtgggaaaagaaaagaaaaggaaaaaattgggaagggtttcgggattggggggggggggttagtgtaggacgttttgaagaaaagcccctatatttttttatgtttacaacgctacccctataaacggaattttctcttcttcgcattgtatttttctggaagacaagaggttatacataagaaacaaaacaagatgtcagtcggtgcaaggatgtatgcgatattccgtgcaaatatgaggagttttttataaaaagcccagccctcttaccgggagcagcccttccaccctaaccggcaagcatgcataccaccacagcgcccaattttttattaaccggcacaccgcttatgggcggttgcccccgcgcacgcgaggagcaggagggattagcagcaacgtgtaaaacaatgagataccccaataaaaattcaaaaaaatgagaaaaacggtggggttaggggagttattgattgatgatgtgtacagtaggatctctcctagtcacctatagagaacggcccataggtgataactcatttaaaaccgacacctattaatcttttctcacctcccccagatggaaaaaaaatataaatcgacatattggactctcgaggagtgatcctctctagcgggagattgtgagatccccctttgtgagttcggccgggggcagcggatgagatccgagtttttcgagacaaaagagacacaagggatttatacaaattcgggctgctaagaagcgtaataccctactcctgtgctatgctccttgagtgaaggattacaagatctccttgttggagtaaaatgtggtgttgatcatccggggctagagactgctctagagcgtcaaatggatcatcccagatccctccccccttttactaggtctggacctccttttatacctcaaggggttaccacatgggcacaaaaacctagctccggtggagaagtgttttgcattaaatgcctgtcttgtctcttgacttgggaagcaagcgcgcgtcatcttgatgatggggcctgtcaaatcttgccgcctgacacgaggggcgccaatgtcagctgcttttaatgggtgaagacttctgggctcctatttgtcgacccacgattttggaaatcggaaatcttctgtgtttatgagtaccaatccctgaatcagtagttggtacacacataaatagccgaatcacaacatatcacgaatgaattcaggctaaaagagttaaatgcttacattagggccaggcaggccaacaactatcagagaacaatagcggaagacaaaatagtacaagggcccggttgacataccacaagcagtcgactagggaacgagacctagaatggaaccgcactccgatcatcttgttaggtacgcaagcgtacaaacaagggcttctcttcaacactctgctaaaagatatatatatatagagcaacaatgagtacaaaagtactcaggaagccaccacacaaaatgcagtaatgtaagggtattactagagtggctatggttactttgcgtaaagttgagttttcaaatatcatttcacaaacctaagacctagcataaactgatcaagttttagttccattgttcattaaacagggatggttctgtccaccatccattgtgttcccaaggatagcttctcgccactggtcgtcatggttttctggggactacaccttctcgcctctcaaggagttgatccaccagcacaaaatcatcatgcatatcccatcccatatagattaaggaattagagtctagccaagtgtaatacatgtcccggtgctcaataaccgcgagcacgactattcaaatagatgggaatactcacactgcagtggatgtacactttaccccgtattctgtgacttgcccaacacatgagcctacgtcccaaggaatgagacttgccatggcaaagcctttcaataacctactttggcagtacccgctccgtgaactttagtcctcatgcactctaggcgtccaagtttctagcagtgagaggagttctggcgctcccgggagggaaagattcacacatgcgttaagttagggttaagtttagattacacatggcagtcctgccgatggcgacaccactataggcacccgccctttgcggtcctaccaatggctgccccaccgtaggcccctgcctctcacacacatcaagaaatccactacggcttgggtaccgcctccactaggctatttactccgctaggtctatacccacacgagaagtacggttgtactagggtttcatgctcaggatagttcttattcttgataaaatcttgatcaaccatcacctcctggaagctgcatacgttgcctcatgactaaccgatatacaatttccataatacgcgagaagaaccaatattcaaacaacaatcaaatatgcacaaacaaaatagagttgttgaggtcgaacctagggttgctcatactacttgtgtttgctaatggattctaatcaagctaagagctaatgtttcttagtctttctgtggccatagtggttttgtctagctaatggctatggaagaattatggctacacatgcatctatctaaataaaatggtcatatactagaggttctgtcgtcggatggatttaggatcaatcacataattacagtgaatcatttgtattattattttattgatggaggatttactttgattatgaacatattttccttgtcacagtaaattatgaaaggttaataactatccatgctttgcatgttagagttgtttaggttaatcatactatggttacagattatttgtctgtgtggtcccgtaacgattaattacaggaggtcaaaatttataattaggacttatctactattcatgtttgttatatactccccagttgaatatatggaaaagggtaaatcaattgtatagttataatgggatgtacaatatacgtgtgtgcaacgatgtataaggttatggtcgcctacagtacatgagccatttagaaagtgtactacccaatgctccaagtgactcctgaatatattgtagttaaattatacattagctagtttctatatggcattgcattgattaaattatttggtgattcatccacatctagctctgttcttattctcctaaacaagttaaagattcatctatgtgtgtttatattttagttacaaaatatgaggctaaactttatgtaagtaatttataagtcatggattttattgaacattaaatagtgctagtttcttcctatacatccgttcatttgagacattactgtacttaatttacatggttgctactgtgacaaaacatgctagaaacaaatattattacatccactctactgaataataccaattttatttattagcatatttgttgaccataatctaatcatttgatattaattatttaataattgtaaatatgttttattaagtagtgagttatataccattggaaagcttatgaatttatatgaaattaggttcaagtttcactcaaatccgagttaaaatgagcaagttatactagtttaaagattcaatttcgaattaatccaagaaattgtgaaaagctactgttcataattcatttatttttaatccgaagtatatccttatccctaacagctgctgacatgtggggtcaaagctttgattttctttttcacaggattaattttctaaaggaaataggaggagtggggacggcttgtcagtggctcggccgatggtcatcttcaaccttcatcttcttcctcccgaccgagcgggagcagcaggggaacacggtgcacccagaaggccggccgagggcaacccggcggcggccaggggacgcacggagaagctccagcgaccacccaccggctgcggcggcgcttggagggacggggcgcatggccgccatggctgcgccatagccgagctcggctgcaagtggctaagacgacaggaaaggtttccgaccaaattgatgagtgcgtgagcatctacggcatacgggggttccattttgttagctagataggaaggggagcccccgggatggcttgtccacggcgagctcgccggcggcgaaacagtggccggttcggcacggctttgggtgctaatcgccaaaattggtgagacactaagcttctatggaactaggagaggctttaggagcgaggtgttaccgagaggtggcaaaacggcgatgttcgatgccgtggtggggagacggtagtgaagcagaggtggacgatggcggcgagcgcgcaggtgttcgactgcaggtcctcgggtcacaccggcacccggagttgatccaaggtagcaacagtagaggcatcccgaagccacagctcccgcggtcgtcagtaccggctccggcttcaagcaatggctatggaggcacgcacacaaggtgctcgatgaaatgcattcgagaggaaaggcagagagggatggggatttcattggggcttagcttagggtgtaagcaaacggtgtggataagatcgccagcacatgtctggacgagctagagctctaatagcgatcggataagggcaaggagatggatgacgtggataagtttcgatcctcccaagattcgggttccatgcatcgatcgggcgtgatttcccatacagtagagttgcaggggagggattgctagctgtgggaagaagcgctacattatccagcggtcttggctaggggcgacgagatgacgacgcgatggcgacaagaatggcggcgacaggcagtgctaacggccgccgatagagaggtgcagggctatctctagggtgacgcgggatgacgtggaggccgttatccctcggcatcgatggtgacacgcgatgggacgtggtgacgcaggcgctcgtggcggcgcaacctttttgcggaaatccggcggctcggtcaggcggcggggtccacgcgagcgcggtgcggcgtggcgcggtgcacggacacgcctggtgcggcgcacgggcagagaggtcgtgcgcggcctggttgcaacagggaaggtgcagcgctgggtgttcggcatgggctggggttctggtcgagcacctggcggcctatgaacagtagccggccgaaattaaaagatttctagggttttgagggatttaaaaattgagaaaatggctaattcaatttgtgttttcaccaatgcatttgatcaacaatattaagtattcaaatgtgaatttggtccaaaataaacattgtccaatatttaaatcttactatagattttatgattttctatataacttgtaggctctgatatttataaaaattaatcaaaatattctaatgtgactactattaatacaatatctcattggttgaacttatttgtctagcaatgtattttacacggaaaagtttaatctattttattcgagaggtaatttgagacttggtacaacattgatctaaatgtttaattaaacactcacataacgtattttatatataaagttcaatttatttacatgaccaattattttatgcgagtaggttttattccatgcgagactcgatgaaatttataaatattaatttaattattctagtggaacactcctatatctataaagtcattgcagtggcgactatttcgtggttacttagatgtcatgacccaattcaatccgtaacttatagaaattaataattgacttgcactttatttggctttgctaccttgtgtataaatatttctatggttaataataaataatgcattattgtgattattacttagatgtatatatttagtttaatattccattgtgacaattttataatttgccgagcaataacaatcataacaaccagcatgatgcaaaagttttaaaaagttcgaaattttagtgatttttattgtcaggaattttcagggtgttacactattacaccgggaaacgggagcctagctttgaccagagcgggaggaccgactctggctgggataagaggatgagaacctctcaccatcattatttgatgggacatgtcaggctgcacgccgcctgacacacgagcagcgcacaggcgcactacctagtcccatcggtcattcgaccggaaacagaccggttgagtacactgcacgccgcattaaatgcggcgtggcgcgaccgctcggatcgccataaatgtaggtaggtgagcacctgtaggcggacacctaacccaccgtacgtggtgacctagagagggggtcgggggagcccgagccctagtcacgggagggggcggtctccgcccgacctcgggccggatcccccctcgggggagggccacgtggcgcctggggcagccttctccctctagtctcgtttagggagtggccgccgccctacctcgggcccgacccctcccgggggagggccacgtggcattggggggcagcctcctccgtccaatctctaggagggagtggccgtcactccacctcgggccaaactccactcgagggagggccacgtggcattggggggtagcctcctccgtccaatctctaggagggagtggccgccaccccactcgggcctgactcccctcggggagggccacgtggcattggggggcagcctcctccctctaaacatgatacccttgcgcccatatcaccgacagtagcccccggcgttagccctgaccaaaacctttcccaggtggtcatggttgacgccactctgctagttagttgacatgtgggcccgatattctgtccaatcatcctgggagttgggcagtgggagtttagtcacgttcatacgtcgccttaacttcccactttcctcccggtttccgaggcgttgtgggcacgggagtttagcccgtaccttaggctgtgaacttatttcctgtatatactcagcaaacgttgttagattctctcgggcccgtgagcatacgccgcgtacctcgcttgcccctgccttttgttaacctctgttcgtgttctacttcatctattcaaacaattatttttgcgtgagcgtgaggactgaactttccatagctagcaatcttcacccgcgatcaagccaagctgggcgctgtagccagccggcggggccaaagccaaccactacggaagagccagcacagggggccccgggagtcgacggcgccaagagctcgacgcagggctaggagagagctaggaatcgtagcccccgcattttaagcaaagaatcgtttgaatagatgaagcgaatacaaactttttgttaccaagggatgcaagccagcacgcgacacgtgggtaccgcgggaccgctaggaagagataggcgagagataaatataagcaataatgattctatgcaaacgattatcttcgcgcaagtgcgaggacttaattttccatagctagcaatcttcacccatgatcaagccaagctgggcgctttagccagtcggtggggccaaagacagccgctacggaagagccagcacagggggccccgggcgtcgatggcgcccagagctcgacgcagggctaggatatagctaggaatcgtagcccccacacttatagcaaataatcgcttgtatgaatgaagcaaacacaaaccttgcttgcatgtcgcgacctttcaaatctttagctcgaagagggcctcccaccatgggttcctaaccattttgggaagcctgcgaccacttagaaaacaaggtgaggttcccacgagcctgtgtccccacgttacacattttgtttgctctttcctttcggtggcctccttccaatatctctctcttttacatggacgactactttcgcacgagtgtgagagccgaaaaactctagagccagcgatccctgtccacagttgagccaggctaggcgccgtaaccagccggcgggaccaaagctagccgctacggaagagccagcacagtgggtcccgggcttcgacggcacccggcgctcaacttaaggccggaatagggctagaaaacttagcccccacacttagcgaggaaacgttcctgtagatgagagagaggttgggctcttaccaccgagggaccaaacaaatgcgtaacacacgagcgtcacagggccatgagaaaagaacggggggaaaataaatataagactttaagctgtattaagctgatgaattgaaaaattaaaaatacttgaagcttgaaaggacgattagttgagccgggccgggcaccgtagccagccggcaggaccaaagctagccactacagaagagccagcacaggaagtcccgggcttcgacggcacccggagctcaactgcaagagccctccaaggtgtagaccaaggcgggtggcaggttcatgagcgatccctgcgcttggccctggagggccatagggaagaaattcgccttgacccggtcgtcgccccacgtcgcctctatgatcgtcgtgtggatctggagggactcagaggggttgacgctactgtggtaccttacggtgaggctgggccgaactttgggggtcatcggacattccgaagactcgcaataaagacctggccgccagtcttacccggtgaagatacggggggcctagccccctgcctggggtggtgcggcacttctgaggaggctgcaccttcccccgcattggcggcacgaagcttatcacgccggcgctcgaaagaacctcaaaaataacgaacgcgcccctacctggcgcgccaactatcgagaggtgatcctctctagcgggagatcatgagatccccctttttcggtttggccgagggcagcaggtgagatccgaggttttcgagataaaagagacacaagggatttatacaggttcgggccgctaagaagcgtaataccatacttctgtgctatgctccttgagtgaaggattacaagatctccttgttggagtaaaatgtggtgttgatcatccggggctagagactgctctagagcgtcaaatggatcgtcctcgatccctccccccttttacttggcctggacctcctttaatacctcaaggggttaccacatgggcccaaaaacctagctccgatgaagaagtgttttgcattaaatgcctgtcttgtctcttgacttggaaagcaagcgcacgtcatcttgatgatggggcctgtcaaatcttgctgcctgacatgaagggcgcccatgtcagctgcttttaatgagtgaagacttctgggctcttatttgtcgacccacgattttggaaatcggaaatcttttgtgtttatcagtaccaatccctagatcaatagttgggtacacacataaagccgaatcacaacatatcacgaatgaattcagggtaaaaaagt

SEQ ID NO: 49264 - DNA, 5090 bp, Oryza sativa
gggggagggccacgtggaattggggcgcaacctcctccctttaaacatgatacccccgggcccatatcaccgacatggaccaactataaacataagcaccgctttatttgaactgtccccaccctccgctcctgacgacgatgccgttgccccctttcctcccgccgccggccatccgcctccatcccggtcatgggcaacccttacttcgacctctccccgtaatccacccgtaacgatgacgatgttgtcgcccccttcctcccgtcgctggtcgcgcgcctccatcttcgacaagggcgacccctcctccgatccctcgccgcgctccactgccgccaatgacgacgctgctcccttcccgcactccttcacctccactagcatgatggggacgtgcttggtttccaaggatgacagcgacgatgcttgggaggtgagtagcagatcggtgttgggatttgttcttgtgtttgattttgagtagcatgttcctctccctaaccagtgacgaggagcaagcttgcctcaatgcggcacggctatttgttttacgaaatctacacccaatcagtacactggccaatgtcacctgtgacgggcccaaaccctcatctttgacagcttcgcgcatggtcagtgatcagtggtcattggtgagtctagtcacctttgacgggtggccggccgtcacaggtgacacccacctctgacgggcaagttactagaaggccgttagaggtgttaatctccgctagcctagggcgagttgggacccgtcacaggtgactcatctctgaaggacctttaaataaaggccgtcagaggtgatggtctccgtagatagaagctgtcacaggtgatctacctgtgatggccccaaaagtaatggcccgtcacaggtaggtcacctctgacgggcctttatttgctagtccgtcacaactgaggttacctttgatggatttttgttctgacccgtcattgatgagttaattctagaaaaaaaataaatgctaaatattggctagcctcaagatttgctagccatgccctctgaaacacagatacatcacagatatattctagtcaccccccaatataacatcacagatccatctcaaacatcacagatccccaacaacacagatccatatcaaaaattgacatcattcacatatgcagttcaaatgccacaattttgcacagcaaattcacaccccttgaaagccacaatttcggtcgttgctcatagaaccgcatatatacttaccaaatggattaaagccataatgtcgtcgacctccacgacctgtcaataaggaaaaaaaaggagaaaacaaatgaatagtacaacgtaaatcatagttgatcaaatttgatgacaatttagtaaactaccataaatattgcacatatgaaagtaaattacactgcactccataaaaacatattttttacatcacaagaaattataaaaacatcttctttacatcacaacaaattatctagccaagttcatgagtctatttgacgtgaaaacgtcctttcttgttcattatttctgcaagaatgaaggcgcacacttcacctctgatagtgggggggggggttgatgggtgagatcttgaagccatctctacctttctgtttaataaataagaggttagcacgttttgaatagcaatgttggtattgaaatgagcttattcgccattagcaacaaccttagggtcgaaatctttcacctctcttagaagtgttgacatgttgtggcacacgtggaaaccacattggtctccgatctgttgtgcgcatgcgaacttggtgtcatgataaagttcgtcgttgccctccttgtgcctaccacccttttccacatatgggccccaagccatatttaaggccttggtgatttcagtgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttgctctgggttgtgtgcgcacatgatgtactccttgtcttgatgggaccataaacaccggttgacatagtcaaccacctcagtgaagctctgtcgtaaattaacctcgttcaccatggatggatcaaggaacccaacctgattaccaaggcgacgactctcgatccaacacaaccttaaaacatttatgtattagaactaatttaattaggagatatagtccaatcatatcacaagtatagaaggtatgcacttacaaggagtagcattttagaagaccagtgtccaacttccagatcctgaaaaggttgaagaggtcatcaaagcctatagttatgtaggcaggcgacgataggaacggttggtggtcgtgatgtccaactatggatgactccctcattttccgcttcgcattgcttagctccatgtattgcttatgtagctctcggcaagcaatacccatcacggctaacacattgtcctccaccaatggcatgcttaactcaaattgggccggcgcactcacgaccttccccgctttgctcaccggcatcgacgtcgtagccttgcccatttttggctccggcgcaaactccccaaccttccccttgccgcgttcatgcttctggcccttgacaagtggtggggagctatcagcctttcttgtggtctttattggagccaagctttgagctatatctgccaagtccatattagctccatcaggagaatgaggtactgacaatgccggtccacggggagcctcaattgatagcttagacttgggaggtgtaagctccatcagtcgacttggatgaggagtcagtcatcttcacaactatgtcttctttgggccattgtatgaacatcttgcgcgaatcgcccaaagtcatgatttcatcattgggggcatgggcagcggatagcctgacaaggtgtcctttactgtatcgatggacaccttggcatacacagctagcaggtctgtgccgtggaccttgtctgtaaccgagggcttgaaagccatgccctcagcgacttcgggagcgaaagttgggtggaccctcgccagtaggacacattgtgctacgccctgtatatgcgaaagttggttttttattagatatggatcagataacatcaattacctctatgtggtccactgcagctagtggtgcgaccgggagaccaggggccgacacctctgtggatgcacaactactcttgtgctgtgacggactcgcgtcgtgttgtgcacgaggagttggatgcacagcaggtgttgtgccttggggtatattcatgtcggcgaggactttgttaaccctttcttccaccctagcgttcatgctagcttctagttcttgaatgacctcaaccttaagttcggccttcaaacaagcgtccctctcttccttggagacttttcgtttcctgtattgggagctgtactgcgggagtccattgtaacatcctgaaaattcaagacaataaaaaaaatcactaaaatttcaaactttttaaaacttttgcatcatgctggttgttatgattcctattgcttgccaaaccgtaaatgatcaccaagaaggtaaagaaaagaactacatttaagcaatagatatgatttatgagaatatatttaatcctacaaataattatgtgcaagatattaaaatcaaataaaataaaagttattattaacctattttatcaaatattaaaatatttgaataatataggtgggtgccataatacaagccggcgactcataaagttgattccatcgcactcgtcgtcaggaaactcggcgtttacccctacctggcgcgccaactgtcgaaacatgaattcagcaataataaaagggggtagcgctcgagacctaaaagtggatggatcggagacaaaggatttagacaggttcaggccctctcaatgagaggtaataccctactcctgtttggggatttgaatccgccgagtgtgtattgatctgacgattaggttgtctcatgccccctagagggcctcctgcccaccttatatagggtggggggcaggattacaagatagaaaccttaaccaatacggtatcggtttcctaaatctacttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacaacatgaaatgatgatcattcaaatgaactgagctctctgtatatataatagaattatgggagtatttaattcgatatgtagatcgattttgcaccaagttcctaattgcatttagggattgaaatttgatatattaaacccctccatataaaataaactaacatatagataaattgagctaatgtgctattatgttaataacggtctcattagaaaaaattatagaatctttaataaaccttaaaaacaaattggtaaaataaatataaattaaaaataaaagattaggtacggatagtaataaataaaatattatcgcgaccatatttggatcaattaaatttaattgcgatagaataagaatttaccctaattaaaactcaaataaattatataaacaaaatatgagtgatatcaaattaaggagaattttagttaggataacacaaatatgggataaacttcatttatacaagatttagaaattatgaaatcaaatttatattgaaaataacctaaaatcgggaataataggaaagtgcactattcattgctcgcaaggtgttcgatttggtccctaacctttccccttctctcccacctctgccctagccgtcccgagccgcgcgtcgccaccttgcgccgctcgcccgccgcgccgccgtcggcatcgtcgccgtcggcctcgcgccccgtgccgctgcctcgcgcctcgcgccgccgctgccgcgctg

SEQ ID NO: 49265 - DNA, 5924 bp, Oryza sativa
cccctcttccctataaacacccccacccctctccatggtttcccactctattcctttctcctctccctcttccccctttggcacgcgccgccgtcgtcgtgccgccgcgccgccgccacaaagtcaccgcgccgcgccgcgacttgcgccgccgtcgccatcgttgccgccgcgccgccgaccacggtgacgccgcaccgcaccgggtgccgcgccgcgtcctgagccgccgtcgccgtcgtcgccgccaccgccgccaccgatgagccgtctttcccccccccctccatctcgcgcccaccgccgtcgccgcccgagggagaagccgaggaaaaagagaaaggagccgggagggagagaagaaaggaaaaaggagagagaggagagaaagaaaaagaaaagagaggccggcagagaagagaaagagagggagagaaaaaggagagaaaaagaaagagagggagagcaaagagagaaaaagaaaaagaggagagaaaaagagggaaaatagaaaagaagaaaaggagaaaatagaagggaaattgggggagaaattagggggatttaggaaataaaaatggtcggggttaatcatagattatttttggaaattcctcgagcgtaatagtatttcgattgaaattccgagttaattataaatatatgtttctggatcagattaaattagaattggtagttatttagatataattaataaccaaacaattagatgaattcttatagattattatagattatttttggtaatctctataagtcatcggttcacggtagaaattcggattcaattacttggaatcttagccgtgtattatatttaatcgtttagtcatagactaaattaaattgtataatatttctaagatttcgtccgatatttagctcgtaatcgaaatttctaacctgttatatggatataatgctcgggatgagtaaattaaaaacttatgacaacaaaatatttatacccgaaaaatagtttaaatcgaaatggggtttgccgtagttcgcagatagtaaagttaataaaaaggaatcgacttttgcattcgacttttactcggatttaagtgaaacttgaacctagattcatctaaattcataagctttccaatgatatataattcactatttaacaaaatatatttataattataacttaactaatatcaaataattagatgatagttaacctaaatagtgtgccaatgaataaaaatggatgttgtacagtagcataattatctttaacatgtcttgtcgctgtagcaactaaataaattagttataatcaatccttcaaattaatggatatataggaaaatattagtaccagttattaatctatgtccaaatataattaaaacccacgacttattagttatttaaatagagttagccttataattattaggtaagtaaaatatagatacacatagaacggtcctaagcttgtttatggcaaataataacagagctagtgtgattaaatcacctatatgaaattaatcaacgacatatcccatataatagcatatagtaggcaaggtgagcaacccttagttaaccaagcagtaaatagaaactattcaaataaatgattcaatatactaagatattgtgcacacacatattgtacatcccattatagatatatggtatcgtattaatctgcttgttgcgtatattaatttagagggagtatatgacaaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgttaaccttttacaatttattttgacaagtgaaatatgtacataattaaaataaagcctccattaataaaataataatacaaatgattcacagtaattatttggccgatccaaaatccatccggcaacagaacctctagtgtataaccgtgctatgtagataaatgcatgcctagccataatccttccatagccatttgatagactaaaccaccgattagccaaatatatatgtatcctataaatgctatgttggttaactcctaaataggccacgttgacaatagaaagattaagaaaccttagcaagattggaatccattagcaaacacgaatagtacattttgttgcgcatatttgattgttgtttgaatattggtttttctcgcgtattatagaccttgtgtatcggttagtcgtgaggcaacgtcagcaacttccaggaggtgaaggttgatcaagaattacatcaagaataaggactatcctgagcaaggcaagtcatcactattccttgaacatgttgatcccaattgcgaaattgttttgtttacaaataaacttgcatgcaatgatgaacatcctactggtgattataccatgccttgattattgttcacctttaaatctttgtaaccatagatacgtacgagtccctagtcaactatgacacttgcttaggaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtaccgtccctggtcaattaaggaccgagccatgaagttaagcatgaaacgacccccgtacaaccgcacttctcgtatgggtatagacctagcggaatagatagctgagcggaggcagtatccatgcatagtggtttcttgatgtgtgaggtaggggctctacggtggggcagccattggtagaaccgcgaggcgggtgtctacagtggtgtcgccatcagtaggactaccatgtgagaatttaaacataattacaacttaatgcatgtgtgagtctttccttcccgggtgcgccagaactcctctcactgctagaaaccgtgtacgcctagagtgcatgaggatttaagttcatggagcgggtactgccaatgcgaggttatcgaaaagctttgctgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgtgggatgggatattgcatgatgaatttcatgctgatggagccacatcccgagaggagggaaggtggacatcctcagaaaaccatgacgattcaatggcgggaagctatcattgggatcacaatggatggtggacagaaccatcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttattgtggtggcttgctgagtacggttggtactcacccttgctattcatatatcttttaggagagtgttgaagagaagcccttgtcggtacgcttgcgtatccaacaggatgatcggagtgcggtcttgttctaggtctcgttccccagtcgactgcctgtggcatgttaaccgggcccttatattatgttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtttacatccatgcttccagggcacatcgctaccaattcccctagtccggccaggatgtcctttggttccgagcgcctttgtgaggatgtcatcttcacgcctctttggcgtggactcaacatcgctttgtgaagcttgttcagcaaccaagcccaactagaaaaaaaaagagtcgtttatacgaacttctactttatacgaacggaaattagttaggttaagtagtgaactcaccagttcctgatagacgacagcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctacttgccgatgtaccatgcagtgcctagccgatgcgggtgctcattccgctgttgcagtaggcgatgtgcctcgcttgattccctaaactcttgggtgttcttgagagagcagaattcctcccacaccgcttcggttatttgagggtattcatcgaatggcgtatgattgccgggcgggttgacaaactcggtgaagagcttcgacttccaattcttccaacctttgcccatcttatggaatgccttccacttgagataatctatgtgtaaaaaaatgaatatggggcacaggggtagcagcagcaacagtaattcatcaaaaaagaacaagtgtacataaaaaaaagaacaagtgtagataatctgttcttatgcattaaaaaaagaacaagtttagaggtatttctgttctcgagcattcatcactggccatttaacataaggcaaccataggcagcagcatgagcaaacatagacagcaaggcatccaaaaaaaagcaaacatagacagcaaggcatctgaggtatttctaaaacagcagcagcaagggtatataaatcatgtatataaacaacaattcatgcaattcacctattcatagacaacaagggtatataaagaacaatttatgcaattcacctattcatagacagcaagggtatataaagaacaatttatgcaattcacctattcatagacagcaagggtatataaatcatgtatataaacaacaattcatgcaattcacctatttatagacaacaagggtatataaatcaacaagtgtagataatctgttcttatccataaagaaaagaacatccactgcagcaaaattcatgctaagatcctataataccaatagaataattcctctaatactgcattcatccaaaatctagcccctacattcatccaaaacatccacagacaacaaatcacatttaattcatctacacagcagcaccaacaatcgaaacaatagaaacaaatcacatttcattcatctaaacaatgcaattcatccatcgaaaaaaggaggaaggggggagggtggcagcgtacttggataaggcggcgcaggccgtaggcgtcctagatcccggcggcggcgaagacgagggcggggaggcagcggcgaagaggtcgaggcggtcggcgctgcgggccgatgtcgtcaatccaggcgtcggggaggtcggggtcagggaggtcggggccggtgatggacggacggtggcaaacacacaagggtggtggtggagatggcagcggagagggcggcggtggagaggttgaggtggcagtggtggtacagatggcgacggagagggcggcggtgatcggggatcccggcgtcgtgggggtggaggtggccggcgtcgtgaatcccggcgtcggggaggtcagggtcagggaggtcggggaagtcaatggacggacagcggagaggaccagcggcggcggtggagaggaagacgtagagggcggcagagatggcggc

SEQ ID NO: 49266 - DNA, 1242 bp, Oryza sativa
tcacaggtgaggtcacgtgggacggccttacagttagagcccgtcacaggtgagtttgactacatggactacaatattttatttaattttattctatttcacttagttcttttattttccttaacatatttccacatacactacattttttattttattttaattccgatggttatacttgcttaattattttatttcacttctagtggattcctcacttaattattttatttgactatttcataagcaatatactattgatcattgcgaacatattagagtcatacagataacagacatgtagacataaactacatagataaattacaaaaataatccttcctcatggtcgacgcgtgcatattaaacgtcatcttcttcttcctcctcttctagaggtattttttgacctatgccgtggacgtgctggttgtaattatcctcgtctgcaatattgtctaatccaacaattctccttttcccttcacgaacaacatgtagtttcttgttacatgggtcaactatgtagaacacttgaacaacttgtttggcgagaacgaacggttcatccttgtacgcgttgttagccaagttgacagtggtgaaaccttcattgtcaacttttacattgcgaagattgacccattgacaacgaaacaacaggactttgaacattcaagtaatctagctccaaaatttgctcaactctaccatagtattgatcacgcctaccaccgtcactaggagcctcgatgcgtaacccactgttttgcactgtgcatttgctgtcttgctttaccgtgtgaaaggtgtatccatttatgtcatatccttgccaggtggtggcactccattcaggaccctgtgacaaccactgaagtgtttgactagacaagttcggcaacttggcaatccggttcttcagccactcattgaaagaagacatgtgcttatttctgacccaactctctgatcggcctaggttctcctgtcggagaactgcaaggtgttcgtcaacgtacggcaccacctcagtcatatgctgcagtaccgtgaaatgagctttatcgtacaccttccgatccaacctagcagtctttcttccaacagtaccaacaccatcaagtctcccttcatgatgagatcgtggtaatccaattgaagatgtttctaacatgtagtccacacaaaaatcgatgacctcttcggttgtgtaactctcgatgatactcccctcggggt

SEQ ID NO: 49267 - DNA, 730 bp, Oryza sativa
aattcctgcagcccggcttcgcacgttgccactctgcccaccgtcgccccacttcgcctgcttgctctacccgccggcttcatgcggcgccgctccgcctattctgctcccctctggtcggctgctcccatgggagagagcggacagatacagagaagagaggggatgagagaggagaggatagaggaagagaggttgaaaggggaggggaagaagaggctgacgtgtggcggtgtgggacccacgtgggtagaagaaaatcgattgggattgagacagagagggggggggacctggagagacgcgcgtggtaaaggaataggttggttgtatgtacagaaagtggttggcatgctagctgtacggtggaagcaaaccattatggcttgccattgacttctttttaatttccttgagaaatagacaaaaatttaaccagatcctcctcagcaccgtagagggaaggtctcctcgccaccttgctaatgggctcgtggatctgggccgacgatggccggatccgtcatcctgcctcgtcacatggtgtcatcagggatgatggagacggcggcggtggagcgaagcagtcgtcaatgctagctacgaagaggtccatcatagataccggctacgaggtggagataaaatcagaaaaaaaaaagatgaacggattgtggatagcgcattacctggtcgtcgtagggagagaaccaccggtagcaactgcggc

SEQ ID NO: 49268 - DNA, 730 bp, Oryza sativa
gcacttgttcatgatctcccccttgctccccaccggcatgggcagcttgctgagcttgagcagcgaggcggcgaagtcgtggtcccagagggcggcgttgtcggcgtactcgcggacgtggccgcgcgcctcgtcctgcgtcagcagctgccagtccgagttgaagttgaccaccttgtcgaggttgttgcggtagtaggtgttgtccagggcgctgaccggccgcagcttgccgacgaacgccggcatgaacctcgccacggtggcgaggtcctcgtcgcgggcgttgttcaccaccgcagggtcggcgccgccgccgcgggagcacctgtagttgagcaggttgcggtaggacggggtgatctggtcgggcggcgcggcgaggcgggcggtgaaggaggagcagtggccgtcgccgacggagtgcgcgccggagaggacgacgagctcctcgacggtgaagttcttgcgggcgaagttgtcgatgagctgccggatggtgaaggtgggatccgggagctccgcctgggcctcgtaggcggaggagacgacgccgtcgaggcggcccgcggggacgtcgaagcggacgcggccgttgctgaggatgctgctggcgtcgcgggcggcgaagatgaggatgtcggcgcaggagaccacgccggggcacctcctctcgagatcggccttgatctcctccaggatgtcgaatccttccagggggcgcaggaat

SEQ ID NO: 49269 - DNA, 1457 bp, Oryza sativa
agcgaaagtcagtgtcgcgataagcgccgatgcgaccaacacgctttcagtcgactctgaaagggttttcccgtgcttttcttgttcttgagagctaccaccacggatcagttcatcacgcctacgaggactgaagacggctccagaatgagccaataccctcaccatccattctgttgggttctgcagggaaggagacttgaaatgtcaggagatctgttttgtatgtattttaatttatgccaaaattttgatggttttatgcatatacctggggagaggcaaagtagtcttccatccttatcacttttgcaagatcgagtggtgtatagccttctaggttgacatggttgagctccacggccttattctgtaggagatacgtgaagatgtactcgtctcttttctttacagcaagatgtaatgcagtattaccgtcgttgtcctccaaattcagagtttccttgaacctcggatctttgcacaccaatttgactactttgtacttccgattctcaatggcgatatgaagcaatgttctacctttaacattatcacgaagagtggcacagtcttgatcggcattgaccaatgaggtgattgtgtccattgaaccaacagaagcagctatgtgtatggggaacatcccattgttgtcgggccgttgggtgtagtccgttctgcgatcttggtctatgccatcaagcagcgcagttgttacgccctgaactcctactgatgctgcaaagtgaagaggtgtacttccagaccaatcagctttattcatgagatctcctctccttcctagaatcaattcagagttctgccatcgagtatttccgttaattagtacctagctagttatgataccaattgtgtcaaagaatgtacaacctaaattctatggcaaagaacaaatcaaactttcattccaaaataagcactcaaaaagattctggaggatgcacagccattaacacgtacgtgagccttttactgttgctaggagactacctcaagattataattttttttttgataaaggagcttttattaatctcagacgattacaacaagttaatagaaccatactaagaaaacttccggcttctgcataaatgcacataaccaaaacacacacaagcccataaaagagtttgtaacaagagaaggaaagcagtaaataatgtatagtgttgatcaatgatttgatcaattatgaaagcacattgttgactatctgacaacaaccagatgatgccaaggggaaaggtgctatgtataatgagtcaagggcgaaagcataacaagcaagtactaatgtgatattcaggagaaatacaagcaccacctgaaggctatgcgaaagttaatggtgatgccagggtcagaaaagaagcaaagcaagtgcaggcattattgtagacattctcataaaaccactggcttattgaacc

SEQ ID NO: 49270 - DNA, 1196 bp, Oryza sativa
agtccaggcgagattttatcccggcccaccccagtgttttcccctcgtcatcggccgggaaatattcagcttctctggtggcgaggaaaaaatcctctcgacgcagcgacgcaatgagagggggcgctgcggcggggaccgctgcacggcgcggcgcgactaccacgtgacggcaacggcacgctctctcctccggtggccaccttctccccggtgagttcattcccttcccatctcccctagcctcctcttccactgttagggtttcttgccctcgtgacctcccgctattgccgccgccaggagaagcacgagggcatggatctgttctttgtccctcacacggcgtctcgatctattcttctttctcccttgatttgctctgagcaatattcctaccctaggctgaagctctgatcatgtccttcctggatctgatcctctgtttgtagtgccctagtgagaatatgctgattctcctggtagttgagtagttgaaagaccacgttttctgattctcaatgtgagttgttttaaatttgtacataaaggttatgaaaatggtttattcttaaaattagttggcaggtaatagtaatgccacaaaaacatgcagtgcgtaataatattgaggcatcagaagtgaatgctgttcatttttcagaaatactagacaaatgttgttcatcagaagtgattccaacaagttgtctgctcttgtaatctcacccatacttgacagtgcccataatacaagtagatcaatgagccattccacatgccatattttctgaacaaagtacaaagttcaaattgaagtagtaagaaaaatgagtcatgtgcagctttagttcaggcctgtaaaaagctcttggcagtcggcagaatacaacttaaatctgaactattttggtacatggttcaaatggtctaaaaaataatttcctaggttggtccatttttagtagatcttgtagaaccatgtaatgaagaaattctggatgtaaaacatgatttttgcagctattgcttgcttaatctgcagactactgatttttgcttctactatagctactattgaatccagttttttgcttgctcaatcttatatgtgtcctaatttcattttgatatctgaagcactgctagcattagtctcatatgcatatccatgtttctagccctgctagctattg

SEQ ID NO: 49271 - DNA, 773 bp, Oryza sativa
  unsure (1)..(773): unsure at all n locations
gctttgcttgtgtgcttcgcgtagcttctgtcgttccggaggttctcgaagcgtggtttgcggtcgtcgccgaaggttcggaaggccgttctctctgagtaaggcaagtcacatcatccttgaacatattgaatcctagtttataaaattattttgatttaaattattgcattatcgctttatttaaatttccgcgttatcactgttttatctagccatgcctatttacttttgttatgaccttattattgctattgttattattatcttgttcaccctaggaaaataaaaccccaactagtgggtactctattcatggttccactagtatgaatttaggtagatgcttcgctgattaataggacaacattaggtggtttttataactttagactttgggaatattcatatctcttggatactatggaatgggtggcttatggtggaattggacatacccctctcttcctctttcaaagcccctaaaacctgtntttcgatggggtttgggtgcatgccagttgtgggaagtagcaccccgaccaatataaggactaagctcgggcctctattgcaaagcactatcgtacttccacatgtctagtgggtaaggcttagtttgtggctcagtctggttataaacaaaagtacacggatggagatggacgaagtcgggggtcaatggacatctctaggacaaatgaaggctacacgagctgcggcccggtagtcgagatgtcatggcacagggccgatgtcctgctgctgggggc

SEQ ID NO: 49272 - DNA, 732 bp, Oryza sativa
cggttgcttttagtttctggatatttctctggccagtactcaaaaactggaaaagaaatgaatttttagaatggtgattttgtatggtttggtcttcttattttctacaacgtacttgattgttggactgtgaagattacggaagtggtttcacaaggctggaatggaaggttcattgttcagaatttggcgctgtgagatggaactgtgcactacataatataatcatacagttgctatgatactgaaaagctttgagatatactgagagaacaaaatggtttcagtgaaaaatgaagcaggagcatttgccacgtgttttcaaaaacacacagatgtcacaatgatttattgtgcaacttgccattcaagtccaatcttttccattgtgctgtgtgattagtcagctagtacaaaataacactacgagccatgaattgctagagttggataatcttgaaataatattgaatggtccagatttgtataatttgggatcttgggtacctcctaacttacccttcaaagtttcaagttactatcggtttctttcaattgacacaacaaaggtgtgttatcaggttttgtactttttttcaatttgttaattatgtgctcattttatgcatgaagtgaggctgaaatttatctatttggagcctgcgtaacatcttggaaagtccccagtggaaaagacctcctatttgtcagaccagatgcggtgttcaacgg

SEQ ID NO: 49273 - DNA, 753 bp, Oryza sativa
agcacacctcgtacacgtgtgccacataggattggaaaaaatgtttgggcatccgcagccgctgccccctacgatttcacctccgttgctgttaagcttgtcgtcgttgccgcctaggattttgcctccgtcactgtttatattcatagcttatcattgccaccagcgagtttgatggcaagtgagagagtactgagaactagaagaactcatcaaaacaattacaagtgaaatgatttggtttccctaattccgtgtatttccaagtgctagtgttgtgagaaagggaaaaaaaatacgcatgcgatttatgcacatgtccgaaagcaattttttcaatcgtaggttgcatgccatgtatacaaggtatactcatttggatagttagataagtaaatgactcacttaactcacattagtgaactaaatgtgcattttaaaagtagagtgatctacctaacacacctaaacaagttaagtgaccttccatgcattttactcttggaacaaaatggttgtcaaggcgtcgccaaagcgtcactatgacagtaaggcgctaccaggagtcagtgcgtctagcccgccttaccatattgcttatggtgtccgccttatacccaatgcgccgttatggcgtctatatcgcgtccttggcgctacaacagctaaaggtgacgccacaggaagtcgaggacacggtttttgccccgattagttcaagggcccaaaaaattggcgccatgggtcctggac

SEQ ID NO: 49274 - DNA, 1652 bp, Oryza sativa
  unsure (1)..(1652): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgaggacaccaactatgaatttctgtagctttactgctgtgcccttgttttccaactatcaattatcagatacatcttttctctcagaagcaactcttccaactacttttgtgctctctctcctgttcatgaagtacgatcaattttacttacctgcagaatgtttggacaccatcgaaggtcatagcttgtcttggcaaagaaataaatgatgaaagttcctacctttattgggcgtataaggtaacacatgtttattaactacacctgaatatccttacaaagtgcaaaataatagcacaagaggggggccacaccatcaattctgtttataaagtccatgcatctctatccttagtacacaatgagatactaggtagtctgattcaaaatttttctttgttccttgaaaaaatatttgagttattttttgtctgtatttaatgttgtgtagctgtgaactcttcacaataatgccatgggaacatattttcctcctggaactagtgcaccgccatcctatatcttgatgttttgcttattgatgttgatataatgtacatgatatccaaattttaacctttatttgactttttagaatgagttatagacttatagttgagtggatttggtcaagacacttgttttttttctctctcatgatgttgcaatagaccatatactttaagcatctgtggagaatacgacacgtaaaccagcatcgatattcgatattcttgtgtgggttttaagttcttatgcccaagtgcaatgttatgatctgttaatcaaaagactgaaacgagatagtactgactttccaaaacttgatcagaacaatattcctgtatactgcccagcattgactgatggatcgcttggagacatgctattctgtcatgcagtccgcaatcctggcctaattattgacattgtacaaggcaagtttgtgtgcttggttttcttgcttttgcattcaattttttttctcatattatgctcgaaaatgtggcagatataagattgatgaatggggaagccattcatgcaaccccaaggaagacagggatcatagttcttggtggaggtctacccaagcatcatatatgcaacgccaatatgtttcgcaatggtgcagattatgcagtctatatcaacacagcccaagagtttgatggcagtgattctggagcacaacctgatgaagcagtttcatggggaaagattaaaggttcagccaaacccgtcaaggtatatttctgtaccttgagcaattttcacatgattatttttaatatttgatgtgcgcctagctagctaaaagtgccttttgttaaacatcatatgctgcatatatgaacatttttgtcagcttcgcttgaacaaggtatgccaaagagattgcatcaatgatcttggactagatcctaattctaatccatcttata

SEQ ID NO: 49275 - DNA, 1760 bp, Oryza sativa
tccctcctgccttgagccaccaaaatgtggggtccacctgttagcatcatcctttttcttcggcttgagagccagcaaccgtttcccacatcacgacctctccggtgggcctccccgcttccacactcgggtctccaggtgcgtggacacagtcttgtaaaatcaaaggtgtttttgattattattttgtgatgaacaattgggcattggagattattggttttgttatttggaatttattcacgaagtggttttgaagatgattggatttcacatgtgatcgcaggattcgtcattttatgtgatcggtcagaccgggctctggtagccggtcagaccgacgtgtaatgcgcggtcagaccggccgacactgtgtcggtttcaattttgggttgtttatttggatatccgaatttattttatgattatgacttctagatggatactatacgtatgtaatactattgtttgctgctgatgagtcaacttggagatagcttggtctcggaatatggtttctttgtttgttccatgtgtaggtgactcgatgtctcaggggagtatttgcggtgatggaccgggagtcggcttggggataagacgacgtccgtggtggtcagagatcatgcgagatacttaggctagagttgatgcacgtggttgatggagattttatatggcatacgatggagttattgtgtgcgtatgggatgcggagtcaaatttagaaggagtccaaatatggtacgattggttatgtaaagtttctttcttgtactagagggtttcctaaggtgtttaggactcctagtatgagtttggttcgtggctttaggctgcctacctcgggtataaatagagagggagcgtgaggcttcccggtatcgcttttgagagcaattgagttgagttttgagttagggtttcgagtttagtcgaaatttttgtaaggagtgctgttggtgcactttgtaaacacagaaagaatcaataaagtcgtcatcaactttaagagttctttgatttgtgtttccccgggtttcggcggtctaaccggcaactcaccgacggtcagaccggcggcattgcggcggtcagaccggcgggagcatggcggtcagaccggcggcggcgacaggcgcggcaggtgatctcggcggtcagaccggagattcatcaccggtcagaccggcggcatccactcggtcagacaggcagatcaatctcggtcagaccgacttccatcaatttcgagggtaacttttatttccgctaaaagttttcggtttttgggtataccaaccattcaccctccctctggttggcttagttcttatgattcgatcctacaagtctcctccacttgtccacctttagccccaccactctcccgcaaatcatacatcgtcaaagccgcatctcacttatgttgtacctatcgttggctcacctatcgcctctccccgccccaatccagtttctcgagggtataaatagcctcgccatactcctctatcttgttttccacatttcaaaagtttagtgcttttatgctaaagacggagttaaaagaccaaggtttatacctcagttgcgttttacttgtggagtgaaggtgaagttccagtaggatcgtcctttttcactgttgctttgttttttctttatgaggactaagtatttattctgtaagtatttacgtttgaatatgtatattaatttgtcattttgtgtatccgggtaccgagctcgaattcgcc

SEQ ID NO: 49276 - DNA, 2015 bp, Oryza sativa
agatcaaaattttgcacagctaatgctggtcatatatttatgccatcatctacgatatgtttccatgtgattgtggccgtctggactttcgcctggccatcgatcgacatgatgtgcatggtcagctagtcactccgcgaccatactgtatgctcgggaagagctggagcactgaaaacaccaaattgcatggacaactgcaggtgacaataagcgatgtgatggcatgcatgttgagtgagacattccaccgctgattctgatgtttattctcagatgatccagtaggaatgacaatggcgtccatccactactcctccctccgttccaaaataagcgcagacatgaatttttgtgtctgactgttcgtcttatttaatttttttttaaaaaacctaaaaagcatcagtcacacataaaatactatttatattttataatctaataacaataaaaatattaattataaaaaaaattaaataaaatggatggtcaaagttgaacacggaaactcatggcaacgtttattttggaacagacagagaactactcttgcatcagctctcatatggggtcaaattcaaagaaatgtttgaaaaactgacgtttaattaccaaccggtaattatctagcaagttttgataattgtgaccgaggtttctttgttacaaaggctccgttccattctgattaagatatagtctgtctcaatttttgtaaggcatgtttttcaaactgataaacggtgtattttataggaaaactttctatacagaagttgcttaaaatatcaaatgaattcattttataagtttatactaattaaaatttaatcaatcatacgctgatgactttatcattttacatgtccttatttaatcctcatcttcatcactttgcaaacaccacatacttaattaactgttgaatctgttgatgagtggtctgaattcaggatcatcactatcagagttatcagagagggagatctgcaatgagcagtacgctgtagtactacatgccatgagttaattatgagtcgcatctaacgggagctggaccttaaactaaaagcccttaatttttacgcaaaaaagggggaaaaggcacattatttggataatgactagctggatgtagccagctgtggtacctgctgctactattttgcattgcaccaccagatcggctcgggtttgcatagctggaacaggaactctgccgttgcatttccagaaaagaaagaaagaaagattgggtataatcatcttcgccgaataaatagttctgaattttgaacatcagatatggtatgccaacttgcagcgatgacatcttgtatatagtgaaagcaacaaggttttttcacaaggataaagagtttggataaacaatagtcgttaaatcaaaatggtacattcattaataaaaaacataaatgaactaaacatatgggaattttgggagatcaatttctagtgcctcctcttatatattgagggcaaagacaatgaagaaaaaaaaaagaagctgccattgatttctctaataaacatataatataacttaagtaaatttatagttgggtagaccagtcgatatttttaaataaattaacttatgtcaaaacactcataaaagctaagctaaactaaaaaaacatatataaaatttcttaaatgggatcaacagttgcgtaaagagcgactatgtggctagttatttcgtgcaaaacgaaggataacagacaatctcaatggacatcatcgaactgattatctacaccacataaggccatacacaagaaatgctctttatgtttttccctcttccagatgctagctagccagcagcataccatttcagcaatcacatcttgatttcttgttctcttcctcgacaaaaactgtcgacacgcaacacagttactactttcttgcagatgcaggtatctatctgtgacaatcgcgttgctcgtacagctgcgccccatggccgcagcaaaaccccgaga

SEQ ID NO: 49277 - DNA, 1940 bp, Oryza sativa
  unsure (1)..(1940): unsure at all n locations
tgagtacttacagtatctgacaggctaatttttatcagcaaagaattagtctaagcatcaattgttattctgattctgaaacaagcactgaacactctctgaatttacagtcagtcaaggggcaagttggatccggcacatgacgaaaacaagctgagaatttgcgtgtccctccggtgtcggtacatccggatgcagcgacatgctggcagtagattctgtgctgtgtgtgattgatgctgcatcgctgaacaggaggaacatttcacattttcttaatgcgtgtgcttaagacttggacgctggaacaggtcgacggattggcagtttgattagggtgattggtgatggatccgataaacaagtgtcgttgtgctggtgtaatagtataatctggtcgtttgactacggggttggctagcctggcactgcagcctgcaggagtgcagggtgcttgcaaaaatgtctctggcgtctggtacagtgtactgatcatcttaccagtgtttgggggattgagatttctgcacttggaatctcatcttgcttgtcaatgttctgctaatcaagccaataaaatcgagtgaaaattttcctgtctagttaaaaatatattcccttcgttataaaatatagcaatataagatttgacaggacacgttttagtattataaatctaaacattcgtctgtctagattagcaatattaggatgtctcccatcatgttttaaattgttatattttggtacgtagtaatactgaatatcttttttttttcattggacgattgaaagcatgcagattttaggacacaaaatgaagcactaaggccattcccaacccaatgactaggatggtgtccatagcattaaataagttgccacctaggataaaaactgatgtggcaagtgaataaatgagaaaagagaagaaaaccatgtcttgcatgagacttgatttctacacaacatccaagacatcatgtgagataagtagcattaaatttaagtatgaaatagtagtgtttgcattggaagagtagtgtctagtactagtttcttgatgatgtgaagtttatggaaactatatctagtgtcttgggttgggaatagcctaacagtctgtcagtttttatatcggtgtagtaaatcgattgatctactatcctgtcagagagtaatgggtgaagccagggtggcgtgcgtgtgaatatgtgatgaacgatgatgaactgggggctgaatctgaaacacaattcattttgccgtgctgagcacaagctcagctatccgctatgctgaatgaatgaatgaatgaatgaatgaatgatcagttcatccattagtcgccacgcatgcatgccatggtcagcctgaatccctgaagtgctcctcttaagtgtatatggcttagctcagcgacgtcttcaatggctagcttgggcgcatctcgcattcactccatgtaggaccaagccatggatgcgtcgagctcggatgattggagattaatttgagaggagtggttgggtacgtggacctgtggcgccattggtgcgtgggtcagtgggggagatgggaggaggtggaagaagaagaaacgctgcgatccgcacggacgcaacaaaaactgtcccagttatcattcatttcctgcagctgcaggggccactgccaatgatcaccatgtatgggctacctccatgattccatggggggttttcacgaacccgctaggtgttagtttatgaaaacccgtcaatattagtcggttttcgtacggcgttgactaaaacccatcggtttttactagtttttttcggatttcggtaaaccaatgagatatgatttttaattccaaatcgaaaaagttaaaccctnnnnnnnnnnnnnnnnnnnnnnnnnnnnnnnnnnnnnnnnnnnnnnnnnnnnnnnnntta

SEQ ID NO: 49278 - DNA, 757 bp, Oryza sativa
agctgcaggggccactgccaatgatcaccatgtatgggctacctccatgattccatggggggttttcacgaaaccgctaggtgttagtttatgaaaacgggtcaatattagtcggttttcgtacggcgttgactaaaagccatcggtttttactagtttttttcggatttcggtaaaccaatgagatatgatttttaattcgaaatcgaaaaagttaaaccctgaatctccatctccttgttcaagttcatcttaattttttttttgttcttttttcctctcctattctcctctacaagatccgaaaccatttctctcatctatacagaagtatatccattccgatctagtatgtctgaataatggtgtatggacgagctaggcttgatgggcgttgcgagaggactggctggctggctggctgcatgtcgccagctgtacaaagcgccatgaaagcgtcgtcgcgtcggagcgagatcttgagcgacggtcagtcctgtactaacgtcaggactggggctgtacagctctgacattgtgtgtgtgaccatagttacgacatccctctcgagtaaaaacgcccatgcatagcatatagtaggactgtatgggagctttcaaccaggaagaatctatgtcaaaacagtccggtacacgcgcatttaaacacatcttaataccctgctaatcaaagtttcttgcgctacgctattaatcaaggtccattcttaccagcatttgtcgcctcatgcaaaaa

SEQ ID NO: 49279 - DNA, 859 bp, Oryza sativa
acccaaattagggttaaagccaacgtgactaccggcaaaattcccaccactaggtcctgcattcaaaccgaacccgttgttccatccatgtccattaccggcacttccaaaccaccttccaccttgaaaaaaatcctggcggccgccgcggccatcgaaccaacctcttccacgtccgcgaccccttccaccctgatgatttccgccgccaaaaccagggtgaaaccctcgagcagaaaattttccatagccccccacagcaggacgaccctgacggttgtttctctccatcggcagacgagcgacggcggcgtacgagaagggtagcgaccttacagattgatcattcaccctaactttgcgccgtatcgtaccagtttttgcgaagagagaaaccaagccagccgtgggcctgtatggtatgttgggctttggaaaagcaaggccctttggactgtttgtgatcgattcaaaatttgacatcaccggaagttttggaaaacattccaaactagtcaccgtcgggtgagaacccgagtcagaagacatcaccgaagacgaaacaactttttgaatcaaaacattcgccggacgagattggaatctcgccggagaagaagaagaaacagtggaaagaaaacccaatgataccttcccttgcagcgccaaagaaatagccgtacctaacgttcgagggggagacttccttggtaatgaaagcggcccgctccaaggcttcgaagcactctccagcgaagacacatgtggccacgtatcatcggcatgcaaggtctgcaaaacagaaaaacgggaaccagacgactcacaacatcatccagaagagaaacacctccagctg

SEQ ID NO: 49280 - DNA, 3177 bp, Oryza sativa
  unsure (1)..(3177): unsure at all n locations
gggcgaattcgagctcggtacccatttattttgaagatctgaattttttttgacaccgatctggttggcgtgttagcattgtcttgccatgccacctggctgatgtgataggacgttcgttgcgggtgatgtgtcagtgttgtattactcttttggaaataagttttgaaagtatttatttttaaactaaatgttgacgctttttcatggccaacacaaaatcacctaacgatttgcggtgtatgtaatcaacagagtcgccaaaatcgatagatcaaaatcggctagtgaaaccgatttcgagattaattcactttcgcggaatcaagcgactaatttacaagcaaattagtaaagaggataactatcgcacttacgtgatgatgaacgactagtttccgagcaaactagcaaaggataacctcctcgctttcgtggagaagcacgaccgtttttcagcgcaaaacggcaaagattaaccaaattctagggttgacagaactcagccatgaaaacaaaatagaataacaagaatgtaaagaagaggaaaatagtagattgaaattgtttggggggttctcaaactgatctaataccccactatatataggggcacctaaccaccggatgtgtaaatcctacattcatggaaactcttaattaacaaatcagctgctaccaaaaatgtatattccatagctgactttaccgcatagtcgcataatccagtccgcacacacgattctgccttggttgcagagccaagcagcagtgtacgtaagtgcatcaatttccatcgcttgtccagcacagcagctctcaacaaactgaaatacatatttcctcgctgcactccatcatgccatcaacccatcaactgatccatacatatcccaatgccagattaaatactatgatcacccaatgttttgcaagcatgatctagccgatgcaccgaagatccataagccaaattataccacaaacactaaaaaggttaaaaaaaataattaaaaaccgggtaatagtgtcctcgtcgcagaaggagcgagtccccttcatcatcggcagcatggcctccggtgccgccatggcagcggcagcgagaacgtcagcggacgcagtcgcgtcgtcgtgacgatgacatgggctacgcgcgccgggcagaaactgactcctgcactgcacatcgtggttgtcgatgaggaggtaggggatctcacacatgagctagctccttcgtgatctcggcgatggcacacgcttcgtctttcccggcgcccccacgatcgagccagagatgcaggagtacgttggcctgcatggcccctgaaagggggcttttaacttaggcctgatatgcgtgtgactcctgaaagcccactttggcctgatagcagagtataatcaggagttgggtacccacgggccacggacactttcacagtcctactcggtccttgactccttatatatgttttacggaattgctaaatggccttcaaccaaaaaaaatcgagaggatttcttacagcttttaaaccaccccatttgcttgaacattcgtgcgtccaacttcttctccagctccagcgatcgttacctgacgagttaggatatagggtttagggtggggtgaattaggggatggtgagttcagattggagtactaattagttagtaatgattttggcaatcatttttcctgacttcgcccctcatttgtttggaggagacgtagggttcatccattgttaacaacctgtcaatgtagcgtcaccattgacaacttgctaagagagcaccaacgtgaaaggatcttattgttgaggcttcaaccgatgggaactagtggtggactagctctatggaattgtgtgcgtatgaaaaaaaaatataatctggaggtttctcacagtcaccggagcatgagggagggaggagtgggcgggggaatgaatgtggtgagcaaggagaatccaaggataaatatgcaaacaatgtgagggtttttataaaaaaattcctatgcggaatttgtgtgcttcaatctaggctgcaagatctcttatcggcaagattatggaacaactttgtttggattgctaccattcttagcgatcataatctataaataaaatcccttcatttgggaggaattttaccatccagcaagctgaagcggtaccaaatctaggtcattggctagtccaaatcgaacggttcatagaactcgatactgccaggtaccaatttaggctttgggatggtaccgtagaataaaagagacgtagaagggcaggttcatattttcacgttgcaaattttgctggttcaatctaaggttgatggaggataaggcaaaatcccgagcgccgccgccactctcatcgtggaatcgctgcattaccgtcgcctcgtccccgcacgagctatgccctcccctgtcctgctacttggttgtgcctccaccttcattggctgcccacgtccaccgttgtccactcggggcttgccgcctctaggggagacctcctccctgccagcgagccggaggccgtgatgggtggcagtctcgccatatcccctcactgtcgtccaagtccaaatccttgcctcgtctagatctcccgacctcctcctcctcctccctcctcccctccgatatacagcgcaggcggcgaccgtgggagtaggagacagcgacaggccttctccgcccatcttcaatttgtttccaatcttgcccctagtaattcaatggttggatttcatttagtacctgatagtactagtacctcgaggtactatctgctggacagtaacaaacctcttcatttggactgccaccacttaccagcactccaggagcaacagtcattcttttcccaaacagacccctactactcgttatttctgcttcatatctaatcagatccgggatcgcatgcctcatgtcagctttgtttcggtgtggcacatatcaagcgacaatgcctgatcctgctaagtgcttcatcgcactctcgatccatgatcatatcaagacatgacgctactgcaaaaaataattttaatgaacactcccttttgttttttacaagnnnnnnnnnnnnnnnnnnnnnnnnnnnnnnnnnnnnnnnnnnnnnnnnnnnnnnnnnnnnnnnnnnnnnnnnn

SEQ ID NO: 49281 - DNA, 781 bp, Oryza sativa
gtggtccggcaacgccagcgcgagctcgcagaacttggcgggcttcaggttggcgtcggacgcgatctcggcgaggtagctgtcgaccagcttgccgacgtgcaccatggccacggcggacggccgcgacagcgtcgtggctcccggcgccggcgcctactcggtgatcgcagcggcccccaaggtcgacgcctggccctcgccgtggtcctcctcctcggcgaggaagtgcctgaccacgcgctggacgcagtccacgtcgtagagcgtctccgtggcgccggagtagctcgggatgagcacgtcctccagcgtggcgtgctccagctgcgtcgcggccttccgctcgagcgccgcgcacgccgcgtccgacgcgcgcaggatgtgcgccgtccgcagcagcgcgaacaggaacttggcggtgacgacgcgccccgagcacttgtcggcggggaggctggcgaccaccgcctccaggaggtccctctgctccacctccgacgacaccggcgccgacgcgagccgccgccgcatcgacctcgacaggccggggatggtgcccctggcgtacgacacgaggcagctctccctggcctccgtcctcacgtcggcgcgcgcggccatggccgccatcacccgcttgtacatgtgcagcccgaggacggcgaggtcgtctaaccaggagcgcgacgcggccgacgagcgcgcggcgatggcctccacgcagcggccgacaatgccgagctcctcggcgtgcggcagcagctcctcgcaggacttg

SEQ ID NO: 49282 - DNA, 1808 bp, Oryza sativa
ttttgccgatcgatacaacgacacgagagagacgagtgaaaagaaaacggtaatacacactctattccagaaaaaaaaaataacttttgaaaataattctagataaattcataaattatactaccagtattattaagggtaaattgagataaattagtaatttacttttataattagaagttactttgtcatttaagttttttcacagctaaatcgatcattgatagtctattacactagtatcgctcatatttcatcaaaaaaggcaaaaaaaaaagtttattcactgctaaatgatgattatacccttcgcatctattttttctaacaataatgcccctccatatttctactaccactaactagggttgtagtataaataaatctaaaccctttgattaaataagatgtttaaattaatttttattataacttgagagcacctcagtgaggctcataaataaatgtttgttcggattcatttttaaaagttagtttatttttaaaccaagggagtaagtcggtgtagctactgctgcctcttttccgttccctgcgtgcatgatgattaatttgtttgtttgttcggggtttggtgcagcgtcagtgtcatcctcagatatgacgatgtttttcaggctctctgatcttatgctagctgatcgaatgatgattgtattattaagggagtggttagttgtgcattggtaattatagccttgcacttatttgtgtcagtggcaggtgccggctggatataacaacggccatctaatcccttggctccggtcatgcacctgcaggtttggggtttggacagatcgatcggaatatcggatgcagggagggcataagcatgtgattccaggcttccagctacgatgctgtactgtactgttccgttttttctttcagaaaacaaaattttgctgtactgttctgcatgcagactgtcacaagatctgagctagagctggactgcttcagagttcgattttcctatttgtggtcctctggagagttggacggtccattagtgtatctagaatgggctgggctgtgaagtgatgattcaacagtagagatggccccttcttatgggccaaatttgatcgcccatttttcttttttgtcaaatctttttttttcttttgaaccgaactttgttgttaaatctgacagactgttcattagggaatcatgcattctccatcatgaagttacaagtagaagtgtgaagtatgtataaaaaggataaaccaaatcgaaacataactgagcataagttttgcattgaacatcacaataaactgggaatactacatatgaataagcacccgatgaacttttttggtgctaatcttcaaagagggtaattaacaatcctctaacgtcaacctataaaaacagtttgaaattatccccttttattggttcccaattaatcttgatttcaatcgatccttaagatgaataccaagtcgcggcttcaactagtacacatcagatatatgagcatgtatcaaaaattccccccggccactttctgaaagcaaacttacctatatacgctcttcatttctaccacttgccgttgcagcttcagatgttcatggccagaaatgatgttgatgctattcatttcatacttgtcttcatcacagtatatataggacgtgtaacaaacaaaacccagcaatttccttcaattcgctcaaaccgttagccatcagagaggttcatgacgttgatctgcccaattgtaaggtgaaaatttcttcttggaactgatcaaaatggtgcattgg

SEQ ID NO: 49283 - DNA, 2928 bp, Oryza sativa
  unsure (1)..(2928): unsure at all n locations
agaactggaggtttgggtcggagtgcggcgccggaaacggcaggttcgacgggtgcgagcgcgggaggccgccgccggccccttcgccgtcgctatctctcatcagcttcgagctcttggccggcgtcccgttcgcggcgaggcggcggagatgagggggggaagaagagagaactgcgagaggtgtgggagagcgttgggtgtgtatgtgtggaggggaggggagtgtgaggcgacgagaaaatggcgggaagcgagaaaagtgttgagaccgttgcgaggttggggcggggaagaaacggtgggccccacttccctcggattgctccctttcgtcggtttaggaggctaaccaaacttagaaaatgctattttgcctgattaaaatgtttagtataagaaaataggagaaaggcatcaagaatagcctcagtttactgacagttcacatcattcagttatgacctgagatgagttctattggcttgattcacattcactagtggtttgctctttgttcatattgttgccatcagtttacagacaatttaaatcacttaatggtttgttagacattaatccaacttattaagtcttcagataatgttcatcaaaggattttcggtaattcagtcctttcaattcaaaacatggtagatatatggaggatttgcttgaaaatgctacacaaccatatgcttccttattctttattaggaactgaaagggaaattacacaacgaattcatcctccatgacacctccgggtgtaggtgtcatggcaattattgaaagtaaaatactaccggtaaagaccaccgtaaaactactcttgtccacgctggcgcctccgtggagcagcctcatctgatgagatggagatcagatggagatgctgttggggatgcccctggcggagaggccggcagcgtcgcccttgaggtcggaggtgtttgggtagagcagcgtgtaggggaaattggtcggcccgacacggttcttgcggtgggggtccttgttcatggcgacgacgcggctctcgatctccgtcagccgcgcgccgaaccgcttgaacgcctccagcgccttggcgtccgacgtccactccggcgtgtcgcgctgtccgaggtacacctcgtcggaggagtgcttggacaggatctccagcagcgagatccccacgatggcctgcatctgcttggtgattgtccggacgaacaccttctccggatcgcgcgccagctcgtcgtactccttcgttcccggctccggcatcggccgccggctcaccgacggacggttcgggaggtacccggcgtacgggtactgcccgaagttgacggcggcgtgcagcgcggacccgatccagatgatggtggcgcacgccttgaccagctccgccaccgtcttcatctccggccaccacgtcgcgtccttgatgtcgccatgcccgacctcgcggacctccttccaccacgcctgcagctcggcgtcgccctggagcacgccgtcgttggggtagtagatggcgaggtactcggtggcccactgctcgatggcgtgccagacggccagcccgtcgttggcgtacgggtagtcctcgatgagcagccgcaccttgtacgggctcgccgggtccggcaccgcgacgccgcgcttgacaaggtcgtcggggagcgcctggtcggcgaagctccagtccttgtagaacgccgacgacatggcgagcgcgtgcttccgcgggaacacggtcatctcgaagatgccgccgccgttgatgagcgtctgccgcgccagcgcgttgatggtcatggtgtcgcggtagtgcggcagcagcagcttgtgcaccgggtgcgccacgctgagctgccggttggtggcgatgacgaagggctccatcacggcgtgcgtgttgagccagtggctgatcagctggtgccagcagtagtcgttcacgttgacgtacgccttggcgagctgccacacccaccactccacggcgccggcgccggtgccgccgcgcgccgccggcgtgtacacggtgctcctggcggtgatcagcccgtcgtcctgcaggtgcggcaagctcagctcgatggcgagcggcgccagcgtgccgtcgccgcgcaggaacagcagcgtccgcgtggcgtagatgaagttgtcgtcgaggctattgatatccaacaagtagggcatgaaatgatcgtggtggtccaccacgtagagaaggttgccgtcgatcgcctgctgcacggtgagcccctcgagcccgcgctcgacgtgcgccgccgtgatggtgctcgtctggtcgccgtacctggccgggtcgaggcggctccgcggcgggaactcggtgaggcgggcgatgaccatggggttgacgccggcgaggatctcgcgggcgaactcgtcgtcggtcatccacgccttcttgtcctcccggatgacgtgcggcatggggagcttgaggaggtagtcgccgccggcggggatgaggtccttgacgagctggagagggaagcgcttgcggagctcctccagcgccgggatgctgggcagcttgaggccgccctcgtagagcttgaggatgtccttgaaggagtcgaactcgccgggtgtgaggtcgacgtaggtgcggatcgccggcacgatgccgtcgacgagcgccttgatggagtagcccaggaagtcggccatcttcaggtgcccgaaccgctcgtcgcgtggcacgtagatgttctccagcaatgacagcctgctctccgcggtggggtctacaaagttacatgtcccacatgtcagcgaatgattttttagtattcaacaatatagtagtgcgatattttctaatataaaatttagtacannnnnnnnnnnnnnnnnnnnnnnnnnnnnnnnnnnnnnnnnnnnnnnnnnnnnnnnnnn

SEQ ID NO: 49284 - DNA, 780 bp, Oryza sativa
ccaacatctttggaataattaatctctcactaccaaccaatgcaaagcttcagttttagagcagcagagtgcagtgctcagtgctcggtagctagtagtagtagtgaatatgagtgtgtgtgagttgtacgagcaaactgggccgctattaatagagaagaaggcgagcgatcgaacgactgaacgagaggctgatcgatttgaatattgtttaaggtgcacaagatatttgcgatcgatatgtacgtgaaaagcgtgcgtgtgggtcgcgcgcgcgcgcacatgctttgcttgcatgggcgccattgcggcgtgctttcttttgccttggccccgcgcgcgggcgggcgggcggacgtggcggcttcgtcgtcgtcggactcggatcgcgaggacgaggagtaccgcgtacgtggttgattcatccggccgtgctagagagattagagctttcgcgcacatatttcttcacgtgtaccgtgtacgcataccgtgttcaacaatgctccgatcaagctttcgcacacatttttctctatgtcacgcggatgacgtcgattgcatgacgtatatctaagtttttctagtacggtaagtcccgaaagacggatttcaattccttttcgaaagagatgtctcaccgcttgatgtagatgcacgtacgcttccattcacttatcgaatacaatgttgatatcctttacattctcccagatctcactgccagcatgcaatgaactttggacgtgatccgtctttcatcgtctcgtaggaatctct

SEQ ID NO: 49285 - DNA, 4606 bp, Oryza sativa
gacggcgtgtaccgcgccgtggacatctacctcaaggcgcacccgcggctggcggcggaggagagggacagggtgtgcggcgtggtggactgcagaaagctgacggtggaggcgtgcacgcacgcggcgcaaaacgagcgcctcccgctgcgcgcggggctgcaggtgctcttcttcgagcagctgcagcttcgccgcgccatcaccggcacgctgctgtcatccgccggcgccggggccacgcagacgcggctccacctccaccgctaccagcagccacggccggcggcgatggcggcccggcactccgccgacgccggcggcggccgcggcgaggcggcgtggcggtcgacggcgacgcaggacagccaggtgctgcggctggacatggacagcatgaggaaccgggtgcaggacctggagcgggagtgctccagcatgaggagggccatcaagaagatcgatggccgcagcgccgcggcgtcgccgcgccacagcgacgccggagacgacgacgccgcgtcggccgacgggtcgtcgaggccggcgaactggcggtcgcggtacggatgcaagttcagcacgcaggtgtgcgactcgcacgcgcgcaacgtcgtggcgtcgagagcgtcacggatgggaatgagcccataggcgaatcgtctgaattctgaacaaaaaatcgatgctcgagatgaaaatgatttgagaaatcatccaacgtttccaatcgaagatccagccagaaatcgccccatctgtatgatttcgcacgcttacgttgcatcgctcgtgtgcacgaacgccactgccattcgacacggaacataagggatccgtgtgtgttgtgtgtatgtacgaaatgccattttgtagcctgtcatctgttacgtttcatgtgtgcttgtcgacttgctgtttggacaaaagcagtcgcgtagatttgagttgtcagggtgtacaatacacgtgcaggtgttgccggcctcagaaagcacaagctacaaagttggatttacccttcgatccgtacatgaaatggatcttgtgccgtaaatagatccagtagaaatgtacagattgttgataacttgatatcgtcgtttttttttcctctggtgttctgaagatgaaggaacaaatgactctccaccctgagaagcatgcaaactgagagctgagcaaaatgggttggagcatggtccatggatggaattgcttcattaacatgccttctgtgttagctgtgtcactctgcatggtggcattatctctaccattcgattggactaactaaattgtaaactgaatcttttggtcatcgtaaagcctgaaatgtagcagaaagtaggcactctcgatctactttgcctgcacagtccacttctctacaatattcttgtactacaagtatttggtatagtgctatacttataacttatctggcatttctggcttattttgcaccgccactgatcgtgctccaaatgcatctgccgggttggcagatgtcccaactcccaaacacactccagcaacttttattttcctctcgagtgcccaaacctttgtgactgccttttcagtgctctgccgcaatctacttttgttgaaatgcactcttcagatataaaaacatgtaaacaatagtctgttggtgctatgtggcataatatatcacgacagatgggagacataccggtaaacaacgatgctttacccaacactcatgagccctaaacagataatgttagaatacagattgactttaaacggcatcatggattcatggctgtctgcgtttgttgtcggagaagcagcagaagaagttcagcgcatgattttgttcgttatgtggcttcaaaattcgaatccatggcctgctcccggactgttggcaatgccaagcccatgggccatggctattgggctaagaagctagcttagaacttttcttttcacttgcttcggtccatcccttgtgaggcaaaaagtaatggcttgtgtagttcaattcctgttggaatcgagagagaaaatttccacattccaaaggaggcttcagttgtgtaattcaacgaagtaggggatgtgctcctgcatattccagttatcctgtatattctgaactccaaatacggggtacttggagttccctccaggccactaataatacttcctccgtttcacaatgtaagactttttaacactacccatatttatatgaatattaatgaatctagacacatatgaatatttagatttattcacatctttattcacatctttatgaatatggataattcttaaaagtcttacattgtaaaacagagggagtacgagggcgaagacgaagctgtacgtgctgctgtttcagtttgtgtgtgcaactatgcatttttttttgtctgacgaaaccaacggcagcaggaggagttcagaactttgatgacctgacctactccctccattctacaataaacctcgtactagaatgttagaatgtgacacacgctaatagagtactctctctatttcacaatataagtcattttagcatttcttacatttatattgactagcaaaagtgcccgtgcgttgcaccgggtgattacggagtgtgtacactgacaaaaagtgttgtttggtttagacaactaatctgctaaaaaaattgtttgtttttggataaactagctgggtggcccacgcaattgcgcggctagcaccgatacagaattatctatttttaatatgattttatttataatttattcaatagatatttcattgtcttaagacattgaaagaccaaatcatatcatcccccatatttctaattttgtaacttttataaaaatcacatcagtgctaccccttacttttttgtcatcctttctttatttgtttgctcgatctaccatggcttatattcattctccttttaaaattggatattttagttttttgagtttattgtcttattgggttttatttttttatttttagaagtcccattaaaagctgccaatatacttctctacggcccatccgctgcttcctctctttattgtcattgggattttaaggggatcctccatagtcgacctgcaggcatgcaatttttactttctagagtcccaccaaaccgtctgtactcctctacggctcgcccgcttattcccactctttattatatttgagattttaaaattgaatgtgattatcattgaggtttgtttttttttacttttttagaaatcccgccaccgtcgtgaccgtgctgcttaacggcatgtccgtcgtcactccttttaattgtcattaggattctatttggggttttgttaatagtttttagatgttccatcagctgtcaccactctactcctttacagcccggttacttcttcgatatttattgtcatttatcattgttgtgttctagatgattttttttgaaatttccatatttttcatcccgatagattttatttataaattatattcctagttgtttttattctattttcagaatttattttattaattatttggaattttaattaatctcgttatgtgttccagatggtgtattctttaaatagtctttattttttattatgaattttagttatttttaaattgcattccaagttgaactcttcttttatttccttatttctaatttcagattttattttatttttttattttaaattttaattaatctcgtattgggttcttatatatggacttgtatgaaatgagggcactatattatttttctgctgctgcagcctaagcgtgctggcctggtatctccaccctatatatgtgcggcaatgtatgttggtttagaatcataactctctatactgtacaattctgcaattgatttttctaaacggacatggactcctagtgcggattgtatgatctataattagattgatatgattatcttttgtacagtaaatctagaccattattcttttagtaatttcaaatttgtattcctactcgaactctcttttttcttttttttctaatttcagcaatttatttatttattattctgaattttaattaatcacgtattgggttcttatatggactcctctttcaatattgcttatttttaattccgaatttcagttatttttcagattgtatttctatttggactctttttttctttttctccgattaatgcgggaatttctagcctccacagtgaacgtggtgccttcttttcgagctgtcttaataatataaaagataatctgctatatatttgcggaatatatatgatgtttagtttggatgatttgtagcatgagagaaaatggatggacgaacaatgcgactgtctttgcctaaaaggcgacggatggaaatttgtatgatgaacggaacggagtgtggacagtaaccaaaaagtatattagataatcaggatttagtttttcatgatatgagcccttcaaaaaaaatatatttttagaaattaaaagttgtaaatcaaaaaagaaaaaaaatgcccattagccctgacttttctggctcaagtgagcgaaccatgagtccatgatggcaaccactc

SEQ ID NO: 49286 - DNA, 1112 bp, Oryza sativa
tttacttgtggggcataataacaattaataagatagtacacaagttattttttaactgtgtcttgaaaaatggcaagcatataaagcacgtttttcaacgccctcaacaggatatgagtgggtgagaatatatagtatgtacagtaaaaaggtactgttaaggacttttgatcaattgaaaaataactcattttcggatagccaacatttgtcacacgatggcattgctcaagtctttaatacatattgatataaactcctgacagatataagacatgcgcatgaaaacaagcaaaatggatggttagataaaagtttcactaaattgttacagttgttgataaatattctttcagtgggtaatatataaattgccggaaacaacataccaaacgaagaagattatatgtccctttggtcttgaaatacataaaattcatacttatcagaatgattgcatactttacttgggtgagtatacagatttggatcaatgttcagtgtgcaaggcatctcagtataagtgtgaagatgatgatggtggaactaaaaaaaatgtaccaagtgaagaagattatatgcccccttggtcttcaaatacagaaaattcacacttatcgaaatgattccatattgtatcgggtgagtatgcatatttggatcaatgtgatggtggaactaatggtacagtgaaagaagaaaaaaatgcctcagaaggtggtgtgatattttcaattgtctctcgtttggaacgtttgtttgcaaacaagaaacatgctcaactaatatgttggcaccacaaagggcgtaaaagggatggaatggaataataagacacccaactgagggatcttaatggagaaagatagataggaagtatataaaacatttgtgtatgacaagaggaatgtccggattgtactcaacacagagagcatgaatccatttggtgacatgagacgtcgccataacgcatagccagatattgttattatctacaacattcctctttgacactgtttgaactgcaaatacatcattaattcatgatgccatttctaatttaagggcctaaataacttgagaacaatattaatgtgtacttcgagcca

SEQ ID NO: 49287 - DNA, 791 bp, Oryza sativa
ttgttgtaagtatttgattaagaaaaaaattaaataacttataatatgaaatataacggagggagtactaggctgtgtttagttcagcgcaaagtttaaattttggttgaaattggagatgatgtgactgaaaagttgtgtgtgtatgacatgtgatgtgatggaaaagaattgaagtttggatctaaacacaactttagttgtaggttgtgattaaacaattattacactgacgtacagttccacgataatttagggcctattcagcaagcgccgcggctgtgcacagtgaatgtggcactgttcatgccggcagtcgcagcctgggcagcccaacaggcccttagttactaaatgaaattgtgtatattttgttgagataataatgagtgctatctgtaaacgaaatggcaaagaaaccggaaactgtacaagcaaaacggagtaactctggtaattcgctaagttacagcaggttattatcaatctcaatcaaatgataccaggtttatgatcacacgcatcagaagggaacaggagaaacgatcgaccgaggagactggagagtcgctgtaccgaaagaaaaagttgagtttgatctccagctctgcacgcgaacgggagagagagagagagagagagagagcagacagctccaaactcagttgacgaaagatctccaccgctgcgacagtggagagaaacagaagccgttccagaaacgccgacgaaaatgctcgggcgccgttcgttcggtcacttgttccgccctctgctcggaacgatcgacc

SEQ ID NO: 49288 - DNA, 1091 bp, Oryza sativa
gacgctataaacgtgtggtgtgttggttgttttttttttcatggctatatcctccaagggttgtagtgctgttctgataatacgaaacgcagtactatgttgtttattaaaaagaagcacatatctgattgtgaatgctcgctcgcacatttgtcatcgacttcggtattgtctgattgtctccgagcgactgggcgagagatgtagcggttggcgcaccaaccattgtccattgaacctgccaaccacgcctcggcgtcttctctcctcttctctcgccccgttaacttcagggagcgctacttgtacacggatgatcgacaagtcggaactactccttcacaagtcagaatttcgtactaccatttggcagcgattcgactactcctagttgcatacttgcaaccgagaggtacagtactcttctagctacagtatagcgagtgctactactccagactgcttctacttctctgtacttgcagggggtgcattgtggccgatacattcgtccaggttcagcgtgttgagcagatacgttcggtttagcattccagctgctagctccaagtcgccaacaccttgtcgtctcatcgtttgtcatctggtcaggtcgtcaagtcctgaactactgctgccgttggttttcgttcagacactgcatagctgcatactggcttgtcccaaaaagaatcaaaccttgtgtgtgacccagagtttgatttttttttatggaggggtacacaactgactatcgaccgagggtgtgtttagttcgtgaaaagaaaatttttaagtgtcacattagacgtttgatcagatatcagaaggggttttcggacacgaatgaaaaaactaatttcataactggcttggaaaccgcgagacgaatttattaagcctaattaatccgtcattagtatatgtgggttaatatagcacttatgactaattatggactaattaggctcaaaaaattcgtctcgcgattttcatacaaactgtgcaattagttttttctttttatctatatttaatactttatacatgtgttcaaagatacgatgtgatatttttgaaaaaaaaatttg

SEQ ID NO: 49289 - DNA, 3222 bp, Oryza sativa
agctcctgttgcgagagaaaaaatagaaccaagagatcttcaaaacgacgcctccaaaaaaaacgacgccaagaacaccaccactacctgtcccggagagcaaggacatgattttcacttgaaaaaagtaactggagagacaagaatatgtaacaacgctccaagaggaaagcggcacccacatgcgttattgttgctaccccgaagatagagcattcgcccataattatttcatcattcccaagaaataagctcctgcacactccgctgccaccaccgtcgaaagccttcgacgcacagccaccgcatcggcgccacgttgccggccgaccgtcataaaggagctcgacccctgacacgctccagctccatccacgtagttgggttggatgaggagagggtgagagagaagaatggatctcctctctcccacactagcccgttcgacgtggtcatcttttgtcggcaaaaggcgccgttgccagaggacaaatatctagactggggcccgtcgtagaatcgcagctccccctgatggtgtacccgccgactccgccatgatctagttgcccgcgtcacctcggggcaccataccgcgtctatgctgatgacaccatccgtcacagcgcttccgatgtcatgttaggccggaattaatctctatctcgaactccgtttcgattccttcttctctaaatttggtcattaacatttctttgacgtggaattggtactggcagtactacttttcatgttgaaaacatcgtagtgttgtatcagttgtaggtgtagttaaccgatgattatccaaacggtaatggaaattcccaaccgattgagcatagttttttttttaaaaaaaaagtggtgccgttttcaactgttttttttattctggccatgtgtaaaatttgttgcaaatatcacagtgatgtactagttgttcgttgttgtggttatgtgattattgcagtgacgccctgttccacgacaattagttattactggatgaaattgtatataatttttttgagataataatgaatgcaatctgtaaaatggcaaagaaatcggaaactttacaagcaaaggtgtactgaatatatgatatatgggagttacagattatactgcaggttatcaatctcgaccaaatgataccaatgtgcagctgaaggggacagaagaaacgatcaatcgaggagaccgtagagtagagtcgctgtatcgaaagaaaaagttgagtttgatctccagccccgcacgcgaacggaaaaaggagcagaaaaccccaaactgagatgacgaaagatctccccgccgctgcgtcgtccgtccgtccgtccatctgaacgtagctcacattgttgcgttagttccagctggttcacagccgctctcctccgttcaaacagctgttttttacaaaagttttatatacgaaagttatttaaatattatgtcatttttctaaaaaataatatacacttaattaatcacatgtgaatggatcatttcgtttttcccaatccaatccagggaaacgaacgcagctgctgggatcggaatgaacgcagccgctcggaatgatcggccgcacgcgtgggcgtgtgtgacttgacgaggatgtgtagtgtagcgtcgcaggtaacaggaggcggacgtgtgcggctcccggccggcttacgccgaggccggcacggcggcgcacgtgaggcaaacaccggccgctcgttgaaggcggtgcgtgctctatgacgtcgccgtctccgcgtgtgcctctgaagttctcaactctggcacgtgtacggtgcaccctgcgtcgatcacatggtccattggctccagccgacgatttccatcagaaaactgtttgtgttctacaacgtggtaacagatcagaaccgtaggagcacgtagaatttttctttttttagaaaaatacgagtgatattacagtttttaggaggtatcgaaagttgctatattttcgaatgtaaaatttgtataaaaaaaaggtgtagctatatttatggcgccatatttttcacctaaaaatagtcggcgtgtatttacattgtaagtctctaaattacatatgtaaatttagtgtatttataatgtaagttttaaaattacatatgtaagtctcaaaattacatagtaattatatgtgtaagtgggatgtaagcggggtataaattgtgttaaagaaaaggatgcatacatgtagcatgaaattaggtgacgtttcacttggatttgcatgactttagagattagctagcaatagcatatgctttcaggtctcttcgcgaggaaaaagtcagtatggaagcacggatcttaaacacagatccaacggccagataaccgactgtaatcaacgaaaaaaatctgtcgacataattatagcaaatccgaaaaaaatggtacgtcttagtatctctcgcgaactgtaaaatttctttaaaaatattccttttcaccggtttcataggaatacgcatgtttcaaagaaattgtcacagatatatcgttatcgtatagcgagaataagaactcacgacgagttcgcacagtgagtacacaaactcgcgatgtttgcgaggaatagcgggaacgatccgcgccaccacgaactcgagagcgagatcgctgagcgaactcgtgagtactcgtgcatgctagtctcttctggtttgctgctaccacaagttcacatttttagaccattcacggtgcgccacaagaatttagtgtgcgtcacatgccacctagacctaagaacacccaagaactagatggatacatactccacggtgcgtactacttgcatactactttataaagggtcccacagtgtttcccatctcctctgtccttcttatctcttctttctcccctctttgctcttatctcttttctctcacctctctacgtctcccacagacggtgaggaatggtggcgatggggtggctggtggtgccggagacgggttgagcggaggccacggcgccgggcaacggggcgacctaaacggccgccgccgccctgctcgagtggtggcgacggctccgagccccggggcggcctgagcggagggcggcgacgactgtgccgggaggcggcgccagagacgggtcgagctcgccggctctgaaccggcgtcgacatcaagctcctatgcctctctcttctccagccggccgtgtaacatc

SEQ ID NO: 49290 - DNA, 4459 bp, Oryza sativa
tattacaaaagtaacatccaaacaccgagtgtagtttaaatgaattaaacacacccaataaaataaaagatcaactaagataaggagagcatatttattcaagtttatttggaatctctatccatagtttgcaaggaattgcatgaccgttgtctcaagcctacaacatgcaaccttcaataagctcgcgatcatcttcacacatttgcaactgtgcctaaaatcggagccaatatgttgccctggaaattacctgcatatatgagatagatgttgatttgtcaaaaaccatatcattcctagtcaaccacagagcccaatatatggcagaagctcctacaagtatgagtttgctcttcttcttgtctacccccaagagccaaccatcaaatatattagatatggtagtatgaagttataaaccaagagagaactgtactgctctccaaacaaattttgcataatgacactctataaaaagatgttgaatagtctcatttttcattaaaaaacatcatcttaaactgccattccaatttcgtcttgccaaattatccttggttagcacaacccctttaagcaagtaccacataaaaatcttaatcttaagtggcatcttaagcttccaaataatcttgtttctctcaatataaccattattaattaaagttagatacatcgacctaacagaaaatattccattctgatgataattccatctaaagctatcagaggattgattcaattgaatatgtacaatagaagcacacaattcatgccaatttgcaagattctgaccaactaatgatctcctaaagaaaacattgagtggaacagatctcataacattagcaatagtagaacttttccttcggacaatagagtataaagatggatatttgtctttaaaagccaggtttcctagccatttatcttcccagaaccttatttgtttcccattatttacaatccaagaatccatatctaagaaaatatctttgaccttcatgagacctgaccaaaaatgagaatcaccctgtttcttattaacttgggttataaactgattgtagagatactctcttcaatagattttaccatacaccttcctcgttaatcaacttaaacaaccacttactcaagagacacttgttttgtatttccaagttatgaacccctaaacctccctgatccttaggttgacaaatgatatcccatctagtaagtctatacttttttttatggttatccccttgccaaaagaatagtgatctataataatcaattttttgaagaacccctttcagtatctaaaaaaagatatcataaacatagttaaacttgaaagtacagagttaatcaaaaccagtctacccccaacagataaatgttttcctttccaactaagttttttctcaattcttttctcaatcattttccaatctctattattcagttttctaacatgcattggtataccaagatatttaacagggagagagccaaacttacaaccaaagatgttagaatactcatcataatattcctttgcctgaccaaaacaaaataattcactcttatgaaaatttgttttcaagccagacaactcttcaaacacagataaaatcaatttaagattcttcgcttgttgtaagtcatgttccaaaaaaatgatggtatcatctgcatactgtaaaatagataaaccatcatccactaggtgagggactaccccattcaatgaaccaacatctttatccctcttaattaataaggtaagcatatctgttactatattaaaaagaattggagataaaggatctccttgccttagacctttgtaagtttgaaaattattaccggtctgatcatttactctaataccaacatgtcccccttgaataaaagaagttatccactcacaccatttaggagagaaacctttcattctgagcatctgttgtacaaaagaccatttaaccttgtcataggctttttcaaaatcgatcttaaaaatcacagcacttttatttttgcgatgtaattcatgcatagtttcatgcaaaataacaacacattccataatatttctcccaggtataaaagcagtttgagtagggctaatcaccttttgagcaacactcattattctattcgtagcaactttggtaaagatcttaaaactaacattaagtaagcagataggcctatattgttgaattctcatggcctcagcacacttaggcaaaagaataatagtaccaaagttaagggagaataaaggcaaaagtaccattatgaaaatctctgaaaagatccaacatatcatccttaatgacatcccaaaagacctgataaaactcagcaggaaatccatcaggacccggagctttattatgttctatttggaaaatagcctctttaatttccttttcagtgaattattgtattaaagcttcattctctaattgagatacttgtgggatgtccacaaaattattttcatcaaactggagatcagaatcatcaggaggaccaaagaggcctttataataagtagtaatatgcgattttagatttgcatcaccatttatcaattgatccccatcttgaagttgaaaaattctggtttttctatgtttgccgttagcaaccaaatgaaaatactttgtatttgaatcaccctccaaaatatccttagttttagccctttgataccacttaatttcttcttctctcataagagtagataatctattcctacaaaaccatctaaaatcaatttcctcctgagttagaagaacagattcagcttttttatccaacaaatccaacctatccaaaatttccttttttttcttttttatacataccacttgtatgtttagcccatcctctcaaatgctgtcttaatcggggaatcttcgcctgccatcgctccataggagtattaccctcatgtacactagaccagacctccttttccatatctacaaagccatcatgtaataaccaaccaagttcaaatttaaaactatgttgtgcattacctgaagaggtggagtttgtatttaaaagaagtggagtatgatccaaaatatctctattaagagcaacccccgaggataaaggaaatttatgttcccactaaatggacatcaaaatcctatcaagtttctcataagttggatttgctaagttatttgcccaagtataaatcctacctaacatttgcaactccctaagacacagtctatcaataatagcattaaaaaaaagggccatctatcatcgtaactgccattatttttttcatcagggctacgtaaaatattaaaatcaccaccaatgagaattggtagggattcatgactgcacaaattaactaattcagcaagaaactgatccttaagttcattttgtgccggtctataaactaaaactaaagcccacttgaacttatcaactttgttacataaatggaacttaatataaaaatcaccttcatcaattaaaccaatatcaacgtttagtaaattgatgcctaacagaagacccccagacctacctctgggaggtttacaatgccacaaaaactccttaccagcacaaagatttttaagtgcagctagagtaaattctttcttaaccgtctcagacaatgctataaagtcaagctgatgttccttgggcaagtcagaaataaacttatgtttttttggtccttaaacccatcacaattccaaaagattcccttcatttgaaactatttttattatttttcttatttttcccccttttactctttttcttagagttaggagaaaatgccataggatttaaagtgtttttaagactattctcacagtcctcactaaaatccatgacctcttccataatttcactacataaatgttgtagtaaaaattatcctccaactggtcatctaatgactcagtatcaacattaggggtacaaacttgattaatagaagaacaagcatattcgcttatcctattattttctacacatttcaaatcattaattacatcatctaaaacaacatttttactagaaggtataacaccaagattatgatgatgtgcagatatttgatcatttgaaaaatgtgtaaaagaaacattattaactgaattacctctagcctgcaggttctccaagttcttaccagccttcaacttttcggccctttcaagaacaagctgatcgctatcacttgcccttcttttactcttccttgatggaaagattactgcctcagggatagcagagagctttgccacaagactttcctgaatctgggccttgtcacccattatagtctcttcatttaaaccatcaaatttttcatcagaaacagtcaagccatcagattcaggtattagatttagctgagaagagggagcagaaggaccacccctctcactaaattgaccac

SEQ ID NO: 49291 - DNA, 744 bp, Oryza sativa
caggctccttaggcccattttcaggttctactctaaaagacagctcatacaagtgatcaccaataaccacatccaccacatcaggaatcagagatgggtcaagaaccaaaacttgtaagcgagctatatcataccttctagtaaaattcatatcaacagctttagtaattccaaggatggaaccaacagcccaaatgattaaatactctctcaattcagaaggaagacttttgcactgtacccacacttttggcatcacatatttcacctcattcccaactcccctttccacaatctccatttcagcctcaccaactttagtgtgtacattgccccattcgaccatacgacttaattcagctgcagaaggaaaaatagtatgaaaagtcccatcaccattatcatgcaccacccacttccatctaccaggtattaacctctccaactcagaaataatagaactcacagacatctgtcctttagtgaccttaaccaaagccgctttaggctcatgcttaaccctcattccagctgaaagaggtatatggaagaaacccaaaccatctctagtataaccacgtaactgagcaacaggtttaacatatgaccaaaaaattgggcacgagaagcaacatgatcctcactttcacaattctcccagtaaaacctagaagaacattctggcattgtatgccctttaggataacatctataacaataaggtttgccttaccctttgacctc

SEQ ID NO: 49292 - DNA, 1665 bp, Oryza sativa
ggattaatcagcttcacttcagaactaactcttggtattaaatttagaaattgaagctttgctaaatagatcatgtatgcctctccctctcccgtccctacaatcatcatctcctttagacctttgctgctgatttgtttgctgccccctttgagagctaaggattctactgctaagcttcgacgccatttcctccgcttccaaaagctctggttagattaagcgccgctttcgcacgatcatgatcagcagcatcagcacgtgattcaattgctttcgccataaccattaactcgtgctgctgcaccaccaataggtacagtgtatcgctgattagctaggaggaattttttatggtacggcttaatgcaccgaagcagctagcaggagctagcaggactggacttttgttttttcacgcaaaaaatgatggttaaaaaaacaaaaggaaaaaaaactctaaattaattccaaagttaagcttatgcgccattctttttctgattatgatatatattttatctcagtttctgttagcatggtgttttatttgctaaatgatgcatttcgtacgaaaacattatatattaagttattttaaaaccttagataaatatatttttaaaatttataataattttaacttattaatcatgcgttaatggttttttaagagcaagtttaatagtataacccacaactagctccaatttatctatagctaatctaatagccaattcatacaataattgcttactatactattaatatatgttcccatctgtcatacacacactgtgtcttggagtccgtactacagctggctacagatctgtagtccgctcctcttctctctcattttttatctcattaaaatatgtttataacctgctattgtacctgctcttatactacctccatcacaaaattagttcattttttcacccgtcacacacatataccaatacaaaagtaaaaaagactaaaaacatctactttatctacttccgatacaattattctctatttttataaactttgatgcgatgatcactctaaaaataatcttattttgggataaataaaatgagctaaaaataaacttattttgaaacgaaggaatgtcctaaaacggcactgacaagtgggccccaccacggcatcgcgccacgcaagcagggatgtgcacacaactcaccgcgcactggtagcaaaatagactcgtagcaccctaggatgcgtgcacggtgtcacacacatttacgcgcgcgtactacaactactatagccccgctcccttgcaagctgtcctcaacaacctccaggttggcacgatcgcctcctcctcctcctttcgacactacccgacgcgacgcgtcctcctccccctcgcgtatatatacgcgcgaccgcacgccgcgctccacgcccaaccccgaccacgagtccccgaccgcggcgcgcgctcgggtcggctcacccaccgccgcgccgcgtccgacgacgacgacgagcattcaaactgtgagatgggggcgtgcaacttctgcgaggcgacagcggtggcggcggtgaacgggaggtcggcgtcgggggaggcgacggcggcgagggtggtgctggcggacggcgcgctgcggcggttcccgggtggcaccagggcgt

SEQ ID NO: 49293 - DNA, 3137 bp, Oryza sativa
agctcggtaccctgtgcagcgccgacgggctggagctcggggccgcggtggcggcggagggcggcggcgacgactaggagctccagcccgggcagctctacttcgtgctccccgccgctatgcggcggcgggcgctccaggcggaggagatggcggcgctcgctgtccgcgccagcgccgcgctggtgggcgaccacaaccggcccctcgtgttcccggaggccgccgcctccgccgccgatccccgcgccgccgggaaggggtgccgccggtcgaggacgaggcggcacagccgtggccgcgacttcgtgcccgatctcggcgccattgccgagtagcacttgaacccgccgtctcgaagagaaatcgatcgagctaaactagcccagccagctcgccgcggcgggaagaagaaaaaaaaaacattagattagttacgtgtaaactgatcgattgatcggaggagccattgaccaaattaagttaatttagctaggaggagaggagtgtagcttagctgtcatgctgtagcctgtagctgtaggtaagcacgcaccaagtgtatatacactacgtgtacatgcacaaccacgtatgtacatgtggctcgccacggtggttgagaaagccaaaaaaaaaaaaaaatctgcacttgattttcccgacccaacaatccgacgcctcaagcctggatccctgactcggggggcccacatcgtcagtgtcagcattcagcaagacccaattaacaggataactactgtgctgatcgcgtcggcatgtgatgtgagtcacccttggacgatcgagacggtgatacgatcatcaatctgtatctatctagcgtgtggtttggatttgttaatgactcggaaatggagacatagccgacgacgaggagaggcggaggcggcccgacacggggagacctttttctcggccgcgcgcgcgcgcgcgcccactgggatggggatgggatccgcggttgatggatgggtggttcgccgcgccgcgcgcgcgcgacgagcggcaacttgcagcttattttgcgaggcagctaaatgatcgatcgagctcggtgcttcggttgatcgatccgatcgggtgggcgcgcctaactcattccccaactgggccaagggagatacgcgttctgtacttctgtggcgtacgtgtgtacatgttaaggctagctgttaagggtcacgattctaacttacaaatctaactgtaagaaattagagtttgaagaagacatatgaagaatatagctctacttttctaattcattttgttaaagcattttagcttgaagtagcttggagctttaacaaacagaccatccaacctttccttcgttggttcccacgcgcatacttcataagcttgtgtgttttacgaaatttttctatagaaaagttggtttaaaatatcatactaatccaatttttttagaaaaaaagtcaatactttgttaaatatgtgttaatccactactttgttttcgtgcatagagaatgagttatcaactactacaaacgaacgcaacctagtcatatatagaaaaattaatcaaacaaaaagcaaatatttacaggtaaaacttttatatttatgtaatttgtggtttaaatacaaaaccttaactgcaaaatttaaatttctactagttgataagcttacggacagacaatgacatgccattaacatctttcaatataaatcctgtaatgctaaataaaaagcaaaaaagatattgctaggacaggactcagtatgtcagtcaacttcagccttagacttgtccaataaacgactgaagatgttgactaaatgtgttatacatctgatgagacttgactcaatttgttaggactctacaacatccgaattctttagaattcttagcaaattagataagccaacgaatctgatcgagtcaagtgggttaacctgcatgttggtgctgcagagataaaactgagataagtgcagtgcatatatgccttcgttctttgctgagctttatatattcgaacgagattacgtagctagtgttctcaaaatagattacatagctagacttgtgtttgcttcttacgcatgcccttttttttactccgtcacgtcctgatcgccacgcaggcgtatcacatatatccattggcggaagcgagtttcagcgcggggttttgtcggaatacattctattcccaaatcttttttcgtggacttgacggttcgaatcgatctcgaaccttgacgccacagtagcacacagaattgtggtcggcacttggcagggaaaatttcgcaaaataataaaataaaatccaatgatgtagctactgttaagctctaatgaactcactttgctaagctaaaaaagcctcgtctttcactcaggcttatgcttagcggtcaaaatttaatttttctttttttaaaccccgcggggtgtatttgtattaaagtagagggaaaaactgtacaatagcccagggggctaggagattacaataagaaaggaaaaagaaagcaggtggagggaggtgcagctacaaaggaggggtgcagctgatgagtctaatttacgtaatgtcggttatgcttccatggttgtgggtcgttagacattggatgccctttgccccgcttacacgctagagccagatctcgtcgatcgctttctcaacgattccctgcgtcgctgtctctatgttcttgaaaaccatgttatttctctctttccagatttcccaggatagtaggataaggatcgatttggcacccttccttttctccttaggcattgtactaacggtttgtgtccaccggtcctcaaggattgtcgttttagaccagttctgtggtcttagctgaggcatgccgagccttgttgctatggcatcccagattttccttgtgatcgggcattcataaaagaggtggtgtgccgtctcgaggtttctgaagcagagctgacagaagtagttatttggccactccctctgctgaagtcgatcggccgtccaaattctgttttggaggagtagccaggcaaagaatttgcacttcgatggtgcccaacatttccatatcatatttgctgataccgacggtatgccccctaggaa

SEQ ID NO: 49294 - DNA, 2976 bp, Oryza sativa
  unsure (1)..(2976): unsure at all n locations
actttgtcgatttcttgaatgatttgctttggtattttcagagctgtcatggcatagattggcatggagcttggtactgatagtactaactctcttcttcctcctgccgagaggagctttttcttccaactggctaatcgtgccttgattttgtcaattaggtattggcgatggacctttcggagcctgcttatcatgagtggcatccctaggtatcgcattgggaatgtcccgcgggggccagtaaagttgtgtagcatttcatcaaggtcaatttcaccacagctgattgggatcactgagcttttgtgaaggttaaccagaagtccagtagcactcccgaagttattcaagatcgaaatcaggctgtccacatcttgtcgtgatggtttgatgaagattgccgtgtcatcagcatatagggagcatctgaagcgtgcactgcggtccgctaggtcactgaggaggccctcatcagttgcaatcttgagtagtctatgtagggggtccatcgcaagaataaaaaggtatggggataggggatccccttgccttagccctctatggtgatcaattctttctccctcaatcccatttagtgcaaccctggaagaggaggttgagaggattaaagccacccagtctcgccatctagtactgaaccccattttttcaagcagcgttaggaggtactcccatgagaccgagtcgaaggccttggcaatatcgagcttgaagaatagggtgggctgcttggacctgtgcatcttcttagccaggttggagacatagaggaaattgtcctggatgcaccttgttatgatgaacgcactctgagcttgtgatatcactttgttaatttgtctggataggcggattgccaaaatctttgcaaggagcttcgctaaggagtgaattaagctgattggtctatagtcgcccatagtgcaagcatcattctttttggggatgaggatgagtgtcgctctgtttatactcccgaaatttcctcccgataaggagtggaatttgtcaagcaattccatgatgtctgacttgataacctcccagcaacatctgaagaaggtgcctgtgaagccgtctggcccaggtgccttctcagcaagcatccgtttgatagcttcccaaacatcctcctcggtgaagggggagtcaagatcttctggcgtcacctggggtaggtgaagctcctcccagtttagggtgcaagagcgagggagtcgctggcccatcagagaggagaagtgttcgtgtagggcacgctctttggcttcatgagtttctgggatgacgttgccacggtggagtttgtgaatgaagttcttccgatggcacgcattgactttcaagtggaaaaacttagtgtttgcatcaccctctttcagccatgttagtgtggatcgctgtcttctccttgccttctctacagcagcaagaccaagaatctgtagctttagatcttttctgagggagatctccaagggcgacaatgctctgttttcttgtgcaatgtccaaacggaggattagctcatttacgagatggaattggatgcgactgtcacttaggatgcgattgctccaggaccgtagagccttggctgtagctttcagcttggaactcaagcgcttgacagggtgagaagcgctaactggctgggaccaagccgtctggacggtgtcaaggaagcccggcggtcttggccaaaagttttcaaatctgaaagttggttttcgcagcagctggtgtgttggtgagagcaccagggggcagtggtcagagttggaggaagagagagcttgtaggttgtggttagagaagagcatatcgccatctgggttacaaaaaatccgatccaacttctcgagggttggggcatctctctcgttactccaagtgaatcgtctattttgcagtcttaattcacggagttcacatctatttatcgcagccttgaaccgccccatcaatcgacgatcaaggttgaggttattcttgtctcttgcctcataaatcaggttgaagtcccccataatcagccagggggtctgtcctgatggtgccacttcgcacatttcctggaggaagttttccttatcagcgtcatccgtcggtccatagacgttggtgaggaggaatgccgtgtttgaggaccgttgggtgagacggactgagagggagaaatttctgatgttgatatcactgtgctggaggatatcatccatcccaaaaggtagctgctcctccacggctcccatcagcaggaaggtagctgaaattattcagtcttggacccccaatttccgaacacattctttggtccatgattgccaattttgtatgttggaggcacatgatggatatgcggttggtggttgccacttcgcggattgcttctctttttgccgggtagtttagaccccgcacattccaacacatgatatgttcactaatcattgcacaacgagacaaccattctaaaaaggcagcgtcttataatctcagcatttgaaccaatacattgccacagcagtagccaaatactagttactatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49295 - DNA, 1720 bp, Oryza sativa
  unsure (1)..(1720): unsure at all n locations
atatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataattaggtatatactcacaatttaaaaattttgaaaaatttgagtgattttgtgcattagataccatggtgcccgggcaccatggtgccccatatgagtgtcatatatatatatatatatatatatatatatatatatatatatatatatatatatatatataaaagttttatttataaattatttttcgtttggcttcttccggataggtctctaggtttacgtgggatttttctggagggagacaccacaaattgcaacattagtactgttggattggatggatacttgtttggcatcgatcaggttggccacttggccacagtgacatgaaaaaggtgtactaatgacggacaaggacgtgacgtggacgcctggggggtcgtcattaactcgaggttaaagctcggaatagcatcgttgggtgacgaggcgatggacctctccgcgctgttcatgatatatttcaccgtcgctgactagtggccccccccccacccacagtctcgttccccttcgcctccggtctccatcccacccgcccgtgtgggggaccgtgtgcagtgcgacccattgggttcggactcgggctcgacatgattttggccggctgcggcgtcgatcgtccatcatcgcccatgccgtcgcgcggtatttgcgagatttgcccctcaacatgtggtaggatttgctccccggaatccggctaaaacctcccattaattgtcgagccatacgtgacgttgttcaagtgatgattcgtagttactctgaaaataatcaatttctgaaaataaatctggatgagtatctatctaattttacgtgtggaagttagtttttttttaatgaacgaaggaagtacattacagtttagtccgagccatctctttggttggcctgcttggcatttgcggtacgtgctgctacggtgtaaacgtaaacgtgaaggaatggaggttgcgagtgagtggtcccccgttcgggattgttgccggcggcgggcgcgccacgaggatcggtgcgtgaaatcgggagcggtctcgtcacttgttcctgcttgatcaattcaacaaaacgggagagagaggctgcagtgcagacggggcagggcttggctggcgtcgtcctcggccagctgcttgcgacctggaacccaattcaccggcagtggagcagcatatcaacctcctgtacgccttcctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49296 - DNA, 738 bp, Oryza sativa
agaagggaagccaggccggcgaggaagggaaaaaagacttgggctggaaacggcccaaaggacatggacggaattttaatttggtttttaatttaaataattgattaaatgaactttgtattattgaaattaccactcgagcactgaaaattcacgagaaatttcaaagagtactttatggccaactatgatttttaaagaaaaatttatttcccacattaattttactttataaattgcttttaattttaacataaattatagaaatgatgtactatttgatttttaacctcgaaagaaaatcaaggcataacattcattttcagaattttatagctacatgttcctagaatttgagtgacaatctatattacctggggagctagagatctttggagaagctcccataaacataacctttgtaaaactgaacaactctcgaaaagcgctcttaagcggtacctctatttctctataaaaaaccaaataccactgatgaagtatatattgctctcgtcctaaaattaaaaaaacaaagctttgttttttctaaaaaaaaagttccattttccaacttatattctctcattttttatgtgcatatttcccgaactgctaaatgatgttttttctctctctctctctatatatatatatatatagcatgtcaaaatgaaaagctatccccagaaaacaaagaaaacgaacttaggcttgattggctgaagctccatgtca

SEQ ID NO: 49297 - DNA, 958 bp, Oryza sativa
attcttagcccaagccagaatgcacgtgggccacaaaatttgatggcccagcatggatcgacgcccggtggcccatgttgcgcggtcgcgtcgccgccctccccccttctcccagacccagcgtggcggcgccgccggccgcccccacctcaccttccgccgcctttgcctcccgctttctccaagcgcggcagcgccgccgccgccgccgaaccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggaggagggggagtgcgcgacatggacgcgctggagggcgtgcgctcaatcgtgttgaagccctcggagtccctcgacgaggggcggttcacgaggatcgccggcgccgacttcaacgacgccggcctcggcctccccgggctgctcgcgtcgctcgccaccaccggattccaggcctccaacctcggcgacgccgtcgacgtcgtcaaccagatggtacgttactaattactgcaccctttgcagccttcctgccttttgcatgcccgtgagggaggcgaagcggatttgggggttactgtagcttgaaattgttgtgtttctagatccttggagtttcttaggaattgcaatttagacgaggcccattgctgtagctgtgttggtgtaattggagctgaagaggtgaagtcatgtgctgaatgatgcgatagatgtggttgctataaaatcggaaacttgcagcttattattcatgctaggattgacgctctactgatgattatctcgataattcctgtcagatga

SEQ ID NO: 49298 - DNA, 1541 bp, Oryza sativa
caaacattttgaaacggagggagtagttattttacaattacacttaggctgtgtttagttcacactgaagtttgaaagtttgattgaaattggtacgatgtgatagaaaaattgtgtgtgtatgaaatgtttgatgtgatggaaagttgaaagtttagaaaaaaaaactttagaactaaacagggccttacatgctagatttttggaagaaagttttaagacaaagctagcaactgctcgcgcggcggctgcgggcgggagcccacaccgtggcgcgcatcaaactcgcccgctaggatcttgcgtcggcgcgccgttggacacttggacttggaagactcagctagcagctggccgatggagagctggtcgctggctacttggctagctagccaatctctccctcctacttgcaagctgcctcctccgacatggaattttcctgagcgagaagacgaattgaaagggggaagcttgatgacttgatgggcactgggatgggatgttctgccgatcacaatccatcatttacgtcgtgcttgctttgattgtcaaacagtgccagacgatgactctgctgatcgatcgcttttaatttgtgatctccaggctgtatgtattactgtacactacagcgctcatgctctctgtagctctctcgtcttaaagtcagcttcaaatctacaactggataactgcttacagagtaactgagagtactgtgacagcaacaacatcgaactggaaattcaaggcgagattgttagaatttatatcagatatgtatatatacaaaattagatataaattaggacttgagtgttaaagatatagaagtagaattaagactcttaccctaagctctctcttaaatagagtggcgcataccacacataatgtaatcgtatgataatgatagcgtaagaaaaagaaataaatggccagcaacgtaatcagtggaaggtcattgataccttgatagttatagttaccatggatagaggaggagcatccgtaactagtgctctcggatgtacttcctccgtcccaaaaaaaggcaaaccctgagtttccgtgtctaactttgactgtccatcttatatgaaatttttttataattcgtattttcattgttgttagatgataaaatatgattaatattttatgcgtgacttgtctttttaatttttttcatattttttttcaaatcagacagatggtcaaacgttgggcacggaaaccagggtttgtctttttttgggacggagggagtaggtttcgtagtaactttgtgcatcgttgttgtcataaaatttgaattttctaagggatttttcctgtgtttggttgtggacgggagttttggtgccaattttatactccctccgtttcgaaatgtttgacgccattgacttttttaaacatgtttgaccgttcgtcttattcaaaaaatttaagtaattattaattattttcctatcatttgattcattgttaaatatatttctatgtaggcatataattttacatatttcacaaaa

SEQ ID NO: 49299 - DNA, 2143 bp, Oryza sativa
tccacggccatccccgcgagccccactgcgtgcgacgagcgaggcgggggcgctgcgggcgggcggatctgagggacacccaccgctgctcgccacccagtcgccgctcgctcccgccccctgcgccgcccttcctcgctgccgcctcgctgtagccgccgccgccgccagatgcagacggcgacacgctggcgcacggggatggaggcgcggagcatgggtgtcctccttggccacgacggcgacgccgacgcggaggccgtctcggcggcaccttcctcgatagccacgaccgccgccgtggcggccgacacggcgaagctcccctccatcgtggcggccgactacatctgtatgacaacaattaaacagacacaccataaaataagtatgccaagaagattgttttagagagaaacatcaaaaatgcattcgtagtgattacatgaaggctataccttcagcattggcaacaatgtttcccaggtcacccgcatgacggacttcatcttctggtgcaccgtgcgtcaaattgtttgggttaaaatgtggtcctgcaggacaaagttttgccatgtaatgtgagggtgtgtttggataatgggaaatgtgaggtgggattgagatttggaaatgaatgagggttaggattaaatgaaagagtgagaatgaatggttaggatttaaagatgtcttttagtggttgggaaatgatttccctgtcccattagctaaacagggcctaagtagacaggccttagggcacccgcaacgcgcttgcctcgcagcagccgcagccaccgccgccgatatatgcagacggcgacgcgctggcgcacagggatggcggccgacacggcgaagctcccctacttcctcgctgccgcctagcctgatcccctgccgcggccgccgttccgtgtcctcacctgcgccgcccttcctcgcagctgcatcggctcctccgccgcctgccgctgtggcgccgtgcgcgtttagagagtgagaggagagagatgaacacagagagagagaagagagggggggaataatgttataggggtatgacaggtgggtcccccatttttttaataactaaaatgctgactggattcccacgggtaccccaggtagcccaaaactcccgtggattggattgaggggggtaattcgtccggtttgcatagtttggggtaaaaaatatccggttttatggttcaggggtgtaattcggacaatacgatagttcggcaggtaattcgtacttttttccaaaatgaatcggaatggacaaacggaacgatatgcattcccctcccaagaaaaagcacacgcgcgcacacaatgaccgaagttgctaattagcattcgaatgatgcatcattgggtgcgttcgaatgggtgaattcatttggctaagttgtttcacgcaaaactagataagttattaactattataaactaaaaaaaattgttttggagttttttcataaaacgtatcatttaacagcttataaaatgtgtccatagaatacgataaagtagcttgccccgttatccgtaatgggaattgtttacaggactgcagctgctgtagcagccgctgacatgtgggaccaggtccacctatcagcctggcttctgcaaatacagtactgcaaaggatcatgtctcgttgcccgatgctgaatcaaacagactgcagtatacgcttccaccgtcccacgaaccaatgaagcatacgctcagtttcaagcttggacacgaaaaatgaagggcctcaaatcactcaaatcacccaattctcaacacttatatgcacactggtcagatgtattctgcatttctgccagcatcaaagccgagttgtattttccccggagaatgtaacgcggaaaaaaaaaagcccaacaattttgcacaaggtaaaaaagaaggagcaaaatattcgcccatgcacgcgcactagcccttggcgtgcgcaacgctcagctcaagccgcaacaccttcgccgcggccgcgccaccgaacagccgcggcgcgcacagcgcgcggagcacgccatccccgcccgcggcgaacgcgaagtcgcccgtgccgcccaccacccgcagcacctccgggtcaccgcactccccgcgc

SEQ ID NO: 49300 - DNA, 818 bp, Oryza sativa
  unsure (1)..(818): unsure at all n locations
cacgcggnnttttgagnaaccgtatannnnnnnnnnnnnnnnnnnnnnnnnnnnnnnnnnnnnnnnncttaattcaaaagtttcttccatcacaaccaaaaaaatatgacatcacagtgagtaggaaatgctaaattttaaaggtttgtttgccaaacttgttgcaatggtcattcatttcttttagtttgaatattccaacttgcatggcaggaaaaatgcatcttgaaactaaacgtacacaacaaaaatggtagaatcttaccaaagctaattcgttcctagtatcatttagttcatggtccagtatggtatactcaagtgatcttctttgtttgtccagctgctggtacttcttcatttcttctttctcttcatcaagttctctcaacctttcctccaagtagtggacaacttgatcaatctgctttcttttgttggctgctaataaatcatgaatcaatgtccacttacaagaggtcccctacaaatatataaacatttatgataacttaaacatgcctgtttcctgcatgattttcaaactctgtcgccgtctatcttcataaacgcgcgtaccaccgatctctttcaggagttccagtcgttcagaatctttcattagggtaagggctgcaatctactcataacaattttcattacattatagctgaacagcacatggcaacaatcaggtgaaaaaatattacctttccctgctgggcaacgtaatatggatttgagcgagaaaatccagcattnnnnnnnnnnnnnnnnnnnnnnnnnnnnnnnnnnnnnnnnnnnnaaatcatgaatcg

SEQ ID NO: 49301 - DNA, 750 bp, Oryza sativa
gtcgtccagaagaccactgattcgtgtggtcttggacgggccgtcgcctaaggcaacctccttgaccgggacctagtcgcatgtgatcatccgctgcctcggggtggctgggacggaggggctgagcctctcgtcgccacccgcgggcttggacgctgcggcgaggtggtccgcgcgctgctccatacaagcaagcgcgactttgaggtcgccatggacggtgatggggccaccggggcccggcatcttcatctgaagataggcgtagtggaccgccgccatgaacttcaccaacgcgggccttcccaggaccacgttgtagggcagactgaggtccgccacatcgaagttcacccgctccgtgcagaagttggcggaaccaccgaaagtgaccggaaggtcgatatgacccagcggccaagtgtgccccggcgtcacaccgatgatcggctgggatggccggagcaccatccccggggccttgatggcgtcaaaggctgcaggggaaaggatgttgagggctgcacccccatctatgaggacacgccccaacttcacattggaaacggtgggggaaaccaccatcgcgatctgtcctccccgggcaacgcacggcgggtggtcggtctggtcgaaggtgagggccacctccgaccatcgcgcccgccacgtcgcctcatgggtgggggcgcggccagaagctctcgcttcaaggccttgaggctccggcgagaagcgtgagcgcacgct

SEQ ID NO: 49302 - DNA, 2089 bp, Oryza sativa
ttaattcttaaaatttgctcaataactaaaatgtcgaatggttggcctgggttggcttgggacgagctgggacccagggtcgggttgccagttcggtctgaatcatcgtaggccttgggttaaggcaggttcgtgagggttcacggccttgattaataatattgtgtagctctaggatcgtccttataaaatggctttgggcaactaagtgacttttaaatgcggatttctgcaaaacttaacccctatattattatccccttgtactcccttacattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttattttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaaagcgcggagtgcttatcgatcttgatgaccggataagcctcgggccacttagtgaacttgtcgatagcgacatacagatactcgaacccgcccggggcccgcctaaacggacccaggatatcgagcccccagacagcaaacggccacaaaagaggtatggtctgcagggcctaggccggctgatgggtttgcctggcgtgaactggcacgccctgcatcgccggaccaggtcgaccgcatcattgagagccgtcgaccaatagaaaccctggcgaaaggccttgccaaccaaggtgcgtgaggcggaatgggctccgcactcgccttcatggatatcggcgagaagctcgacgccttgtttccgaggaaagcacttcaggaggactccgttagccgcgcgccgatagagggtcccttccaccagcacgtagcgcttggagatgcgctggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgcttcatacgccgcacctggcgcacgtaagcatccatctgcgggtcagagcacgggtactccttacagacctggttaacgaccagctgggagtcgcctaacaccaggaggcggcggatccccagtccagctgccaccctgagtcctgcaaggagtccctcgtactccgccatattattggttgcccgaaagtcgaggcgaaccaggtatctgaggacgtctccgctcggcgaggtcaacgtgacccccgcaccggcgccctgaagagacagggagccgtcgaactgcatcacccagtaggtggtgtgaggcagctgtgcggggccagagctagcctcggggacggagacgggctcgggagctggggtccactctgccacaaagtcggcgagggcctggctcttgatcgtgtggcgtggttcaaagtgcaaatcgaactcagagagttcgattgctcatttcaccactcgtccagtaccttctcggttatgcaagatttggccgaggggtaagacgtaaccaccgtgacccgatgcgcctggaaataatggcgcaacttcctcgaagccatcaaaatagcgtaaagcatcttctgggcctgagggtatcgggtcttggcgtcctggagggcctcgctaacgaagtagacgggccgctgcacctttcggcggggccgatcctcgtcgctaggggccgcatctcg

SEQ ID NO: 49303 - DNA, 4443 bp, Oryza sativa
  unsure (1)..(4443): unsure at all n locations
aaaaaaaagtcaaactattttaaatttggccagtttatagacaaatatagtaatatttatattataaaattatttttattaaattgataattaaatatatttttataataaatttatcttgaattaaaaatattactattttttctataagcctaattaaacttgaaacagtttgactttaaccaaagtcaaaacatcttatattgaaatggaatacttttgctatacaatggatcacctcaaatcatatcacaacaacctcgaacacatcaataacaactgccggcgaacttcaccatttatacacatgccgtacctttgccaaaaagacattacgtatggcaagtgaagaattaagaatcttaggatggcccattgtgcaacaaaaatgaaaagattagacataagatgataactttggcaataaaatatggcccaaagtacagttcgttcttgaattatataccttttcttcatagcggatgaacagcttctgcctataaatctagcaaatatatgcatcacaatatcacatgattggacacatcaaattggcgcacagctgcgattcaagccactaagcaagcgattacattaccaagcagtcgataatttatcgcatacaagccactaaatcttcttttgcaaacagctacccaactattacagtaccattattgattctataaataagcaaacccctaacatagatacactgatgcacaccactaaactgtatctagcacctaggctaccacctaatgagagtcacttatgtacaatctgaaggagacaagagttttgttagcccttctggaagcactggaggttgttcatcttgagggctccaggcatacacctccagtgaagaaatatgctaatttttcaagaatctgactcggtgtctcctgaaagtatcaaagcataaatagagtcacttgaatgttgcacttgaaggttgaagaaaaccaaagagaggatgcagttagaagtaaaaagtagaagaggatgatcaccttcaccacaaagttgctcaactcggctcacaatatgcttgccataggtgtacttccttaatgcttgcagatggcccttcacacggctgagcaggagctctctctgttgctcgttgcatgtttcaagtatcttctgaactacatagtttgcatactggtccttcatcatcgcctaaatgtgtaaaaggttgttagcaaatcaattcgtacgaaaaccgcaggaaagaatattgtggaatctaagagatgctatattagatatagtgaatagtatatcggtttttatctaattttttcgtggatgctaaaaacacgggatgctactgcatactggttatcccgctaattcaggctttgctccctgtgcctgagagagggagggagagaactgaatgaaaatatttgatttacagtatcaacttctcaaacataccagcaagttatcattgccctcagtctgcttcacaatctcccggatcagaagatctcgctctgtcatatccccatgttgaaagcacttctctatcacatttgatgcgaatttgttttgactcatggtaacaacctgcccagccaatttactgataatttgggtcctttcatgtccccttcctctttccaaaacatgctacaaaagagaaaggaaaaacaacgagctgacaagtaagaatacaagatgacataaaattgagttcagtcacttcattatagcatcattcactaaaaatatgcatgtagatttcagtgctaactgccaacaaatgagccaacacacttcataacatgcaatgcattctacgtctgttacacacagtctgatcatttactagtcaagaaactgtttgaaattatcatatttcagcaaggcaggattgactgattgacagggtattattccgcagttgtgatgggtactgccaaggaaataggaatttgggcagcaagtattgcatcagcttgtagacaaatttacctgtgtaacatagttgccatactgatcttgtgcgaggacgcaagccgactccagtatctcatctattatgcactggccttgtgaatcaccaccgcagtgctccaaaactctctaccaagtaggataaagattaatgagaaagctggccaccaagctctagcacaggacacatcttaaatattattctgaaattacctgaataacacggcaaccatatgggtgcattgaaaggctggccacctgcccccgaaaagcagatactacaaagccaatatgttctgtaggaacacattcaatgcacttctgtataacatggttcccattttgatcacggacacatcgcataatgtttccatcaagctcacgaactagttctattttttggtcaagttccataacttcaagagcctacatgttttaaaatacaagttaggtaaatatagtactggtaacagatcatagatggtactaagctgcatctcgtattctcgtcgcagtgttgcatgtatgtgcatccatgtcatgccaatgaacattcgccaggtccacacaatacttgcaggaggacataaaatagctatttctaggcatacaaaagtagtttattttgaattccccaggcaaaatttccccaaaatactgtaatgattgcatacacagatatagaacatggatacccttatgtatctcgtgtacaaccgagtacttctaatctcgtgtaccacttgtttctcgtgtacaactgagtacttctactctcttaaagacatttcttaatttctaaaatattttagttctcttcaaagttctcaagttcaaaaggctgaggacctatggaacattcagtagagctagatggttaatgtaaggttgatagtaacctttaatactctgcatataatcgatgttaaaaaaaatctaaataagctacatcagaacttcaaatcaataggcaatagccaataagtaatacacctttcaagatcagaagtatagctagcaaaggcacacagtcatagacaacctgaaaccatctatcgctaacccatgtattctatggtattgtccaaccagttatttaagtttaaagttttccacagataaacccaaaaatctgctataaaaaaaagaaccgcatacccacagtccaatatttttatagttgccatcaaagtattcaaaagcattcttgattttaggaaagataaaataagaaaaaggtaaagattaccttttgaattactcggcatccatacatttgaaggctcaaaggtaaaacatgaccaacaagcttagtggcaagatccctcctttgttcaggagttccatgttcgaagaactgcagatattatatgtcatttcttcagatatgataaaactcagagttgttattggtcacaaagcatagttatgtaagatgaagtgactagaccacaacatgcaacacatgatttttaccacagacaataggcattgacatattaactcttacagcagcataccttttggatcacataattcccaaacacatcagtcattaatgatgaagcatgagggagaacttctgaaaacacagatgccttctcttcagcagtgcagttctctaacttctgttggatgaatcggctgccatgttggtcagcgctgaggtaaaaaatacatcaggaattaatgaccaaaagttgtatatgagtagacatgtctaagacagaacaactaaaaggaacacctcgagactaacctgtattctactatatggcctgcaatatcagatagttcaaccctgcgagccctgttagacttgagttcttccaggaaggaacatgcctttgggtcatcgaatttctccctttctcgctgcccttgaacaccagaataagcggtcatatttcttgagggagtttggaatctcacagaatcatttctcctaccaggagaaaatactccagtgaaagtctgtccctgaaacactgggcttgttgggtaagtcattggtgctccaacatatggtgtcatgccttgataatttggagcggcccctcctcttctggctgcaggagagttataaattccagttcttggaagttgaagcctctgatcagatggatacgcaggctgggataataccttttggggatcaaaactatcagcaggattcccaacaacactaacccttggtcccattgtattgtattgatttataccagcatatgaaagtaaagaaggatgctgaaagaactgaaagaagtttgggtcaggaacggatggctgcatggtaaccccaagttgttgtccatacattttatatggctgaacaaattctgctcctgcactaagattccctggtgaaggaaaaccagatggtctaccnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49304 - DNA, 5660 bp, Oryza sativa
  unsure (1)..(5660): unsure at all n locations
gctgcagccaaattttgtacaggttttccacttaatgagtttagtaactctgggtgcacaaccgtgccaggaagcgaggagctgtgctgcatgttcatccactgagctagatttagaccaggcactacactgttctgaatattcagatctttcttgcaaatctcctcaccaacccatggcatggccctcttgagaagaccgtccatttcagtctcgtcatctacagatgtgattaaattattataagataatgaaatcataattttctgttagaactgatattcagtcgaaaactttggttacacaataatcatagtctgatatgagtactaatcatccatagagtgaccttttatcagatcagtaactggttacctgtcatcccaggtagccttggacgttttgcggtgaataatggtgaggggtagatgaagaatggagcaatgataggctctatctcccagagggaaaccctggtgcgtctctcagttggtgccgcttcatcccatgcaacctgcatatagttctacttattccagcaaaaacaaaggagatatagctttgtaaggaatcagaccaaacctgaatattgcgccaatgagatgttttccaccttactggatccagatcacttataccagttattgtacccatgtacctgcaaggaagatgtcacaaatacgattcagaaaagaatcttataaaacatcacacattcacaagtgcatgaacatgaacacagtcaacacagagagctgaatgtgactcaatgcagaaaaatgatgctcccaaaatatcctaagtgtgcacaacacacaccaaggatctttttaggtccagtctgtagcagggtccctgtgggagtcaaggtagctcgatatccaccccttagaggggggtttaggataaaaaattttcaactaaaaggaatttgaagtaatgagaacaagtatatgttacacaaataagataaagttcagaaactataccttcttgttcctgactcttcagtttcaaacatcattctgaaccgcatgccaagagataattggttaccatacactgccttctggtatttggcaaaaggaatcacaaattcggaagtactggccctgaataaacaaaaaaaagttcaaacaaaactaataacatatcatctcttcatacgttaaacctagccaaagatgtttaccttgggttataatatattgtaaattggctgttattcgctgcagcatgggctgctgcagcaagaattccaatatgcatactatcactagataagacagatgatgagaggttcgtaggttgcctatttgctcgtctgatccccaagaggagctgctgttttgcatccctatggtcggaatgaagaaagtttagtactccctcaagattgatttgttacagcaacattttcaagcgatagcgaggcagaaaaaacagtttattggcataatcagtgtacctaataaacaagactgaatcaccagcaagtaatctctttccactgacaaataggctccagcccgtagtcagtaaatgccttttaggctgacctggtgaagagaaagagaactcataaactttgagacattaaagcatgaagtaacaccagagtttcctgaaccttttagtaaccaaaggccaaagctgacatacggcagttgaatacgggtttcgtttacaagagtaaggcctttactaagttgcattagcttttatcatgcatcaaagggaacaacggaatattagtatttttctactgtaccccggtatatatgacgaaatgtccaaacattatcatgcaaatcccgggcctgcagttcctgggcaggaggctgcatggagaagtcctaaacataatacagtgcgcataagttagtagaagaaaccaagaaagaatcaacactttgttttccataaagttaaagtatgctcacaagacgaggaaaaattctttcagcggcacggcgtggcacagagaaaccttcatgagtgcttgtatcactggcggtcagtggtttgcaaaagaattctgtttgtggcctggtttgcttcagcgcaagctctgatgctagcaatgtcttcttgtcacactgggtcacataataatcccaattccaaaatcatgtcggtactgctacatcacataatccagaagatctaactaaatttgggaaattgcaacctacattgctaactggctggagagtcattcgagcataaacctcatctgtgtcaggatcagcctgtcatgttttgtcaagaaatgtgtcagtacagaagttcaaattattggcataatagagcactaataaagcgtggagctctttttctgtttactgatgctcaaagtggcagagattacaagcatggtgacactgtggaggatgcatatcagctttgatggaagatttggatagcttggaatttgcgcatctgcgtcctttcgcatagatgctgcaacctgaaatcgggtatccaggaatgagaattgttctccatgaaaccccaaaaccacttgcacaaaacttgcacatttacaaacggtgtgctagtaactctcaaagcttttgttaactctcatcatagaacttgtgtacagaaacacacatgttttctatatcaaactccatggtaaaacagaagcaaccaagtaacatgagcacttttcgtttgggttgattcaaattacagtgccgtataactgaatttgctaagaactgaaagaagattaacaaaagttgtatgttcgtagttgaaagttgcaaaaagattaaagttatctgcagataagattaaacaacatgtaaaggagcatcagaaaaggaagacagattgggaggatgcccaactccatgctcctccagcattgcatcaaatggcaccaaacctccatgacgcgacgacttaatctcacaaagaacaaaagcaaagggaagtaaacaacacgagcaattagacagtgaattaattcctctctgaaacctcttcctttatgaccaaaaaaatcgattcccaaatcttcctcttatgagaacaagaacaccgagaaaaccggaatctttttttccctatttctcgagaacaaagggaaagaaaccatttggatatatggccaagatcaaacgctcaagaaccaattgacaccggacacggaaccaatcaaccaaaccacacaaccgcaaagagagagagaaaaaaattctccgccgcacgcggacatgacgcgacaactaagagaagaaagatgaaaacgaaaaattcacgaaaaccacaatgaaaaaacaacaagaaccaaagaaagggagaaatctcccttcatccgaaatgggggaaaaaagaagaacaaagcaaagcatcagcagcagcagctttgatcaaagacgacttcaacaacttcacaagtcgtcgtcgtcggaagcagagagctcggcgacggcggcggcggcgnccgtacctgctcgctgtgaccctgggggaagtagacgatgaggctcccttgcggcggcagcgagacgancggccccgcgcacgcgtaccacagctcctggttcaccttggtcgcccccntgccctccccctcctccccaccaccaccccctccgccggagctcgccatcgccgccgccgtgtctcccgagctcagtcaccgccgcctcagcctaccgcccgccggaatccatcgccggatggatcgccgccggcgaggaggaggcgaatttgaggagagaacagaagagactcggtagcagcgaagagaaaaaaaaaagtagtagtaatataatagtgcagccgagctaagcttactggccactgtactgtttaagcatcagagttaatttaatcgcaggctataattaattaattactctcgctaattaatcaaccagaacacatctggggaatggggatttgcagctgcaggctgcatcacgtgtggagagggattctatacgcgaaattcacacgcgcgagcgtgcgggtgcgttcgttgcgtgtgtgactcctatgaattctgacgaaagtctgaatacactgctccctccatcacaatgattccgttcttttctccaacaaaagttagacgaagattaatatttttatggcacgattttcaaactgctaaacggtgcaattcgtgcgaaaatttttatatgaaagttgctctaaaatatcatactaatctatttttcaaatttgtaataattaaaactcaatcaatcatacgttaataccacctcattttacgtaaaaaaaacttaatcttcatcttcatatttatcttcagaagaaaaaaaagccacctatacaaaactaacttctgactatacgtccagattcgtactcagaatttgattttttatgggacaaagagagcatctctgaataaacatatgggagcagccattcgttttgccttttcttcgtaaagattactaattaatgatgggattttaatttattttgtatactatccaccttttgacaactttgtttcttttctactacctcttttgatgtttgattttgagaagagagggaaaggtaatttgcagtgtatagcatttggggcaattttatctttctctttctctatttctttttgcctactttagttgtgcttctttttgaactcggcttttcagaagttttggatgcttttcagaagttgccaagggagacttcagaatattatttggagtttaactaggtgcatgcatgttggcatgtactgttggtaatatagtgccaattccttttctttttaccataaaaaatggatgataatatgctataatatgataatgtggataatatggatgataatggtgtattacttacaatttggagtttttttttatggaactcttcaagtgacccaaccatagtttcttcttttttttcttttttttaaaccacatgtgttaggcaaagctaaaggatgaagagaacgcttaactactgctactaataggactccaccttacgtgatactagtttcatagtgttaggcccagttgatagttgattgaattagatgtgtatatatagatattattcctttgggataagaaaaaaaaatcagcaatatactcttttcatgcgagtggggtttataaaagatcaaaataaatcgggacactagagttaatattattttgaggaaacttaaaactccattgctaaattgcttttggctctgattgttagagttatggctaataagctgtgaaaaaaatgagcaaagtaaccttatgagtaaaatttttatatgtgtagttatcattgtctattccaaggagtctctacttggccagctttcttagttcgtaagacaagccatcaaaaccgtgcgacttgtgggccaacccctgtttagcttagaccaagtctatggtctcatggggaggtccatgtgtccatcctctgtctagaaatatccttatgaaggttgaacattcgattatggttggttcagttgatgtgggtcgagatcgtgcccctagagctgtttagagacaaacacactttcactatgctagcgcgtaagatatgatagctggctgcatggtggccaggtcatggcgtttttctatgctagagtccatgactctgcattgtccgggactgccaggtatatcttgcccattgag

SEQ ID NO: 49305 - DNA, 5029 bp, Oryza sativa
  unsure (1)..(5029): unsure at all n locations
aaaagaagacttaaaatagagttgaaacgaataatgaaaatcaggagctgaaacttcaagaaagaaatatacggagtacttgacagcctgaaactgaagtactctgaacacagaaaagcatcaagccatcaacgaattagaactgttcgctagataaaacagctacagatcgaacatgaaaaaacccctccatgaatcagaacaaggtgtccttctcggagtccaccatgtaatcgtacatgggaaggaggatgaagaccctagactctaggtgttgtatcacgagcaccccttggcgtctcatgacaggccaaatagtgttcatgagtgccgaagatgggtgggtgtgtgtccaaatgggcactacatcgcctttgggaggaatgcataggccacatagtccatccatcatattaactacatattctctcaagttgcctcttagcattaatgatgagggataatgtgtattgaagactcaatatctcttgggagtagctttttaggctcacatgagagaataaggagactacaagttagtccagtgtggattcctaggggagattgactgctacattaaatatagcgaggagttcaaggaattagttcggacttatgattatgtacagtcttttttgtttgtctttcatcaaggagaaaaagagagagcagggtagttgtagggtataaaaacccatcctaaaccctgtagaaaaggttagacgttaggaattggtaagaacaccagtcttcctaagctagttggagagcatccagagcttgtacgagttgctttgatagtgacgaataacatgagtagatttgctatcttcggaagacctgaacatgtgtacgtgcttgtgttctttcttattccccgagcacatctggacacgccgtcagcatctagaaccgtacccctggttgatcccgatttatgatttttcacgtttgtcggtgttaatactggtttaaaattaaccaagactaaaaaatggaccgataaaacaaacaccaaaattaaccttaggattaaaattttaaaattcaaaatttgattgtatgtaaattgcaagctaaggtacaagggaaatccaactgaactactatattgttcaaactgagtttattataaactactctatccatcttaaaatataagtattcatagtattcaacaaaattaattttagggtattgcttcttcaccgactatacctgaactggccctcatttaactttttacccaattaattttaccttaaaccccaatcccactcgaattgaatgacaaagggagtaactaatactacataatcgaaggtctcccataaaacgagccacagagatattatatcaaaatcattaccatgactaagcatatactgaacatgattgcatatatatactccatatatggaattaattgaacattagtgttattcatgcgcgattagatagaacttagggccatgctaattggctgctagctagctaaatagagctagagttagctactaattacctactagctgtttgcagcaagctgatagtgcaaccttagctactacagctagtggccttgcatgtgttgatcatcatctttactctggaatatgcatatccagctaacaataatgcatatgcattgcgtacatttgatgcatggctaacacaacgatcgatcgacgccgctcctactcgatcgtttcaccaatgaataattcatgatcagtttggctctttcttccaagccttttaatactatagcatgtagtatgagtaagagctactttctgcaaacccaagctcatggaccatgcgtgtactttatgttgcagtgttgcagctaattactatgtctgtttctctattgattttttaaataaagtttaaacatttgtcttatctaaaatttttgtgtaaatatacaaacatttaagtcatacttaaatacttaaagaacatttaacgataaacacaataaatgataattacataatttttttaataagatgaattgttaaatgtatctaagaagtcaacagcgtcatacattaaaaaagatagagtagttgatatagactagtacttcaaaattgaagtatagcaactacaaaaatccaagctgcattgcattccgcgcattcatccgccgaccgatcgatcgatcagcagtgatgggatgcaacatgggacctcttgcttgatgaacaataatatgatcatcatacgccggtgccactacttcttatcgtatacacactcgtccataaattaataattttcatcagactagtatataccgagttgtatgtatgtgtatgctgcctgattaaaaaggctgtcgtttcggacacaggtcaaactttcaaagttaagcaacaaattaataatatatatttataaatatttggaatattgcacacattcttaaagtcccaagcctccgaggtaggttcatatgctatggacttgatcacttgattagaggaacttcatcccaaatattacatactcaccgttgaattcttctttacaaaattcttatctagattccaagactaggtaagtacatagttaaaataaaatatagtacttcccccgtttcacaatgtaagtcattctaacattttatatatttatattgatgttaatgaatttagacatatataactatttagattcacttttgcttccacccttatgttatgatgcgattaaccaccgcatctacttgagagaggatcaaatacacaagcgtttcattccaaccaaatattccagataacagataacggggggatgagggagtcgaatcattttttgaggtgatctcggtgagagcactcccattagatttgaagtgccggccattgactagacgaagaggaaggaccaatttgatcttgaccaacaactcgtgccatgccaatgcttgtaaaaactgctaccgatcgagcttgatctcatgcctggattgattgaaaccagctaattaaacacgtgcaatataattcagactctttaaccgatccaaatcttggcattgtacatgtaatagtacaaaatatgcatggcagatgcatgctctggttgccacatgatcgtcgcgaaacgtgtgatggacgtacggcgatcgggtgagatgggatccccacatgcatatcatcaccgcttcatccgcctccttctttgtcctcatcttaagctaagctaaactgagaccatagagcttaataattgatcaactatatatacatctatccagtgattagtagttcttgttgttgccagttgccttctcttcagatagatagcgagatttgatcgatagatcgagataatgattaacttgtacatgcaggtgatcgatgcgtcctactactagtagttatttctccaagctatttcaatcaaaagaaatagtttcagcctctgaataatgnaagcaagcggatcaacctgatcaagacgattatntgcatcataatcaacagagagttatttaagagctagctatttttaggccttatccgtaggctgccttcacatatatctctacacatcgagatacaatttttacagccactaaaatacattaatatttgtgtagagatggtagaaccaatcgtctcttaaaataacacatgaaaattatacgtctccagtttttttttcacgtgaaagtaaccagatatatagcttgtttatttctagctatttaagttcatattaaatcattactctagtttactaatatattgacgtacaattcttttgcacgttcgggaaaagaatcttactctagtttagtttacttagtaattaaataattagataattaatatgtcgagacttctggtaatttttattctagtttctccactgaccagcgccatatgaaaaacaatttccaactacgatcggcttaatgccatctcgagcgaaaaccatctccacatgtgggcccttatgccagccgttgccacatatatttctttcatcccataaaaaatcaaaatagaatacaaaagcacatccaaattcactatattaagatatgttatatccaatcctatgcttcttttatagagggagtacataagaccacatgagttgcttgtttacactgataccttgtaagttgtaatgtaagttcatgcagcttagttgcaagatatatttgatagcgcagtgaaaaggggtgtgtggttttaaccttgagatcacgtgtttaatatttaacacgcttataatttttttagaaaaaaaaatatttggagagacgattctccctcgtttttatgcagctcagctgccagctcgatcgactcgaccagcttatgcattcagagatggacgatggctggccgtcatggggtcctcctgcagctgggcatggtggttgcgtcgttgcgagcattcgatccgatggggacgacacattgcgccgctagggcccccggatcgatcactgttcatcgacgtctcgtcggcacctaccaatcatcatcatcatccatcacacattcattttcgcagcaaatctctgaataattcagcagcagctcgatccatccatcagatcgcaggatgaagcatgtcatcgatcctgaatttagcctgacgagactgcatttctgtttcatccatactactatatgcaccggcgaaaactatgcaccgtgtacagtgtacagcgtagaattcagagttcagagtctcgtatcctctcactgggtgttaactgaagaatgttctcttgcagtgatagtattagttgttggcatgaacagctaggagtaattaatagagatatgacgagactgcatttctgtttcatccatgcaccgtgtacagcttagaattcagaatttagagttcagagtctcttttcccacaaattttgacaatttgaccctttgcaaaaaactatttttacaaataaaccgccgccaaaacttatttcaaatctgacccttttactcaacgccaaatcgtgtggcgctgaatttagacacctcag

SEQ ID NO: 49306 - DNA, 5839 bp, Oryza sativa
  unsure (1)..(5839): unsure at all n locations
aagaatgttctcttgcatatacagtgatattaactgttggaatgaagaattaggagtataattaattaatagagatatgactgagatgttatccactctgacgacaaatcatcaggaatctgtcaaataaagcggccggctatcctgatgaaccctagaagatttcgtcgctggaattgaatctccgggcactttgatcagcaaaacctgatgtgatgccaaacgagcaccttgtcggctccgcggtttatgcgattggacatcactcacgcttgatagatgagataatgcgtatgctttcattagttgttgtactgcagtacaatttctactcagtcatgatatcattatgaatgaagctttgcattgtccaagttttttttttttgcagataaatgcatttgttaagaccagtgcgaccgatctgaggacaagaattattgcccattgacattgcgaatggtagtgggcaaacataattaaatgtttgttttttacaaaaatatcatacaataattttaattagttcatccttacagctcatgttgcctttttttttgtttttactgtttggcaaaagaattgcacgttactatattagggttttgttgtttatactaaatatgttcatgagtattttagggcctgttcactttgatgccatttttaaccttactaaattttagtaatgttgccaaaaagtagtttgctgcaaatttttggtaactacataacaaatcctgctaaaattttggcaagacaatgtcaaaatttggtaaggttgaaaatggcaacaaagcgaacatgcctttaaacttttcaatagtttacgcttttcgtctttttgttttaaaatatagtaacatagaacacgcaattagacatcagctaccattacaaaagatatattagaacaaaggacatctttactctctctatctattatattattaaaacagctttgaaagaaggcaccacgttcgctgtggaagttagaaatttccacattaatcagtgaaaaagaaaaaaaaagaagagtccaagtagaagtacaatctaaaaatagttaaaattaggaattaaaaataagcaatattgaaacaagttttcatataggaacccaatacgagattaatcaagattcaaaataaaaataaaataaaatccaaaattagaaaaggaaaggagagtccaagtataaatacaattaaaaatagctgaaattcagaattaaaaataagcaatgttgaaagaagttttcatataagaacccaatacgagattaatcaaaattcgaaataaaaataaaataaaatctaaaattagaaaagaaaataaaagaagagtccaagtaggaatacaatttaaaaatagctgaaattcggagttaaaaataagaaatattaaaagaagagtccatataagaacccaatacgagattaattaaaattcagaataaaaataaaataatatctaaaattagaaaaattaaaagagagttcaagtaggagtacaattttgaaacaactgaaattgaaaataaaacattaaaacattaaaataacacaatacgatattaactaatttttttttaaaaaaatctgaaattagaaaaagaaaaataagatttcaattaggcatacaatttataaataactaaaatttgtgataaaaataaagattattgaaagaaaagaccatctaaaacacatgacgagataaattaagtaacatgcctataaaggagtagagtggtggcggttgatacgatatatagaaattgttaataaaacactaaataaaatcctaatgacgattaaaaggagggacatcaggcaggccgtaaagcaaacgagtaaggcggtgccgggacttctagaaagtaaaaaaaaacccattgataatcatattcattttttaaaatctcaatgacaataaaaaggagaagcagcgggcgggatgtataagagtatagttacagagccaccgacggttgacgggacttctagaaaataaaaaatgaattccaacgatagttatattcaatctttagaatcacaatgacaataaatagttggcggcggacgggctatagaggggcatagtggcatcgtttgatgggacatctaaaaattataaaaaataaaactacaagtccaatttttaaaggtttaaaacttctaaaaagtaaaaaaaaacaatgataatcatgttcaattttaaaatctcaatgacaataaaaaagggagggcagcggcgagccgcagaggagtacgatggtaaagctgctgacggtttggcgagacttctagaaagtaaaaaaatgaacccaaacgataattatgtcgatttttaaaatctcaatgacaacaaagagaagagatagtggacgggccgtaaaggagtataatggcaacgtttgacaggacatctagaaattataaaaatgaaatccaacgactctaaaagctataaaatccaatttttaaaggttgcaagaagaatgaatagaaatagtggtagatcgagcaagcaaataaagaaggagatgacataaggggtagcaactggtgtgacttttaaaaactacataattataaacacgaggatgataagatttggaatttcaaagtctcatgacaatgagatagccagatagctattttataaattttaagtaaaatcatactaaaaaatattatgattttgtttgggtgctagccgcgcaattacgcgggccagccagctagttaattatataatataacaatataaaacacggaattgacattgtggaacataggggtcggagtctcgaaggtggctacagaggggaaggcaaaaggcccaccaactgcacggcccaatacctgaccaatcgaaacccaacaggccaacactgcgggcaatcccgttccggcccaacttaaatgggccgtccgtaccacggcggagctccggcgagctgccacggcggacgcggagggattcttcgggatcgcagaatgttgggatcgtacgttttcctagtactgaattcaaacaattctcttgaatctgatccaaattcatctctatttcagttgaaaactgatttttacagtacagcaacagagtacacggggtgaaaagatttcccaatttcaccaccacatcaccgggctcgcctgcccgatcgccggcagctgctgctgcggcggcggcatgcaatgctgcggccaccgccggaacaggtacccctcgccggaggcggccgggggaccggcgccggcgagatgcgcgccctctttcttgacctccatcggcttcgctgagccctcggcgtncttcttcttctcctccttcgacgacgacgagacgcccacagtatccttcgccatgaatcccccgccgctgccggcgcggagccccaacggacaagggccatgccggcgccattctcttttcttttttggcgccggacaacagccgccgcaccgtccggctgtccgcctccgcagcatgtcccggatccactcggcgccagcgcggaggctggcccacggccggagccgccgccgcagctggccgaggaggccgacgcctcccacagattcgaccggctcgtacaccaccatagccctttcacctaccgccgccacctccgccgcagacggcgcctcgcccatcgccacgtcgtccgccgccgccgcgttgtcatcgcgcaccagccgcctcattttggtcgcgcggcaagcgagcgggagcccgccgtcgacgtcgccggggcaaatgaacagctcaggctcctccccgcccttcctcttcagcgtcacgccgccgccgggggactccacgagcaccaccatatcctgctccactaatcaatcaccacgtcgctaatctcgccacttaatcccggtgcactcgaaggttaattctcgcatcgcagcgaaggggggaagcgaaatggcgggagatttatacggggctcgtcgagagaggagtggacgagtggagaagaagaaggcgaggaagaccggagaagcttcggttccatctccggaagcctctagaatgcgcctcgcttctcgagacagcgacagcgcgtcacctgggcggcccacaaggccaccattctgggccggatgggtgatgggccgaattggtggtgggccgaatggcggaagccgaggaggggtgtcgcgcgcggtttggccgtgtgaggtgggggtttgagtttagtaccacctcggcgagcgaggcgggtggtggagggggaggtggctatataaggggggttgggtgtgagggtggaaggcacgcagctgcgtggtgagcacaaagcgaactattctttcgccttttactaaagaataccgtgtgcgcgccacaattagcagcatacgctaaatttaaatttaaagctttgttttactaaatcttgaaatgttttggcggaaattcaaagctttcagccgtgagatgtgccaaatgtttttaagtaattgtataactttgaaatgctcaacgaaagactacgggattaacttgatgatttcgagtttgaattgattttaccaatgcctgggattaacttgatgatttggggtttgaaactttgaattaattttaccaatgctgatttggggtttgaattgattttacgcctgaattatcagatatctacaatcgctctctgtaaatttggtttctatagaacatactacaatttatactccactactgttttaaacctggatttcctctgaattaaatttaccaatatctgcaagttttcagaatttacagtgataatcagggaagactcatcgtgtcagagctactcctggtcacaccggacgaggcggccgcgtttgctgcacagcgcctgctcgccgccggccgccgccaccaccttcccgtagctgtaccggagcggcatccttcccagcagccggtggaactccgtgatgcaatcccctctcttctcccagtgcgccgcgccccccgtcgagctcaggccgacggccttcatctcctcgccaccggcgccggcgccggcgtcggcatcgtcgttcctcgggtcgccccagtctctgatgctgccggcctccaccagcaccggcccctcgccggactcctcggcggcgacgaagttcatcaggatgtcctcgcagttgcgctcccggtccaccacggcgcgcgccgcggcgagctccggcgagcaggagtactcgcggaggaggcccgcgccgaggacgaggagcttggtgagcaccatggagtagcgcgcctgctgccgcgccgccgcgccgtacgcccacctcccgcgggccaggtcgaggtggtgggacctcgggaagaacccgacgagggtgcccggcggggcgcgctgctgccaggcggcgaacgcgaaggagagcgcggcggcgtccgggagcacgtcgtcgtcggcgacggccacgcgggcggtgcggatggacgggtgcgggaggaagcgggagttgaggnagccgnagccggtgcggtggagggtgacgcccggcgggaagcttgacaggaggctgtccggtgtggaggggttggaccagagcacgacgacggcgaggacgagcgggtgggcggcgtacgctccggcgatggcgcggagcagcgggagccgccgctccgagtagccgctcaggagcaccgtgagccggtccggcctcagcgtggccgcgtccggcatggactccactccgcagaacgcctcttcttcttccacaccggctacgacagcgacggcggcggcgagcgtcgccgcgagcaaaaggaggcggaggcggcgatgcgacgccatggacgcggtggcgagatc

SEQ ID NO: 49307 - DNA, 2693 bp, Oryza sativa
ggcggggtcgtcggctgcgtgtccgttccaagggaggtcgccgcggccgcggcggtggagccggcggcgccgccggaggctgaggccgagacagaggttagttatcttgcatgctccctgagctcgccggcgctttgccggagcagtgtgtggtgcaaccgtgcaatcctcacaccgacaggacgggcccacgggtcagcgagacagcagtggtgccctgtggtagttctctctaggaagtccaaccgcttaccatttgtaactgtcctaaccttgacctccctccgccgtccgatctaccataggcggttcagatcactaggggcacgtttggatcctgggcaagggtcaccctagccttgcctggcaaggctatccgtttggaactagtaaaatagcttggcttttaagggcgagttagttgtacagggcgagaaaaaccttgccggctagggagagccaatttggctcgctttcgacgtcaaacttcactcgcgtgaaaatattgtctgcgggcgacgcggacttctccggaatcgctgatattctctccccgatcaggagacgaactcattagcagcagctcaatccggaggcgatctcatccgcgtagactcctagatttgatttcttctttatcgtcagctcctaacctcttctttctgagatacatggtgtgctgtcttgttcaatcgctctgtcaggaagttggtagagttagaaaagagcgtctttgagatcgtttgctttgtgctagatgcagcctttgcgttgccaagatcatttattatgatggtacttgattaaggaattctcttgatttctcatttgtgaatcctaaaatattatgggccattttggtttgatatcaaaatgttgccataccaattttttggtagtttaaatagtaaatgtgatgatttggtttgaagccaaatattttgtaatgactatattcaatttggcacaattctagaatgttcttcaccacaattcaaaatttggctctcaattgacattgatctaaagacactcatttacaattctaccctaccaaaatattggtagtgccaaaacttgcgtagagtttggcactaccaatatattggtagggtactaaaccaaacaagccatataactttaaggtagtaataaactactagcaaaagaatggctatgggaaaaaaaacaatgcaagattattaacatgaccagtgccttttaatttttggacaaaaaaaggaagcaaaataaacttgggcaaagcaataatttttgaaggattcaaacagctagccactattccttgccctcggaagcaaaccaaccaaacacaggggtacggcaaggctagcaagctggcaatgagatgttttagccttgctgagccaggctagcggagcgaaggatccaaacataccctagatcaacaccattggtagccttcgccctctcttctgatgctgagaatctgactgtgtgtggtttcgatgcaaaaaccattcgaatctgatgctgttgaactaccttggctgtgatgattcttcttgtcctaaggaagagtgtagagtgcgaaggttgcaacggcgcagggtggctgctctgcgacttctgcaaggggaagaagaacaacgtcaagtcggagagcagccggatctaccgccgctgcccgacctgcaaagccgtgagtttcgctcctctcttcaattttgcacattgccatcacctttttctgcttcgttccaacactttgaactggtgctgctgttgcaggcagggtacatcctttgcccaagatgcagggtctacaaatgcatcacttatccagagagcaatgactcatgaacagaagtgaaactgatcgagctggaaaatctggatgaagatctgatccttttgatgagcatgcttgagttgagtggatagactgcaccgatgaatatagaacaaccgcacagctctgaatctgattgtactgcgcattgaagcaaaatgactatgtacacaagtgcattctgcatagcaacatatgctgtttattgtacctgctcttccaaacatcaggcataccctgatgttccgcctttcttgttgagtgaaatgaggatcatctttcgtccactcaacatgtcagcataccctgcactagtatatacatcaatccgttcttgccagagaatgctttttctgctagctcgtcccggaggagcttatctggccgctcaggacatgcatgaatatacagattacaccatccatcaaaattgaaggaccgcacaacttcaacatatacgcaaaaagggctataaacatatgttttttactctgctatactatgctatactttgttctttcaatcatcaggctgcaattcaaggatgatggaggagtagctgagcatggggtagagattggagttgaggaaatgagagaacaggtggacggcgtgagcacgatcaggcaggtcgtcggtgaggaagtataaggcgctggcttgcctgtgtccaccagcggctcccagcggtagcctgggcgctctgggagtccaacaaccgccggcaaatggctggcgttgaaggccacgtagatctcgcctttcgtttcatctttctgtgatagacatggataaaagaaattatcatctagcttcaacttgattgttgtgaaaaagacggtgcttttattttttgggg

SEQ ID NO: 49308 - DNA, 1812 bp, Oryza sativa
  unsure (1)..(1812): unsure at all n locations
cagcaacatccaacatttcgagctgcatgtgaagctctaggtctccttggtgatgaccaagagtggtcccatgctctcaatgatgcagtgcactgggccttaccttatcagttacgtcagttatttgtaacaatcttactgtttggagggacaaatccacaaaggctttttacagaacatgcccagcatatgagtgaagattttagatacagaacaaatcaaaatctatcacaaagtaatagttcatttgcagactcttttgttggcaatgccctattatttgaattggataaattattgagaaatgctggatattctttatcacactttaatttgccacttccagatgatattggtagtgcatctgcagataatagattattactagatgaactcagctatgatattaccagcattgcatctacatctgctaatgacatcaatagtctgaatacaaaccagaaggaaatattcaattctatttctaactcagtcataaataatgagggaagaacattctttgtgtatggacatggaggaactggaaaaactttcttatggacaactttattaaactttgtgagaactcaanggaaaattgcattagctgttgcataatcaggaattgcagcccttctacttccaggaggtagaacacctcattcccgctcaaaatccctttgacatacgtgagaatctatgtgcagtataaagaagacacacacttagcagacttattcaacaaacatctcttattgtttgggatgaagcacctgtgaatcacaagtattgttttgaagcattagatcacacacttagatatatattatcggacattcgacctaatgcacagcataggcaatttggtggaataactgttgcatttggtggagattttcggcaaacacttcctgttattcagaatgcaacaaggcaccaaattctgcgagcttctattgttaattcatacttatggcatcaatgtgtagttcttcaactgactgaaaatatgagacttagctcacaaaacctttcaccatccgataaagaagaactacgggtatttgcagattgggttttaagagtaggaaatggtacagagcctcatatttcaatagaaaatgaaaccaatggtactttcatagagataccccaatctcttttgttgccctcagattccagaaatcttgatagcttgatttcctttgtgtatgacttaggatatgaaccaagcaatattacaacatatttttgtgatcgtgcaattttatcaccaacaaataaggttgttccagaaataaacaacaaaatcattgctcaagtaacagctgctgaaatttcatattatagctcagatactattgatgatagctgtgcaaaccattcaactctagaggctctatacccaacagaattcccgcaacacaatatctttgaatggacttccagaccatgttttgcatctcaaaattggtgtttctataatgcttttgcgtaaccttgatccttctagaggtctctgtaatgggactagacttattgttacacagctcacaaccccgcatcattgaaggggaaataatgactggaaaagccaaaggttcaaaagcatacataccgcgtattataacgacatcagcccaatctaagtgggcattcaagctaaaaagacgtcaatttccaatacgtttgtcatatgcgatgacaattaacaaaagccaaggtcaaacacttcaaaaagttggtgcatacttgccatctccagttttttctcatggacaattatatgttgcgttatcacgagtaacatct

SEQ ID NO: 49309 - DNA, 3063 bp, Oryza sativa
  unsure (1)..(3063): unsure at all n locations
tatgcaatgtatgttttctgatattgtctactagctaaccttagacctcttatttcaggaacatttccatagatgggatcagcaacaaaactcaaacagataaatttgggacagcaaaacctcaaagttttcggacgacttattagactatgggatgctaaaaacatggcctcagccagtacaccaacaatattcaacatcgatggggtaattcttgatgaagaggtatactatcctacaccaaaaaatgatttatcctatgcttaacttccaatctaaatattactgataaaacgatgcagttttagacttataccagttctaatcttgcagggcactatggtgcagtttactattccaaagaaacttgaaaatgaatttcgtccatcactaactctaggttgtgtctacatgtttgttgatgtcaatactgttgacattaaaaacaaaaaatatatttaccaccaccaaaaatacatgttgcagtttaagtccagcacaaaggttcatcacctagaatcaagaggttcatccatcccaaactatggttttgaattctgcccatttgatcagataccatctaaaagcggaatatcaaaaccattgataggtaatacttgcattttctatcttcttttatttaattattatacaactaatctcgaacattttgcctctagatctgataggagttatcagccatgttgggccatatgattatgctggcaaaacatcatccaagaaaaacagaaagctcaaaatccgtagcaaagagtatgtatcacatatgcattatatttttatgttccaaatgtatatgacacagtagtttataccttttgtttcaccaatttgtagtgaacaagaacaagaaatagtcctctggggtgaatatggagggtcatttgatgaagcttttgttctacagaaatctacagaccacaaaatagtagtagctatacttgctggacttacagcagggacttatttaagtcagtccctcaaataactttttaataccccctctcataaacaacactactcacttatgtgctacaattttaaaaggcaaaacagaggctacatcaagttcagcaacacaaatatattttgactccgatataacagagattgctgaatatcaaagcaggtaacttatatagcttattgtcatactgattntaatttatatttgcttcaaaaatgcatcaatcttccttcaagctaccaatgggatattccaactctccaacaacaaatgccacgagttgaacatttaactccacttcaagcggctggtaagctatacaaacttgaagaaatatcaagactgcccatttctgctttcgaggtacctcattcacactacatcactaaataagttgctaatctaattaaataatcatttcaatatttcttacacactagggagggaattcatacagttgcattgcaaaggtatcagcgatagtaccatatacaaattggtactacaaaatatgcaaatcatgtactgcatcatacaatagcaactccgacactccaagatgtcaatgtcagcattccatgccaaaaccaatgtatgtgacatatctataatactaatttttcttattaattaattcgtcttacatttctataaacaaatctaatatactcaaacaaactttcaggtacaaacttcctttaacaattaaagatgaatcaggaactttggacgcagtagcattctacaatgtggctgaggatttgggtgaggtaaatgctactcaagctacccagaacttgaaaattgatgcaacagaacatgccatagctcttgatatagccattgggaaaacaagattgtttcacattgccatgaatacaaagtactcttcacacttcactatcaattatgtcctcaagaagagttatcccgttgaaaatgaaaatacaagtttgatactacctactctggaaaatacaaaggtagcaaaggtatacaaatgtttgtccttaccatatcttctaccaaccatctataatctaaaaataacttttttcaggaatcagccaccaaacaacttgcaacagatgaagggctaaccaccatggaacattgcaggttaaccaacatatgccttttttacttattatattctgcttaacatttctatatttatgactacaactaatagcagcaaagaagaccaacatcccactacgccaccatccctacaacctccagaaacaactctagacaacaatacagtaaaccaaattataccttcagcaaagagagctcttcaatttgaaaaggagttacacattgatcaaccaaggtactgcactgatacaagttctttttccagaatatacaaactattcttcaactaaattcctttcatatatgcatcagcccagcaattgcaaacactattcagggtgcaacaaatcaactttatcatccccaacaagtagatctcagcaaggaaaaacaaccgtcaacagaattttctccaggacaaaattctaagtgccataaaaaagtgtacgtgcacaccttaagtttcagcctataaacatatatatgtgtgtgtcgcgcgcgtgcatatatatatgtatgtatgtatgtatgttttgctactaatttgactgctaaattcagaacggaaacctccaccaatggagaggaaaaccagctgcagcagccaaagatagctgatcaacagccatcgggtcacaaggaacaggtacaactcttcaaatccttcacaattctcctacaacatggccttttatcagcaacatatatagattttcttaaaaaaattagacctgcaccaaatctgtcaccatcactgctaacgatttccttaagaaatttaaacctgcaccaaatctatcaccatcattgctaacttatctttgcaaccattacttgcaagtttactggcaaaaccaaccaaatctgaaatatggcatttatatctattccatattttatcgtcaataataaaagactcaagatatgattcttaatcatatctgattcggcaataaatgagaaaacaaaattag

SEQ ID NO: 49310 - DNA, 2553 bp, Oryza sativa
  unsure (1)..(2553): unsure at all n locations
tcagctatagcttcctaattacatagttttcaagcttatattttatatttaacatgcttcatgcatttcagtgctctgtacattgtatatgcctatctatacatcatcaaacgcattactcttcttcaggaaccatgaggcgcaactcatccacaccaactacctgcaagcagtttccaagattactgcatccaaatcaatagctatttatatcactctccaagggaaatcatccaccgacgacctctccaagctgcagccaactcaagctcatgttgtgaattacatgaaaaataaacttcctcacatgcatatcattctcgatggagaaaatgtcacaaacaatgagatttagaccttacagtttcctactgtttccagctcatagtattactacctacctacagtttgctgtaatcaaataaacaaaacttaattttatatttgcatgtgtttcactcaacttatatttatcctctggtgaagatcttggtgttcctaacaatattctgcttgcaatgtttccagtaaatctgaatggtgttgtcattgtgactataaatttccaactccctggactcgaaatgagttttttgtgcttggcacttttagcaattgatgatgcaaatatcatctttaattgatcagatagcagaactgcttacttttgaaattgtatactatactaaactatattcctgtttggttaggtagcagaactactcacttatatctcacttattcatgtttattcatacttacatgcatattcatcctttctaatgtgcccgccacaacgcgcggggtttcaactagttacagataaagacgactccattatttttaatcgatccagcacgagagtgtgcttttttcattaaataaagtgggagaaaaatgcaacccctaagagcaaagaaaaggcaaaagccaagaaaaactgtacactatacaaggtgcggaacaagctcactaaggcacttagcgcccgccaaaccccacatgtcgacttcttcctttattctcgcgagaagatacgaagttgtggcctccttgtactcatagatccgctggtttcattcctttcatatttcccaaacgatgaggaggatcatggtacgggatcccttcttgggaatgccagccaaagtggctggcacttcccaccattcattgaccgactgagtagtctcccagtgtcaaggctcaagctgatgattggccacccaatccgtccttttagtgtatctgcacctagtgacgaggtgcaaggccgtttcgtcctctccccgacaaagtgggcaccgtccgttgttctatcatcccctggtcgcaagtcggtcagaggtccagactttattcaggatgatgaaccaggcgtgtagtttgcattntcctggcgcccagacccttcagatcaatgaatcaaaggttgtgtcgagcacgccaacagcatngtgttataggccgacgaagccaagtactagtcatggggtgtgaacttccatgagatttggtcagactcttcctcgtgtagctacacaccacggactgcggtccataaaggccacaagctgctccacgagggccactgtgatatgtgggtttgtctccaaggctaaatctccgacccagacattattctcctttccttggtgtagggactctctcctcttcttagaaattgcgtagactaggggtacgaggaggtctttgggtcttcgcccttccatccatgcttgcatgtatactttaagagcattgctccagtccagcatattgtacctcgaggtaccggtaccttgaggtaccaatttaaatccggccattcattcacggagggtaagattgaaaatctcacgctaagcagctcgtgatgctccttctctttgactgagtgactgtgtgaacgaagactccaagagcaactgagcaagtccaaaccaagagcaagggcgtggtgggagcgggacgaggggtggtcggcgccggtggtgccgggggcgtcggcggcggggtgttggacggcggcgcgttgggtgccggcggtgtctgcatggtggcgaggtaacgaggagcaggaggggtggtcggcgccggtggtgttgaacggcggcgcctgcatcggaggctgctacgcggcggcggaggcgacgaggacctacgtcggtcgcctatgtgctcgaatccggcagcgagattaggggaagggccgcggtaggcgtatgtcaccagcgagcttgggggaagtgatgcacggaggctcgtcggccccctccacctccactccggctagcctatccatccctggtgagagccatcgatcgatgcaggcatgcagcatcttttggagagagaaaagacaggaggaagatgaagaagatacacgtgaaattacttaactacccttacttctttagcacctctctatgctatgtaaaatcacgtggacagtactactaggtacaactctttctcacccgttggatcaaacgaaatcaatggcttaaattgcatgtacagtaaaaattctcatactttaatgtgatcatg

SEQ ID NO: 49311 - DNA, 2287 bp, Oryza sativa
atcagccgtgtaaatctgttgctaatattattatagcatatatcatctcggggtgcatgcatgtctgaacttctcatgacgtataatgctcgccggcatctctcctgctccggcgagtctctcagctgcggcgccggccggatcagttgtctcgacgacgaacggtggcggcggctactcgacgcgctcatacagattcttgaggctctggagattttgctcgatgttgctgatgtacttcttcccctccgagcgctccaccgcttgctgcctcacgcgcagtttaacgccgacgtagatgccggccgcgaagctcccgcagatgctgtaccccatcttcgcgaagttcgacatcgacatggccggcgcacgtacgccgccgctcgccggcggtagggttgtcgaacgggctgaatctccggcgaggtggctcgcctgcatgcgtgcgtaactgcgtatgcaagtcgcgtcgtgtcgcgcgtggagatcgatcgatcgcctcggaatatgtacacgtgagtacgttcgatcgatagagtttgtgtcggaattatccaagttgaatttgggtccaagagaccagagcctgtttgtgtctagaattaagccagggttttgcccaaattaaatgaaattaattctgggctggaaaccggcggctaggattgtggctagaatcgaatattgatggcctgatgtaatacgctctcagttcaagaacattgccaaattttggcaagattcagtgttaccgaattttgatagttttttactatgtgtttagtttgatgcctttttaaattttgatagtattgagaaaacttttgaaattttggtaggatagcattttactccaattagtatggttaaaagttccaattaaaatttagaatagtttgatggtaaagaggaaaggagagagaagataagactaggggtgaaaataatcgtagaaattcctgactgaccgacacttgttctcgattttgactggctgagctatgtgaaaattgttgccaacaaaattaaaaatagaaatagtagaaaaatatagaaatgcaaatgaaaactattttattgttatatcgagtgtttccgaatttttataccataattgtatgaaaattaccatctattaccctatatttgtaaatacgtcaacatctatgacccatttttttttatttgactgatacccatcaactccatacccaaatcaagtgcatggctaaaaaaagagacaattataatttacattgtataatcttgaatttattatattttatatagctatgtaaagttaaatgtgtgatttcgccgttcaatgtttttgatatttattatcgttttccaacacgtcgtttccggtttttccaatatttttcgataccgttttcattttattctttactgttttcgattccgttccgaaagaaatataactatgaaagtggtttccatattttcggacctttttcatccttagataagaaaacacaagtggttttatgtgtgagttggggtagtggcgttggtaggttggaagtggtgaatccgtggtggtaagcagggttcaaattttcggaacgaaatttctaaaatttcggttctattggatccgcgatacaatattatttcggccaaaaaaatatttttaaaatttggtaataatttgttcaaatttaacaaaatttatcaaaatttccaaaattcgaaaactaaagattgaactggtgaacaggttgaagactaaagattcgatatatattgcaccctccgaaaaaaatgtcgaaaactaaagattgaactggtgaacaggttgaagacgatgaccgcgacagcaagaacgcgacgcagccgaccacaaatcgagctccacttgtgcacagagagagatggccaaaccgcgaacacgataagccatctgatcagtggctcgccgtcgccgctgctcctctccaactccaacctcgcatcactccatgcgcgagctcgagctcagctgagtggacgatggaatgaggctcgtggctgccaaaccttgctgcctcttccgaatctcaagcgtcgccgccgttgcagccggtcgccgccggccatggcgagccgcggcggcgagcggcaatgcgcacgccgaagccgaaggcgatgaggacggccaatcgctgtcggcgagggcgaggggcaggcgggcgcggctgtcggcgagcggcggaaaaagatcgtggtggtggaggccggcggcgttgggggcatcggcgagttcctgcgtcagcccgccggcgtg

SEQ ID NO: 49312 - DNA, 2750 bp, Oryza sativa
caggcaacctgtaaggccctacattaatcactgaagtttctgaaagttcagtagtaaaaaaaaaaggcaaaatatctcaaagaaattacacacaagtgctcaccagatgctgatgagaactaaattccaatccaatcaccccatcaagatgtttaagcacatcttttacactgaaactgaatcactgttcagtattaccagtttcattttggttaaccataagaactgaacatttgccaggctgatgcaagccctcctgaacaggctcgtgcccttgctggggaccaagctgctgagagactaccattcgtgggttcagcttcagcagcagcagcctgaaatttcctcattagaaactgctgaaatcgatgcttcatagtcggatggcttcatcgaattcagagatttttagcgagacgaaagaattctgagaaaatatgttggatggtttggagaaaaattggttgccgatgtaactaaaaattgcagtttgtaatatagttccattatgactgcttcagtgaaactcaggcatcaaactgcacagcttacaatctctgttttcttcagcactagttctcgtaaaaaaagacgaactcaagaattaggaaaagggacattgcactgagaacttttggtgaagtaacaaagatctgaaaatgaataatcttttaggaatttcagcttgcgtgatcatatatcacagagagagaaatgaaaaggtgaagtaacaagcatctgaaaacgaataatctttcaacaattttttgatcgcactacatgatcatacatcggagaagagatgaaaaggtgaagtaacaaacatctgaatctgaaaaccaataatctttcaagaattttggattcattgatcatacatcggagataaaaaaaaccacaaaaaagttaacaaataatctttcaacaattatgaaaccaaaaagaaattccgttgccgggactcgaacccgggtctctcgggtgagagccgagtatcctaaccagctagactacaacggattgctgatggaagtacatatacaaattatataaatattattattacaaaatgatacagagggatattattgccgttcgattcgaggctacccgctaccagcatgcacggtgtggtgtccaaggccccaaagctagaatgacgtgcacacgagtacaaaagagagatatagctgaatgattgatgtgtttgaaaattagcataaaccaaaactgcttgcaattgatgagtagactcatcagtagagtacttatttatttgtgcatgacatcttcaggataggtagatgccatcatttcctgacctcacccacatctgtagttgcatcaatcttggacatgtctcaactagtaaaaaagaaacggtaactttaattgcaactctgcttgaaacttgttaacactatatatgtttttcaaacaaaatgtgaaatacatgaacttacaagtatgattacacagagacatcaaagacacacgtacaccacgcgagtgagtcccctcccttaacacaagcttaaaaagaaggaaaaaacatggcaaatatcggactgaacaatatatatggttttgtactatacgtagcatattttgaaggggtttttcggctcaaaattatgactataatgttcacgtgagcgctcggtgagaggagtccattacttttgtttatgatgaaacgggaattccattattaatttggttctttcactttctatctagctagttttaaaaaatctcttcaaaaaaaagttttaaaaaaatctcttgcagcccttgcctaaatctcttgtactatcttcctccggatagagtggaaaataggaagaaaaaagacatcagtcattctaatgaaagcccttctgctctttaacatgaaagcccttctgctctttaacacaagttcttgattctatagactttgatggtacaactcattatggctagatttgttttcatatatgttcagttcatgcatttatatatgtgcttcataatccttggacttatttacatgcatgagattttgaccccatatatatactccaagctagcatatgaaaagggtaattgattaattcacattcgaccctgccaaagttcacatatgttcatgatagctagtatcttcatatagaatgcttctgtcatcccccagaatgaattgtaagaaagttataccgcaaaattaaacattccactcaaaaattttcaaattcaaactttcgcgccatgggtcgatttcgcgcctctttttctcctttcttcctctgttaatttccactacaaaatcacaccggattgcaaagagaaacaactgcaaatttccatttcatgacaacatccatctcatatataacaacagttccttttcaagaaccgattattacacttctcttacacaaggatcatacacaaggtgcatgaccaagtacagactaagttaatttattccatggctagagtactctagactctagatcatgcatgtcttccttgatatggctagttacaccattaggacagcacaacacaaccacaaaagtgcatagtacacatgctacatagaaggtgtaactagctagctaagaagttgtagatatggtcactctccttgctgaacaatggcgatcaaagcggcgacctcttcgatgtccatggagaggaggcggtcagccgcagccatgacgtcctcgtctgtggtggtgtcaggctcgttgcagtagtaagga

SEQ ID NO: 49313 - DNA, 2132 bp, Oryza sativa
  unsure (1)..(2132): unsure at all n locations
acacgtggcggcatgcacgcatgcaggagtaacgtgggagaaatgccacgtgtccatgcaacctggcgcatctgtttgcaaaattgcaagtgtttttttttaattttctttcattttatttatttgtttattattatatagggatatttatcttgaaaccggttgacacctactcctctagtgatgagccggtccgtgcatacgtagttctatctctagtgtctcgtgcacagagaaagtagctacatttatgtttctagccatataactataggttgaatttatttatgggttcactccatcttttagcttgctacactgcaaaaaatttagaggagtaactaacagtatggcttactttaccaccaaacgaaagtgccacaccatctactaatctctatccatgtcagtccggctgcaatctgctctgggtctgcaactctctcctcgcgctttatccattgggtattcatattgttgctagatgtggcaattgatctctgggtctgaaactggatgaaggatgaaggatggtggtcctatcttgtcagattgtaccatcgatgtttttattttaaagaagtatagatatagtgtttttatgttgtataaataaggtcttgtctagatcccacttcaaaattttttaccctgtcactcgaacgtttgaacacttgcatgaaggctgtgtttagttcagcgcaaagtttggattttggttgaaattggagatgatgtgactgaaaagttatgtgtatatgacaggttgatatgatggaaaaggactgaagtttggatccaaactttagatctaaacacatccgaagtattaaatataggttaaaaaaataactaattatacagcttgcggccagacgaatcttttaagcctaattgctccatgatttaacaatgtggtgctacagtaaacatttgctaatgacagattaattaggcttaataaattcgtttcacggttactaaccaattctataattagttttttattagtgcccaccctatacgatattctatataatatctgatgtgacacgttaaaattttaaaccctggatatacacccccttaacgcgaggggagtatagcaccgagggcggcgagggacggatgcacggagcgtacgtacgtgcgtgcgtgtgtcacacgcgcgcgcggcgaccgtgcggacgtgaagcgacgaagctgggncgcgaacggtctattcctggacaaaagtacaaattagcatccatttgacttttgcagaattcattgccatgtgtaggtagacactgatcaagccggcttaattaattaagtaaaacccacaaatacgacacactataatctctaattatattactctctccggttccattgctcttaatgttttgaataaggttgtattcaaaacttttaaaatttcgactgaaagcactagaataacatatatatagtccctcttagtctttactattagagtaaatacttatttgtatttatttattgtatatgtcataatagacaatatagttaaagatatacttcaaaaattatgtcgttctccaaaaaattaagaatatcgaatcggatgaagggagtagtactgtctttgctcgcgtttgaagatatgaggattaattatgtgcttgcagatatgtagtatacacgtacgtataaccccaacgctccgtattgacgcctactaccgcgtcactcccatcgatcggcgcagtttgactcttgtaccagagtatgtatatcgatttccattattatcgttggtttatcatcatacttgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacatggtatcagagccttccaccctccaccaatcaatctttcaatctaatctcccaactcccgacgcaaatggcgtcttcttcctccaacccatctgctctcaatgggcagacagtttctgagaagctcaccaagagcaacttcgtgctgtggaaggcgcaag

SEQ ID NO: 49314 - DNA, 9051 bp, Oryza sativa
  unsure (1)..(9051): unsure at all n locations
atgacatggcttctgcagaaaaaccagttgatgatgaggagctcatctcctacattcttgccgggctggatttcgactacaactcggtggtctcgtcagtcacgggacgcaccggtccaatctctgtgagcgatgtctatgcgctcctggttggctttgagtcgcggctggaacttctccagaacgcgggcaatccttctgccaacaccgcgtcgcgaggaggacgagcccgaggcggtcgtgatggcagagggcgcgggcgcggcaaccctggacgtggcggcagcttcgggcgcggtcgtaatgacggcaagcccaagccgacgtgccaactctgcggcaagatcggccacatcgtcgccaagtgctggaagaggtttgatccctctttcaccggtgaagagaagaacgccaacactgctgcagtgaactcctacggcatcgacacgaactggtacatcgacagcggcgccaccgaccacatcactggagagatggagaagctcatggtgaaggacaaatacaccggcaatgatcaagtccacaatgctagtggcgcaggtatgaatatcgatcatgttggtcatactgcaattcgtacccctactcgtgatctaacgttgaaaaacgtcctccatgttcctgatgcatgcaaaagccttgtttctgcccatcgctttactcgtgacaataaaacatttgttgaacttcatcctttcttctttttggttaaggatcaggtaacgaggatgccactccttcgaggcaggtgtagatccggcctctatcctctgccaacagacaagctccaaaccatctccaacaagcaggcttttggtgttgtcaagccctctcttttccggtggcacagtagattagggcacccttctttttctgttgtcaatcgcgtcattagccaaaataatctcccagttgttagggattctagtcaagagtttgtgtgtgatgcttgccagaaaggcaagagccatcagctaccctaccctaagtccagtagtgtttctattgaacctttgcaacttgtgttttccgatgtatggggtcctgctataaactctgttggcaataaagtttattatgttagtttcatcgatgactttagcaaattcacttggatctatctccttaaacacaaatctgaggtttttgccaagtttcaggattttcaaaaccttgttgaacgcttgacgaatagaaaaatcaaagctgtgcagacggattggggcggggaataccaacgtcttaattccttctttcagcgcattgggattgaacactacgttgcctgtccctatgcgcatcagcagaacggttctgccgagcgcaaacaccgtcacatcgttgaggtcgggctctcgttgttagctcatgcctccatgcctctcaaattctgggatgaggccttcaccaccgctgcttacctcataaacaggaccccaaccaaagtgataaactttgagacccctctacaacgtctgtttaacctgcccccagattattctctgcttcgcaccttcggctgtgcctgctggccgaatctgcgtccctacaacgcccgcaaattagctttccgttctaaacagtgtgcttttctgggttatagcacgcttcacaaaggttttaagtgcctagacatctctacagggcgtgtgtatatttcccgtgatgttgtctttgacgagcaaatctatccctttgaaaaacttcatcccaacgccggtgctcgcctccgggctgagatcaatctcctcccggcgcatcttcttccgctgcttgatcacgggggtgtacagatgcatgatcaaccgctgattgatgattctaatcctgctaatccaattattgagaatagtgcaggcagcagtgcaggcaatggagcaaaatcaggggcgcagcacgggcatgatttcatgcagagttccggcgggcaacctaccggcggccatcatgactctctgacgcacagtaccatgcatggcacggagaaccaggcggaccaggagaactcggcgtcatctcgatctgcagaaccggtcacgccgcgacacgcagcgagtccctcggccgcgccacacgcggcaaccgcgccaatcgcgtcgtcacacgcggcagcctcgtctctgtcgggagacattgtgggaccgggttcacgtgggccatcgcaggaggatcaagacacgtcgcaggaggatcaagacacgtctgcatcagctcctgcttcttccacatcgcatgatgatgatagtgctcagtttgccgctcagccgactcgaccagtgaccagagcacagcgtggtatccacaaaccaaagaagtacacagatggccacggagggtatggcngacttacacataccgggagaaccaagtatatctccaaggagtttagagaattctaattggaagtcagctatggatagcgagtttgctgctttagtgagaaataaaacctggcacctagttccaccaaagcagggggtgaatgtaatagattgtaagtgggtctataagattaaaagaaaggcagatggaactatagatagatataaagctaggttagtagcaaagggtttaaacaacgttatggtattgcttatgaggataccttcagtcctgtagttaaggctgctactattagacttgttctgtcactggctgtgtcacagggatggagtcttcgacagcttgatgtacagaatgccttcttgcatggctatcttgaagaagatgtgtacatgaagcagccaccaagatacgaggagaaaaagatgccacactatctctgtaagttggataaagctctgtatggcttaaaacaggcacctagagcttggtactccaggttgagtaaaaggctacaagaacttggttttgtttcatctaaggctgatacatctttgttcttctataataagaagggacttgtatgtttctgcttgtatatgttgatgatattatagtggctagctcttctggtcaagcagttacagttttactcaggaacttgagaaagattttgctctgaaagatcttggggatctgcactactttctgggaattgaagtaaagaaaactgagaaaggtctgctggtgacacaggaaaggtatgcaggtgatattattaagagacctggaatgagtaattgtaagcctgtgagtactcctctctgtgtgtctgaaaaactgtggttaaatgatggtgaatttttgggtgcaaatgatgccagtcagtacaggagtatcgttggggctctacagtacttaactcttacaagaccagacatatctttctcagttaataaagtgtgtcagttcttacagaatcctactattgtacattgggcagcagtaaagagaatacttagatatctgcaaggtactcttggtcaggattaaagattgacaaatccttttcttatattgttagtgctttctctgatgcagactgggcaggatgtctagatgacaggagatctactggaggttttgcagtatttctgggatcaaatttgatatcctggagtgccaggaagcaagcttctgtatcacgctctagtactgaagccgaatataaagccttggctaatgcaactgctgaggtaatgtgggttcgtaaattgctagaagagattggtttgttgcatccaggaccttctcaattatggtgtgataatattggagctacctatttgtcagcaaatcctgtgtttcatgctagaacaaaacacatagaagtggattccattttgtcagagaacaggtggcgcagaaaatgttggaaattcggtttgttccgtcacaagatcaaattgctgatggatttacaaagcctcttcctgtgagacaattacaattgttctgtaacaatctcaatcttggagagttgagattgagggggagtgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacaatactaaatatcttgaagattggttacttcatactctatcaatgtatcttctggacatgtatatcatcttgaggatattattagttattacctattcttttttcttagggtatttaatgagcatccatctattatgcaattttatgggtttgcctatgttatatctccacatgtgcaatgttaggtacagggcccctttatttatttatttattgggaaaatttcagattactacatatttaatgattaaactatcaacttgctgcaatataaatgacatattttagatagctacgataatacaaaataaaattatcataaaactgtaactctccagaccctcttgtcacttaaacacctggcttatatgccatacaaactctactagatggaagcgaaatgatgagaagtgtcacattgcaagtaggttatgtatgactcgtgggcctcgtgtgtcagtaataagagggttctaacgaaattgtagatttattttttataatttaatccactgtcatcgtagctaattgaaatatattgttaatgttataacaagtattcctactttggccatgaaatttatcgtccttttcttttgaatctacatgcattgactccttgttttggttgtggcatttaggacctttctattatggttgaaatgtattttcctggagaattttgactagccataagaaacatttttagtgcgtgtccattgcacgagtgcaacatgacgcattgctgcaccatgtgtattgttgagcgccgctccaccgcctccctttcctgcatgacaacacctttggcctccctactactgatgttgttggttgcaaactattactccttataaatcaatcggttggtgaaagatggatgttcatactaaacatagtaccgcaaaatgccatcaaatatatgtggttcttagcacatctcatcgatcggtgcaagaagcacccaaagataaaaaagctttacctaagcacctgaatactgatttgcgttggccgctgagtcctcgtcacgaagaacatggcggcatgccgcgtaaactttcagatgaacttgatagagttgaagagtagcgtggtgcatgttccggcttccgtttctacgtatactcgaaactcgaaaccgcaaacaaataggcaagaacgttgagatttccgcaggaatattgcaaatctttcatccagggtttaaaggatgatgttgaaaccagagataccgtctaatttcagttcaaccgcaaacggatctcaagatggtttcatttttggagaactacggctaggcagcagcatgttggaaaggctgtcatgcaactaacggccaaagcattttggcccgcccataagcacaacttatattctactttccgaagcacattagagtattacaaagtgctccaggataccgtctcaacaaggaaaaagaaaaagaatgaatgaacgaaagaaaggggtaaaaaaacaccttcacactgaaagaaagggaaaaaaacacctgcacactggtattatagactttactgtggaagaagcaatcgaccattcaaaaaatgactatgcttccggtgtgcacactccacacagatatggtacggagtaagactgatttgcattcttacatcaaggctggccatcacacgatgtttcccatctccaacttccttagcaagatcactgcatgcaatactgtcagctgctcctgatagaagcacatccacatggatcaaagttctcaccttgtttggaaaatgaaaagggtatcagctcttaacactgttctgcaactcactgagagctgccattcgcagggcgtgcgaacttgtcggtactccagcagggccaccgggaggatccacctttgtttgctcattattgtcttgaaagtcatgtgaaagttgcagctttgataaaaagctcacaatattacatgacaacaactatatttaatgaccatcagtcagtcgagtagtcagagtcgaaccaagcatgccatggtacccagtctaccactccacaatgtgatgatgcacatggattcattgttcatcnaagggcccttctctttgaatcaagcacatcagatggggtaacttgaaaatgctaagctccagataacatgataacatataacaggattccatgagctctacgagtctggcagaaagtaacatgcatgcctatttgccgtacacatgtaaaagcaaacaatagggacttatagaacttctgagcactgggataatcatagtttttcaattaatttctacattggctgtaggagtcaatccattgacaacgatggaaactaagctaaggtccatggttcaaatgaacctgattaacctcagacaatggttttataggtctcctaaccaatataccaacattgtgggaggacagaagggtgttatcctctttttacaaacatataaaaattttgtggcagaaacctagatcaagttcattttttatttattccaaaggctgataccgttgatgaaatagtgatatactgacacagaggtatcaattccatggtaccgagctaacttgtttcttagacccaattgctacttcaaacaatagcaccagagaggctctccaaatcaattttcagtacaaaaagaaaatgtggagagaaacttgtgaagaggatgccacgcaaacatatagtgagaaactgagaatctaccttccaagatcctctcgaaaatttttaaaacgggtaaaaaagatataggcatcagcaagaaccaacttatctgagataccaaacccttacgttgaaacaaagaccacaaacacaattgacaaaactgagaccgcaatgaacagtctaatagtacttcatagcacacaggtagcaatctaagacacagatagctaattgaaatttatatcataaattgccattttcccagagtaccagtaaccaagacaaagcaaccaagcttcagaagtatatgacaaattcacaagggatgttcttaaccaaaatctgtagcaataaagaaatccatgactccagttgccactccaaaacgtttaccattaggacgacgactcaactaaggtctcaaggggatacagcagcgactactgacacagatagaccccagacattcagactgaaccttgacgacgacgctggaccttcttgaccctcataactgttctaggactcactgtaacagtaaggacatgatatatcaagccatgcacaagagatgatgaagacaagcaaataaacgaaactgttgatagaaaacataagatatgcaatttatattgaattgttctaaagaaaggcatggcatataatgatgatcatactggaggttctaattatgcacctgattgtcctgatcagcagatgactcattagcattgtttgtctgaaatggcttttcagcctcgcaacttggacggttacattttgtgcggaatggatagtttatgttattgcacttctcgcacttccaactaccttctggcatctttggttctgccatgaaatattagatgtaaagattatatagaattaaaaaggacaaagccattacaagaactagtgctaagtgacacgcataacttatgcaatgtggaaataagatggcattgatctcagatttttactggtttcgaggtactaaaggtacactaaaaaattttacaaacaaggcaccgcatgtatgcatagttagtgttaacttacttggacctcttgcaccatcaggtttggacccctgcataagagttgacacacaagctatcagcaaagtaagcatgatggtttaactctaggaaaaacaagagaagtcaaagcatgaggaacaatttcagaagatagatgaaagtgaaattacgaagagaacagctcaaactattttagaatactttgacacgctacagacttcccagaacacagttaatatagcagtactgaaaatcgccggtttgttactgcatgtcagctgtgacttgattaatggctaaggctgagtggacgatgtattgctaagtataggttccagatttgccaaatggagagaaatttagtacatcttgttttgaggagaaaacaatgacagttcacacgaaatgggcaacttaataccttaggtcctggtgcccaaacaatgggcaacttaatacatggcacaagcaaattgtgttgaattgcatggcatgaggttttaatgaacagttcagaccagttactatagcatcgaatataaacggctgtcacattgctaatcttgtggcaacaaggtcaactttaagcatgattacgatgttagtatattgcagtacaccttttagtaagcaaatcaaaaatatttattcattatcagaatttgcacataaactttgaccaattttagatttatagaaagaaagatatttcataatttagtagtagtaatacaataggtgggaacttgcacaagtacaagaagtggagaattgtacctggttttcaggtcttggtgtattgcactttctcatgttacagactgtccggaatgcaaagttaatgttgttgcaattagggcatttccaatcattatcacgcccagctcctaaaataaagttcataagaaaaataaaccaatggacaacaaaatcaatgaacagtcaaaattcatttgaaaatatatacctgcaggcttcttctgggatccttcctcggaatatgaaccagccctcgcgcccttcatcaaagaattgtataaatgagagttgaaacatttcctatcgtgatttatcacactataatatcaaaggacacttaaaggaagcccttcgacagttagacccacagagcacagagtgaccactgacaacatcccacaatagtttgttatgcaagggaaaaacaattgaatcatgctaatatgcatgagcaaatactaataatccagaaaagtttaccattg

SEQ ID NO: 49315 - DNA, 1257 bp, Oryza sativa
tattttgaggacaggaaaatggataagagaaaaaatgtgaggaatagtctcacacgagtcaggacacatattcacaaagagttggtaactttttaatttttatctcgtatgcatttaattcataaactgcaacaacccacccaaaaaaaatatatgttaataactaatttgcctataaaagtttacatgctagagcgtaaaagagtaattagttcccaaagaaacatacttcgcatactagcatttctatcctgtagctatagaaaataaatgtcaggcaaaaagatatttcctgtaaaatctcattctggccacactaagggttgcataaaaagacataaatggtctcaaaaattttgcccattgtatctagtaaatcaagtactcagcagttagtagagtctatattgttgtagcacccctacctggtcccatcatggatccagcagaatatggaggccctgccatatgcatcggcggcccataggggctccccattggcaggcggccaccatagccatatggatatccagaacccccagggaactgagcaataccataacgtggtaaagcaggtccgccatagagggaggtgccataagggggagcaccacccccgaggtacatggatggcggcgtccctgggctcatgtatccccctgacatggggaaatggggcggcggtgtctgcataggtttctgcatatccttctggagaggaggcaacagcacgactaggtaaatgcaaaaatcacgatgagcggaactaatcaaccacatgagcgcgcatcggtggcaatcacatgtaccgtatagtcggtgggcctggattggttgcaattgcgcatgttgcaggtggtgcggaaggcgaagttgacgttctggcagctggggcaaacccagtcgtcctcacgccgcccacctgtgagtcgtcatccataccaaaaatgaaattcccctcagatgcagcttaaacagtaaaggaaagccgcaggttaatcgccgcggcgaagcgacctaccgtcggtgcgggcacgctttccagcagattggctacggttgtcgacctgtaaacaaacaaacaccgcaagcgtgagcttttgcggcgagatcccatggctgatcgacaagcaacaggtccaaatccaacctaacctaattctacgcccacccactcccgcacgcaccatcccgcggcgacgggggtggattcccgcggcagcaatcggagccccccgaccaatccgcggcgacaaa

SEQ ID NO: 49316 - DNA, 6837 bp, Oryza sativa
ttaagtgtgatttatatcttatacatttgcataatttttttaataagacgaatggtcaaacacgtgagaaaaagtcaacggtgttatctattaaaaaatggagggagtatgatacttagatcatttgtacttgttggaggcattttttttccgcttgacatctcctccttttatacatatcacctaaaaagctatttagaatgagaaaatacaatggtaagatatatcaatattttacatgtatattattcacaaacatgaaaatggacaccgttaattttttttcacatgtttgaccattcgtcttattcaaaaaatttatgtaattataatttattttgttatgagttgttttatcactcatagtattttaagtgtgatttatatcttatacatttgcataattttttaataagacgaatggtcaaacatgtgagaaaaagtcaacggcgtcatctattaaaaaatggagggagtatgatacttagatcatttgtacttgttggaggcatttttttccgcttgacatctcctccttttatacatatcacctaaaaagctatttagaatgagaaaatacaatggtaagatatatcaatattttacatgtatattattcacaaacatgaaaatgaaagtggtttcatcactcgagtgggcatacactcaattcgtgcatgccaactaaaaacttatatgagtagaaataaaaataacaaatctcatccatagatgatacacacttttgatcatcatatttgtgtctgttttttttttagaatttgaacttgtatgtttgtaaaattgtatgtttgtaaaatgatatatatcatattgatatatcttactttttaaaaaaattttcatggtagctttttagttgaatgcacaaaacaagtgtatgtccacttaggtgaaaaataagtttcccagtaaaaaaaatgatatactccctccgtttctaaatatttgacgctgttgacttttttaaacatgtttgatcattcgtcttattcgaaaaatttaagtattattaattcttttcctataatttgattcattgaacaatatacttttatatatacatatagtttatatgtttcataaaagtttttgaattagacgaatggtcaaacatgtgctaaaaagtcaacagtgtaaaatatttagaaacggagggggtatatacaagttatctgttatttttatttatacttatataagatgaatttgaatttatatatttatattgtgatatatcatatattagtatatcttgtgacttttttaaattttataagtgaaatgaaaatcgatgggagttcctctcgaggaggaaaaagactttgcgatagtacgtacaaatagtgaatcaatgggggagaacatcttattctgacagattacagcagttgtaaccagtacattgctgtgcgttaacagttgaccgatcagtgagtctctgttacagcaccaagtactctcccggccgtgccatgctaaacatgtcttgaataagaatactcaaaacaatccaagccacaaacatgacacacacaacacaggtgcagtcactgttggatcaagaattgcccgcatttttcttcaagatcgagtttgaaggacgagacgagagcaccaccacatattctccgtgagggtaggcaggttatagagtccgactcgtgtccgaaattggtcaaacttgcatgacgctctcatcgctctcgtacaccatctccactctggcgttggcctcgcccttgctgctcccatcgacgtaaaccacgtcgatgctgtgcagtatcgggatcatgacgacgaagcagagcaagcccaagacgggcccgaagatccacagaagaagcggcacgccggcgtagaacagccggtttccgacgaggttgaggagaaatcctctctcgagcacgtcggcgacgtagtccttggtcaccggcagcccggcgatgtcggcggcgaaggaggaggaggaagagagggtgttgaggaggaaggtggcctggttgagggtgcagatggcggtggtgtgggagagaaaggagaggaggaaggcgaggaggagggtgacgtacttgagcgccatcatgtactcgccgtgggcgccgaacacggcgtcgctgagcggcttcttgacggtgtacgtgctgctgaggatggcggcgacgccggtgcagaagaggatggccgtcgtcgccatcagcgtcgaccccattatcacgttcctcatcgactgcaccaccagcaccgccttcttctcgttgtcctgcgtttccaaaatccattaatccaatcgatttccgggccatgatcgaacaccatgatcgacgtggttggtaccttcatcatgcccaagacccagaggcggcgggtggcggtgttaatgccgacggtgaaggagagcggcgcgcggcggacgacgtgccacagccagacgtggtagacgatcgggaacacgatccccgccgggatcagcacgaggtccaagtagctgtccttccacgccatggacgacctctccaacctgctctctcttcttcttcttccttgccggccgctcgatcgccggagtgcgtcgtcggagaagctagagaggaggaggtggtcggcgtctgcactgtcttaattttctctcccatgtggagattatatagtgatgagctagcaagctagagcaaaaggtaggagatgacaaaatgtgcaccacactgcacatacggttggttggttggttggtggaaacatattcaaattccacgaaggcgagacgagaaatagggaaaaagcaattgtgacctaaaaaaatggtcaagaaaaaactgaaaaagaggggtcagctgatgagatgaccaaacctcatcttgccgcccagttgtgacgaaggagatagctccctagtgctgttataatattttagttcaatttcccctttttccttttctgttcttggttttctttattcagaaaagctttttactggtaaaggaaaagatttcgagtctatctggatttgtttagtgtgatactacctccatttttaatatatgacgccgttgactttttatcgatgtttgatcattcgttttattcgattttttttgaaaaatatgaaatatttaagtcattcttaaaaaatatttgatataaataaagtcacaataaaataaatgataattacataaacttttgaataaggcgaatgttcaaacgtatcccaaaaagtaaacgtcgtcatatataaaaaaaacggagggagtattagtgcttttggtctaatataaatctatcacgcccaaaaaataaaataaaacaagatcactttacaagtcagcctttttgcttgaaatgtattgtaggggcatgcaaatcttatttaattaatcttgtgttaactgatagggtgttaactgttaagtgccctggaaaggaaaaattttgctttttgcccaacattctcctacccctttaattgtaaattaagctgcaggatatacatgtgcggatcatgggttcatacgtgcaggctgaggcagcagaaatgtcaattcggttccccaccgagtgttgtgaagaatgtttcaagagctagctagcgagtgacaggtaaactgtatgagttaattaattgccatgcttgatcgatgccaccacaatgggcaaaaactcataacaatctgttgttacctattcgggaaaacatagttcggtgtggtagtgaaatcgtagatgcatgattacactcatcaatgttcaaatctcaatatccataaattccgctgtgtgtatttctagttagtctagggatcaggaattatatatgtttccattgtaaaaatcactcgcatttagtgttgtcccactgtaccataatactctctccatctatttttgatagacatattttcaaatctgaaaaatttatttttgataggcatatttcaatccaacaacttatcatcttaatggttttcttgaatttaatgcgtgactctccattcttccacacaagattagctgcatggacatcgagaaatataaatattaataaatcgcctgtttacgaggaatgactagtagcatgtttaaatggatgataattagaatcacttatccttggtctgtgtgccatgatgaaatatgactattaaaaatagataaagggagtattatttagatattaaaaaagtttagatatgaaataaagtatacatgtaatttattatcgatttttaaattacatttaattagaaagatttcaaaaagtgatcgacatgcatagaataggacaatacatattaccatatcgaccctcggccttacaaagtagtattctttatatgtaacacatatgcattcatatcagattagtggaatgctctcgttacaatatactcgtggttagctcaaaattaaacttaccaacatcaaataaaggggtacgtgtagtatataatatattcaccgagcaggctagcaattcttagtggggttgaattgtaaacgccttttttcattgtaaaaagaaaaaattctatatagtgggttgtatgagctggataaacccctcaacaaaagcgagctcgctgtctacctgaaaatgccattagccatttagccacgcctctgtgtatgtcggccggccggccatatgttgggttagtcttcgtcacagcgcacgatagaaactagctagtgtacgtagtattcttctttgccatcgtcttcgtcttctcctcctgatcttaacctttttttccctctctatctcctgtcccaatataatttgcattgcatctcctcgttggattggcacgagggaggcagtggccgccgccgccggatgcacgcacaaaaataatggagaaatggtggtagctagcgtggtagaataacggccggcagtgcgtggaagttactcgtactctcttcgtttcttttttatttgacacgttgaccaatttgattttttaccttttacaccaataaaaaaattttgaatcacgatttttattacgagatgctgtgatgaatgcaacagtagtatgattatatttagcatgatatctttctcgatgttcataactatatatattttaaaaaagacgagcagtgaaagtttaatttatatatagtatccggtgtcaaataaaatggaacatatgaagtactcctatatatattgttagtcgcgtgcatgggttgcattttgattgttggtgtgttgcactcatttgatgagtgtcaaagttactcagaaagtgttatatatctagaagataagaatggcatatgcatggaatttttttacacggagagtttccatatctccggtatataccatatatatacttgatcttttaggtcagggcagattgacatgttttagtggacatatgtcaccctagcacttcctggaaagatcaatctgttttggagtgcagcatgaatatatgcattttctatcacaggcttttaagatatatatggttatagtgaaagatgcaacaaagttctcctgcgttgatctgggaagaagcaccggtagtgtgatggtgaattcataagtgcaggagcctccaccaaggttaaatacttgtgcccataaatattgcattgacatgagtatgggaatttagtgaagaaaaggaatttgtcgctggtttccaaatttaactttttaagagtgtgttatgtgatatactcatgggtgtgtgtggatatatactcatgggtgtgtgtgcgcatgtggcgtgtgcgtatatatgtatttttggtatagttgaaaacaaaaaaggtgattaattaggatatgtgaaaactaggtgtatgatttggttaaacttttaaaaccgtgacaatccgtaattaattacttgagaattattaatttaaaacaaaaataatggtatgagctagatttttctttaaaataccatcgtagtaccataaagtttgttactagacttataaacttaatctgatataaaaacaacaacaaaatgagtagaagaggcttctaaatcttacataaagttgataattaaaagttttaattaaatcttattctaattaatgtcaaatatttataaccaggaagtactttagcattctagcaacgtactatgtacatatatatgatactttatttttatagaaaacaatacagacgtcgcttatatacacatgcgcgactctatgaacacgcatgcggtacccatgtcaagttgaggacttgaatccgggtggacagatttccccgtaagataccttaccagttaaggtacgctcagttcatttctacatttaattttaatcatgcatataaaaaataaatcattttaaatgacaaatctattggagtcactttttcctaaaaatatcttttctatgtattagctatagttaatattttgaaagtcatcgattacgtatttacccgccgtctactacagctagtacctataagtttgagaggctgagggagtagtaccatccaaccactgttgccttatcaacgtatatctcatccaataaaactgaggctgtgccggccgccacggccgtatacctgctacttgacatatacccatgagtttaatttgagtttaatttggcctcactttatcgtctgatcaaattctgacctcactcgtcttccttaattagatggagtttagttatgtttgagattgataagatgaagataaaattaaagcactcaaaatgagaaagatgttagtgcataacttattaacttttaattattacagacttaaaaaaataggtttatttgatattttaaagcaccttatatataga

SEQ ID NO: 49317 - DNA, 2322 bp, Oryza sativa
ctatatgtgtaagactaaggacttcaagtgattgaccatgcaattaatcgatgtatggcctaaactttaaaagatgttgaccactggtactttatacagttaattaacagaaatggtactctatgaagcttgtagcctgtttgtacaaaaccgtaccaccagattgtgcggctctcatgcattagagaatatctaatgaaaatgttgtgggacggtgcacatatgaagcacatgcattaagtttgtgtctagttaattatgcctgagttaggacatttacattattcaacctttcattcgatagagaaaatattttgttcgcatggaaaatgagactatgagaggggtggctgccatcaaggacaagaaaagcgataaaaagttgtaaagatttcaataaacaagccacttagtcacgcgatgcgtgatttttaattccgtataagaacttgtatacggtctattagtttacagaaggttttagcacgagttaatttatttacaaagtatatattggtctagctaactatagatttagttatagaaatcactataaccccctagtttttgttttcttcgttatctttgccctctttttgtaccatgtgtctaagagggggcactagaaacctccagaaattcctatatgtttatcccattgttatttttttaatgcatatgtaacctttttgatcccatggctattatttatctaaattctttattcaatggttgatatatgtttttttacgatgtggcgtattctcgtgtaagaaagattgctgctttcactatataagataatatacatatgaaaattagacaattcctattccctaatgtactttgtccatcagggttgcccaagggcccagggatttcaagttccatagggaaaaccaaaattagtagttcaaaatataacacgtggtgagatggagttccgccaatagttttcaagattctagaaattcatataatccacttgaacaatatgtcgacgatgcatttaagaagatacttcctccgtttcacaatgtaagactttctagcattgctcacattcatttagatgctaatgaatctagacatacgtatgtgtttagattcattaacatctatatgtatgtgggtaatgctagaaagtcttacattgtgaaacggagggagtagtgaagaagcaagtgaagcaggggcaggtagggcgagagatagccagggctgcaatcgtactcctgagcttaaatacgcattgaaatttgcacttcaaaactaaaaaaaaaggataaaagcaaacttattgagcactaggcttggaatattctagatctgccccttggttcatgaattattaatggagactgtagtttgcaaaggccttgtgttattgggcctgttcggctgcactcatacggctgtggtgcagccggccagaacagtactttatgtaagtagttgtagcagtaacactgtggtacagctgctgcaccttgcagccgaacatgcccattagcggcacatagaaccttatatttgtgtggcgttgtagtttaagccaacgcactatcatggtttaagggagtgtttggctaatgggataggaaaatgatttcccacccactaaaagacatctttaaattctaacaattcattatccctcttccatttaatcctaactcttcatttatttcccaatcctaattccatgccacatttttcattatccaaacacaccctaaaaggtcttttagtggcgatggaattgatccatattccaacaatattggatatggatatcactgaagttgtctaagccccttaagttgtccattgagactttgagagatgcctgggaattgaagcaaggattgctgaagcaaaagaggcttaagagcttgcacagatgagattgtgtgttcccgtaggaatccggcctagactattgtatcagagatataatcgctatttttataattataattaataaagctctttctttttaccttaaaaagtaaaagatccgtacatacgatccatggtgatggtgtggtgttggcggaataaaagcttacggtacgatgtaggcgctcatatccaatcataaaatttcgagttgatatttttttaagaaccaagtataaaagtatcaatgaagtgatatacggatctcgagatggactaaatagattttagaaacttgtgtgtcatgtatatggcttggaaatttcattgtatatttagcctattagcgtttaacaaatatctaaaagtgctaaataaatacttcctccgtttaaggtgataagacgttttgactaagtt

SEQ ID NO: 49318 - DNA, 2981 bp, Oryza sativa
  unsure (1)..(2981): unsure at all n locations
ggtacgcgctgggtggcgcgtgcagggtgctcgccggaatgcccgcgccgctcggggccaccgcgctcgacggcggggtcaatttcgccgtctactccgcggcgcatccgccgcgtcgctctgcctcttcacccccgacgatctcgaggcggtgagctcgcttcagaccaccacaacggtgtcacgcgttcctcgcgaagttctcctttcgttttcagtggctctgttttttttttaatccgatgattagttgaggtggttttgcattgtgtgggatggtgcaggatgaggtgactgaggaggttccgcttgatcctctgttcaatcggacggggaatgtgtggcacgtcttcatcgaaggcgagctgcacaacatgctgtacgggtacaggttcgatggtatgttcgcccctcgctgcggccagtatttagatgtctccaatgtcgtggtggatccttatgccaaggtgatgcattagcttcatttcgccttcttggtgttcttctcctatgtttgtgattgtactagttttgggaggcgcttatctgcagtttttttctattactgtagcagtgataacccgaggagagtatggtgtccccggtcctggtggcgattgctggcctcaaatggctggcatgatccctcttccgtacagtacggtatgccaacgaatcagtttccttttttttttaactcccacttgtttccatttatcctcttttgatctgatacccgactacccgaggcagtcattatccgattatctggttgctgaatgtacaactaagatttgcatctttttttctaatattgtaattttgataataataataataatatttgtttgcaagtggaaaagaacatgatttttttttttccgaaggaattccatttattcgttgctgctatgaagtggaattgcatttatgtgccttgtaaaaaaatgaattgcattaatttgttgttgttactgtctatgatattaaatctcacagtaaaatgtttgcatttgcagtttgattggcaaggtgacctacctctgagatatcctcagaaggatcttgtaatctatgagatgcatttacgtgggtttacaaagcacagttcaagcaatgtagaacatccagggacttacattggggctatatcaaagcttgactatctgaaggtgcattttactaattacctagttcggtcaagaagctattgggccacagagcaatttataagactgttacatattcattttttataagatcttcacgtacatctagattttgcatggcttttgctgaagatatcctattctacaacttaaccataatcaagtatttctaagaccttcccggcgaaaaaaagtatttctaagacctatgctgtactttgtgatagaacacttaaaatttggtctatgcattgacaaatttacttagtgtcccagcattttttttcttattttgttcatgagtggtccattaagtgaatagctgtaataatagcctgtttatatttttagttgtgtgtttattcttaatttaaatctggaataacccctctacaggagcttggagttaactgtgtagagttgatgccctgccatgaattcaatgagctggagtacttcagctgctcttccaagtatgcagacttacatccagaattgagctataagcagtgtttgaatggggcctaacgaatcttactctcgaaaacttgatttccccttctaactgtgcattggntaacattcagcaactattttgcatgaggtgttgtgtagacatgatagatatgacctactgctaacgctaccatcttgacttttataagttgataaaataaactagtttttctttgtgagatgtaaacaataattaatgttggtcacatcaatatcgtattacatttgaataattgatagcccaaatctcccactcttataagaggttccacatgcatagattttgcatagttgcagcataacagccttttctttgtctagattctggaatgtgatttttttttccatctctaaactcagtttacctttttcccttcatttgcatggaatgttgcagttacgcacttactttcttgtaacatgtgtactgtgtacatccatacatgtttttacattattatgatttttcatattttcatagaaattcaatcattttttatattatttcatataaactgctcactatcttaccaggatgaacttctggggatactccacgataaactttttttcaccaatgataagatattcatcaggtgggataagaaactgtggccgtgatgccataaatgaattcaaaacttttgttagagaggctcacaaacggggaattgaggtaaccaagttgatatagctaattcttgtttagtaattgctgctttctcaacatatttttttacgtggggatactctattaggtgatcatggatgttgtcttcaatcatacagccgagggtaatgagaaaggaccaatattatcatttagggggatagataatagcacatactatatgcttgcccctaaggtgcgttatattgctcattgtggaaacatttctttttttttcttcagagatgtatataatgcagttttattatgtaattctatctaagaatttgaagggtgtttgtgcctacagggagagttttacaattattctggttgtgggaataccttcaactgtaatcatcctgtggtccgtgaatttattgtagattgtttaaggtacagttataaatatatatatatactgcacagtaaaacagttattgatctcttctcactgcttatcattttgtcaagaacttcaattgcaagcctgtaagggttttattcttttaatctccagcaaattgcttttttctgttttcaaaacacatactgatgatgtttcagtgcttgagtatatggacacttggatattcttctatattctaataaagcagggaaactat

SEQ ID NO: 49319 - DNA, 738 bp, Oryza sativa
gcccataaatgtacacagaagataatacatgaactgaacggtgagctatttctcagggctactgctaacaatacataaatacgccttttggtctttagcagggcatgggttatgaaaaagtaagaaacaacagtatactaagcttatatttgagctagacactgaactttggagttataacatatgatctgcatccatctaaagttaaaccaacatctaacatagttcccactttatatgtgtaattgttgttttatcatagcactgacttatattatgtgcttgtttctccagtaccgggacattgttcgtcaattcattaaaggcacagatggatttgctggtggtttcgctgaatgtttgtgtggaagtccacatctataccaggtacatagtgaaatacctttagatggatcgggtacaatgcaaattggatggggtctttggaaatgccacacgatgaactggtgataatagtgcatgaagcttacagttataattctagatccacgcatagcctttaacacacgacttgcgagtaaagaaaatggtcttgttttcttttcattcattttttggggtgctcttgtgtctggtgaggcttctatttggcctaacctctgaaaaaataacctccatgccatttttattttcttttgtccatttctctttgtgaaaagaggttatgttagatactgatagccaattggactagtacatttctgacacttaaaaata

SEQ ID NO: 49320 - DNA, 1074 bp, Oryza sativa
ggtgttggacgggttaagcgcccagatggaggtcctgcagccggagcgggtggagctcgacgcggcgtgggcacgcgtcgaagagggcgacgctcggtggaggccatggtgaaggcgggccgcaaggcacaccgccggcacgcctcagagctcgaggcccgtcgaagggagctggcggagatcgccagggaggtgaagaaggagcggaagactgccctcatcgccaccgccgtgctcgacgaggtgcgggacgacctccgtctccaatacgggagccgggcgtggagctagagaagaagctcgacgccgcccggggagtccttgacgccccgctgcccgggaacggcgggcggcggagaacgaggcggcgtcccggcggcgcgaagaggcccttgaagctcgctccacggcgctggaagagcgtgcccgcgcaaaggagagggacctggcggaccgcgaggccgccctcgccatctgggaggccacactggcggcgcacgaggcccgcctgcgccgaagaggagtccgcactctgcctctgcgaggatacgctcaccgagcgggagcgagctctcgaggaggccgaggccgcggcgcagcggctggcggacaacctgttcttccgcgaggcagcgcaggaggagcaggcgcgccgcaatctggaaggcgcccgcgccgagagggccgcactggctcggcgggccgctgagctcgaggcgcgggctaaagagctggacgcgagagcgcgcagcggtggggcggccgcgggcgacagcgacttagccgcccgcctcgcagctgccgaacacaccatcgccgagctgcagggcgcgctggactcgtccgccggggaggtcgaggccctccgcttggcgggcgaggtagggcccggcatgcttcgggacgccgtctcccgttagaccacgccgggcggcaggcgggcctctggggcgagcggaccgcgaagtacgccgccaaccgggggggcctcgcccagcgcctctcagagatggctgggaccctccagcggctcctcgaggagctcgagaagacgatcaagtcatcctcgagaga

SEQ ID NO: 49321 - DNA, 1236 bp, Oryza sativa
  unsure (1)..(1236): unsure at all n locations
agttcacgggcaagatccccgacttcccccagaaggatctgaaggtgttcgacgtctccaacaacgagctggatggggagatcccggcgagcctcaaatcaatcgatccacagatgttcgagggcaacaagaagctctgcggcgcgccagtcgacgcgaaatgcgaggcgccatccccagcggcaacgacgtcgccgccggcggcgacatccggcaagatcgggacctcgccgtcttccacggccgccgccgagacaaccacaacgggcacagtgccagccgaggaggggacgcagggcgcgacgaagcccaccaagggatcgacgtcgttcggcgtcctcgccgcgttcctcggcacgctggccatcatcggcttcgcggtggtcgagctccagaggcggcgagagtacaacacccagaacttcggccctgcagcttcaaccaagcccacattgccatcagctcccgcgtcaccagcaaccaagcccacgcacgccgccgccgncgncaccgccgaagccgccaccaccggaggaggcggcgcgcgaagcagcagcgtgagcgggagcacggcgaggggcggcggcgggaaggcgggggagcaagggcggctgacgttcgtgcgggacgacgacagggggaggttcttcgagctgcaggacctgctgaaggcgtcggcggaggtgctcggcgccgccaacctcggcgtgtgctaccgcgctacgctcaccggcgggcactccgtggtggtgaagcggttcaaggagatgaaccgcgtggggaaggaggacttcgaggagcacatgcggtggntcggccgcctntcccaccccaacctcctcccgctcatctcctactactaccgcaaggaggagaagctcctcatccacgactacgtccccaacaagagccttgctcacctcctccacggtaatccacacacaccacatttctttctttttattagcttccttgttggcttattataatccacactcaaatttaatgtttaaattttaattttaagccacaatcagagttccaggtttcaaacttgatttttaaagtttgttttggagtattccttttatcctagttttttttggtagattggatcaatgccattataaatttaccgtattagaaatataacattattattcgtggaacttgttgcgtgccaccagaattttctaaattttcaaaccatggcatcgccgtcaaattttctgccat

SEQ ID NO: 49322 - DNA, 2448 bp, Oryza sativa
cttattataatccacactcaaatttaatgtttaaattttaattttaagccacaatcagagttccaggtttcaaacttgatttttaaagtttgttttggagtattccttttatcctagttttttttggtagattggatcaatgccattataaatttaccgtattagaaatataacattattattcgtggaacttgttgcgtgccaccagaattttctaaattttcaaaccatggcatcgccgtcaaattttctgccatgaggatgattcgagttttagaaaatttcaatgcccccacaacatgtttcagaatattaataatatttttaatacggtaaatttgtaatggcatggatcaaatttacctatttttcaaccccaacaaatgataacttaggtataataaaagttttgactcgtaaattattgttttaagttgtttcatttacttttctataatttttcatcattgaagctaattttcttttgggggggggggggtgtggatttgtaggtgagggtcggagggtgaaaaagctggtgcactggccggcgaggctgaagctggtgaagggggtggcgcgagcgctccaatacctgtacgacgagctgccgatgctgacggtgccgcacggccacctcaagtcgtccaacatcctcctcacggaccgcttcgaaccgctgctcaccgactactcgctggtcccggtgatgaaccagtcgcactcggcgcagctcatggtggccttcaagtcgccggagcggaggcagttcggccgctcctccaagaagagcgacgtctggtgcctcggcatcctcatcctcgagatcctcaccggccggccgccgtcctacgacccgccgccgcagccggaggcggcgacggcgaacggcgacctcgtcggagcggtggcgtcgacgccggagggggagtggctggagaaggtggtggacgcggacatgatcaggaagtgggaggacgaggagagcaagggggagatggtgaagctgatcaagatcgggatggcgtgctgcgaggccgccgtggacagccggtgagagctcaagacggtggtggagagcatcgaggagctcaagggggggaaggaggaggacgccaacgacgagcactccttctactcctcgatcgacggcgacgaattcgccagcgtcgtcatcaactaactcggaaatcaacccacattagcgcgcgcatcggttgtaattaagcagcatcaaatgatatgttaaaaagctcattatgtaaagtatacagaaatgatgcctaacacactaaatctgaactagcattctgtacttcatgtacgtctttttcgatttttttttcgttagcatttgactcatttcatttctcttttttttttttgctagtggcacaaaggccagggcacagtatgttcatgtcgtgtacaatatgagcgattttacggtccagaaggtcgtatattttagtttaaatttgttatgcctcactactaattagggcatcatcggtgtatgaaataaatcgaaccatcgcacttaaaattgtaccaacaagcacacaacactacaggtagcaaaccaaatcggtacaaggcaaaatggaaccatgttcttcgttcaaacctgtcaaagatagcttgtcgtccctcctatttttggcatcgtatcttccatatttggtgaacggggaatgcatagtaagccccactattaccttccgttctctgtaatattttccgattattcactagctaggtctatttcactgaaattagcccgtaccaattgtgcatgagttaagccattcctcttctctctcgatacacttgcatggtgacggagcatggggctcctcaccgggagaccgcgcaggcccccctttgccggttcggccgggggcgctaagtgaggttcttcaccctcgatctgtggaatgtacgcgagagagaaaatgcacgagacacgggcgatgtagacaggttcgggccgctgagaagcgtaataccctactcctgtgttctggtggatctgtgtgtgaaggggttacagagaactggaaagcaagagagtacaggctctagaacccctctttctctttctctcctctatcagctcaggtattctctaagttctcctcctcccggatcccggatcccggatccctttcttcggtgggtaaggtcctccttttatatctcaaggggataccacatgcaccacttctacctccccttcttttgggtgaggatttacaatggctgctccgaatgaccctccgatgggatgggtcatacctacctccacttcgctggaagcaaatacaacatgggagcacggtttgtctgccgatgacgtgaccggcgtcagaccagtcacagaccggtcattcttgtccaccacgcgtcagtttagcatgccgcacatctgtccttcttcatacaatg

SEQ ID NO: 49323 - DNA, 8080 bp, Oryza sativa
cgcggtaaagtcccttgatgccctcctcttggaacacctcagctaaggccgcgatcatgtggggcgggcatttcccttgcagggttccaaccataagccgcttcctcgccacttccagagggaagcttattgtacttgcagtagacctagaagatccaacatcaaaattgtgaaaagaggggtatactcaaatcaaatgctaaacttctcgtgaattatcccatttctcaggtttatcagaatttttgggaattaaattgttagctagtgaatttctaatcagcaggtgaagtggcactgaatgctaacctgaaagagctccaataatgagtagctcaggacggctcaaggacttctttttatgtgcacggcaataagaagtcttgatcgtctcatacatgaaatagtagcaggtgctataaggaagcatgccaactagtgttgggcagaggccagcatagagaccaccaataccatcagtttggtatatcttgttgaaggcaaggccgatacttggataagcctcacggttgacagtcaggcggtcctatgatagaacatcagagtatcagactgatgtacatggataaatggcttgccagcagaaagatataaaaaataatcagactcaagctacgtaaaactattttgaagtttgtcagtattttgcactactttgaacatagaactacaaaacctacagtttaattaaaaaggaaatatagcataaaacacatcatgaattccaattttcacagctggaaaagccaacagatagtttagaccattaatacgctgtagattatgaagtaccttaagaacctcaagaggatggcacactaaggtgctaactattccagcagccgcaccaccaacagcaattggagagagcaagtgaagtggtagctcaattttcaaattgccaatttgtatatttgggcacccatcttccttccatttctcttgtgcttctgtcatgctccttttgacacactcaaatgtgccaagctcaagtgcttgagttggaataatccgaagcatatttattgtattacctgcccagagtccttgccagccattttgttcgacgatctccacaaaactaccaaaaatgtgttttgatcctaccccaacaaccattcttgtcctgaaatcagacaccatgtaacataatgcataattcaacagcagtcgattgaaaatatttttttggtaaacacacacacacacaaaaaaaatgaccactccttttttttattttgtgactaagcttaagcttatatgactatgagtactttggtagtaaatatccgttgttcataataaaagaaacaatcaagcaactactatattttgattctaacatttgaactaaatggtgcatacgactgttcaacaaagccgagaaacataatggtaaagaactgatctcaattatgtttataaggcataattctagaaatctcctcaagtgtaccaacaaaaaataagcaaagcaaaaaagaaaagcagctggtactccaagagcctacttaatcaccaagccaactaaaccatgtaatcagaaaagaagacaatgttacagaagtgagtaaatgaatgcagtgatggatgtaaagtgaatacctgatagtttctagaggagcaagaacagctttagtcatagcaccagctaatgccccactcacgaattctccaacttctctattcctcaggaaattctgcataagatatagtaatggttccaatgttaacaattaataacaacaccatgatttaaaacttacgaacaactttgggtagaatataaatcagtgaaagaactatttctggaagtgttaaccctgaatgcatccaaaaaaacacctacaagcgttttgatgtggtagagctgctatggagatgattgcaacgaacttttcatcacccactgcaaagctataaattcaatattttcccttttgaataggaaagaaagcggaagctatatgtccaattactgactgcacttgtttgtggatttctatgctataaacacctaaatggatctggaaggtacccgaggtattcaagtaattattttgtgttcggtcactacttcttgcctgtcatctgtatctaatccaaactacagcattaactttccaggacacatttccggtttgaaaatttgatcaaaattgtgagttcctaaactacagtgtgctgggtttgcctaattgtcagcacgaaagttcctccacagaggcaacatcactagtagtagggcaaatttgaattgttatttcacatgatccagtccaaattcggtgttggaaattggaaggagaaaaataagggataacaactaaaagaccactcttttctacacatggtagatttgagaagaccaagaaaaatctcaggtaccagatgacaaaattggtgtcttcgttgaaagaaacatctcatcctaccaaattctagaagactattctcaacccgatgaaaactaattgagttaatcagataacacacaaaaaaaagacttgccctactcacactaaaacagagctgatgatcgctgacagccagaagtttattgtcccacaatttccatatatatgaaatatataaaatactgtaaaactgtaaaagggttgttcaccgtgaataatgttttcggacagtttactcgtatttctatatgtggttgtcaagtatttggctcgacgtctatttctgaagaaatatctgcctacgatcaatacaaagaatactagtcagcagtcagcacgtgtcgtctactggcacatggcaatgggaaataggacgaacgcgttgaactaatcctaaataaatagtgccataataagtaacactagttcatcacttaactggataaacaagtagctaaagcaagctaaacaggggggcaaaaacgaggtcacagcttcctataacctgtacacttcagtacttcaccaaaacgagccaacagaaaccatttggaatgcgcctagatcaagaaaatactccaataagcatgaaagaaactttccgacaaaagcagatttttaacagtacattaactaataaaaattgcaacgtgtagctgagcctttatgtctttatcagaagtacacagatcaagattcaagagtacaccatcaacaaaattatccaaatagttaagcaattaaaaagttgaagtacttagacttgaaactggtacatcaaacagttaaaaagaagacttaaaatagagttgaaacgaataatgaaaatcaggagctgaaacttcaagaaagaaatatacggagtacttgacagcctgaaactgaagtactctgaacacagaaaagcatcaagccatcaacgaattagaactgttcgctagataaaacagctacagatcgaacatgaaaaaacccctccatgaatcagaacaaggtgtcccagttgcaaaatcctattccgacatcaacaatcaagcacagcaaatccagttttaaacaaaacaagcttgcaaatttgccgcccaaacagtctccaaaacgtccaatatcccactacccccagacgccaagatctgtgtccctccccttaccctgacggcggcgccgacgtccgggagcccgacggccacgtcccgacgaccttggcgacatcgaagtcgtcgtccttgggcaggcccacgactaacaagtcctccttgtacccgccgccggcgccggcgccgccgccggcagccacggcgccgacacggacgtccgcgaagccgatgctggcgagcgcgagcttcttgccgccgccgccgcgcgccacccccttctcctccatgcccatggctactcgagaggaacgcaaatgcgcgaaaccgcagggggcaaaccgcaaaatggtggtggctcctctcctcgccgccgctcgtcgccgcttttggaggaaaggtggagaggagaggaaggaaggaaggaggaggatgctgacgtggcgaagcgcaagaatttttgtatagcggaatggagatcgaattcatactagtacgtatttatatactgtatttatcttgtatttttccctctttttctttcttgagtgaatattgctacgcgtgtttgtattgtgtgagatttttgcatgtttttgttgtgtttgttcatagtgggatgattcgaaatctcctgtattttttgggagtttctgacatcaatttgcacgtttgagaaatttgtgtggttgtatttttttttgtgtatttacaccaaggcttccttcttgaaactttcctgcattttggcattttggccgtttggaatggtggcctttttcttgagagagacctcgatgtcataaaaaaagtgttttttttcccttttcttttttttttgaaatgatttctcactcaccatgattgagagagaaaaaaataagggaaaaagcgagggctaaagtacaaaaaatgggtccttttcccgaggcgatgaccttttgggcccacaaattattattcccctgcaggatctagcttacacaggtgtgtgggcccaccacgcgtgctgggcccaccgtgatactggagtgataggcccatggacctatgttgtatgggccttacgtcagcacggcccagttgctggttttacctgcagatgcgagcagccgccggcggcggcggtcggagagcgagtggaggggaggatgctgtgccgccggcggcgcgtgggggcggcggtgcggtggctgtcgcggctggcgccgcccgcgccggcggaggcggacccggtggtggtccgcgtggacgggagcaacgtggcccgcctcgggaagcccaagcccggcccgaggccgcggcagctgctgtcgctgccgccgttcccgggcgggggggacggcgacccgctccccgggaggaaggctgcggccccccggcgggtgacggcggtcagctgggtgaagcactacctcgccgacgtgccgcagaaggtcgtgcaggcgcacttcaacaagaggctggtaaaatcgcacatggccttcaaactaatttttgacaaactctttgatgcaaagattgcaatctgttttcttcctagttagtgagacatattagaggaaaagattcatgttgttctcttgcttgaaatgctcttcgggagtgtggactctactactctagtggcgaaatgttgcttggttagtgctcatgtttaagtttttctgtgtttctgcccttgcaagaaaatagtatcatgatcttaatatgtcttatttatgtatgattagtcacttttatttttctttaagttcacaattttccctcttgcaatcttttctctcagtttgatgtcatatgcagttggcactatatttagggattccttttttgtgtatgaagtgaaactatttgttccccgtttaccaggtttattccgagtgctcagatcatgaggtttcagttgagactattaagagccagaagcatcatctcaagaaggtatacaatagagatttcgttcctaaaatctgtttgtattctattgttctgcggtttgaatgaagtaaatatgctcagcagtttgttgcagatcaagcataatgatgtgatggagcctggcatgagaattcaccttcctgtgtcagtggcagagggcgagattaagaagcggtatgagaccattccaactgccacattgcatcccaataaagatgagattgaatacttgagaaggcttgtcatacacaaggtaaatttatggttgtgtgatgtattttcattggatgagttgtagcctacataattcatgtagtatgtgcggataaattatgtaggtcttctacctttgtaccattctataccacaacttggacatacagtattatgatatgaattaattaatggctgtttacatattatggtgcttttaaagtatcataagagtgctgttcacagttttattatgtctgtcaattattgaaaaatgtcagcttgacacaatttgagcactctgtttaattacgcagcttggcatgattttagtgtttattttttggagcttactgattttaattttcataattcagagtcataattgtatgcaaaattttgaaattacaggattctgccatacttgtacttaacaagcccccaaaagtgcccatgaagggaaatttgccagtgcataacagcatggatgtgcttgcagcagcagctctgtcatatggaaatgaagaaggtccaaaattggtgagctcaagagtctcttcatcattggtcagcatgtataaccataagcttgcactgaagatttttctcgatggattttgcgttttgaccacaggttcatcgactggacagagaaagtagtggtttgctgttgttcgggagaacaaaagaaagctttactcgattgcattggcttttcactagcgtcaatttagcaaaaacgaattctcaggtaatgaggcaaaatcaattcattgtgcttgtggttaagcaatttttttcatctaaacaacttttatttgctctctgctgatatttgcatgttaattccttaaattgttgacaaatattataggtatggaatgctgcctgtgaagcatacatgcagaggtattgggcattggtgattgggacccctaaagaaagagaagggattatttctgcacctctttcaaaggtgttcccatttacttagtattactctcagtaatgaaccacctaagcatgtaaaagaaaaaagaactgtttcctctctaagtctgagttttttagcttccaatctttttcacttaactttccactatgcagtaatcttagcacttgtgctacgagtaaccatggattggtcaagtcatatgtgccaagttacatgcataataacatatatttttcataaacaggtacttcttgatgatgggaaagccgagcgtgtcattctggcacatccatctggcatagatggtgcacaagaagctgtaacagcatatcgggtgatgggaccaaccattcatgggtgctcatggattgagctacgcccattgacaggccgaaagcatcaggtaccctcaactcaatattatgttctaatgtatcaagataattaagataatatatgttttgatattattagtggcttagtgctactgaatgcctgagttatttcacatgtatacatatgaaatgatgtttctttactgaaagaatcaatctttccgttttgctcctctgcagctccgagtacattgtgcaaaagctctaggcacacccattgtcggagactacaagtacgggtggtttgtgcaccaaaggtggaagcagaatccccaaccagactttgaaccgtttactggggagccatacaagctgaggcgcccagaaggcttggaaatccagaagggcagtgttctctctaaagtccctctgctgcacctgcattgccgggaaatggtcatccccaacatcgcgaaattcctgagcagcaatggagaatggcatgaaaatggtgctccatggtccaaggagaagcccaatctcctcaggttcatcgcaccgatgcctgcacatatgaaaattagctggaatatcatgtcctcatatctggtgtaagagcatctccatgtgccattgttggtaacatcaagtttcattccatgtagttttactgagaagcagctaggcttctagttcattattttctagattctatagctacatcttctcacagtctgggtgagaatctgttctgcactgcttcgggagcctaagattttaggatataagctgccgctgctagaagctcagctcccccgaatagtgccatagctgtttttttcaggaatgccagattgtagcatctgaaccattgcaaaagaaacagttggtgtgaatatagatcaattttctaagagtatacatcctaccaaagttttaaatctttgtttcttttttgtaagcatgatgtaattctgaacaataattactgtacgttgcagcattttactactaatgaaatgccactgctagtctgctactaatctgatgagtaattccattccagtatcagtagttccaaaagatttgggttttcctgtgctg

SEQ ID NO: 49324 - DNA, 6561 bp, Oryza sativa
cgcgtgggcgagcatgagcgccaccaccgcgtcggcgtgcggcggcgcggcccttggaaagtaggcgccgtctcgccgcggcggccgcgcagccgacggcgaggacgggaaggcgagcctcgccggcgagtggagctcgggaaggaggaggcgagcggagggagaggcaggcgagggcagcggccatggtggaagcaggagagaacccatggtgatgatgacgtcacctctttttcttagcttggcttgtgctttctgaactgcctcacaaaaagggcagggagaaatggaagcaagatttttgagaggaaaaaaattccttgggaattggcaattcatgttttcaactttgggttaactgaatccatattattatcaataataatttattcattttcgaaacatgctatattaaaattcgcaatgtttaagttgtgccattacaatttggtttagaagtcttgataaatgcatatacatcgaaggggcaatagtagtggcactgacatgtcccgaatacctgctaaattttaatagcacagcttgaatatcacgaaattataattagcatatttcaaagatggagaaattataatggcggattcaattataatagcgtgccaatcctgtctgcagaatcatcaagatggtgacaaacccagtgtaacaagtttcagtaaaaaaaatgcaggatttggatcatccagcagttcagaattcagagctaacatctcttttcttctgcgctgataatctgatatggcaaaaaatggtcatcttagcctccatattgcaacaaactcaatctgttcatcactgacggcacaaataatcaccaaagataagcagaggatagcagcaggaagctgcaaaacacaaacctttggctacatgataagactagccctctttgcccaaggtgaataatcaatactcagatgggcatcaggagagttacattgatcaatcgcaaattcacattccatcaaatacatctgttactctgttaaggcgagaactacttcgaccaaattagaaaagaaaatggtcaatagtacaacaataataagaagataataacacaattccgcgacaagcagtgaaccggaagaggagcactcactcaaatagtacagaaaccagaaaataggaaccgaaagaggaaggccaggcttgcgccgaacaagccgaacactacaaatgccttcctcctccttaagcacctagttgtagtacataagctgttgcgctgatgactggttcgggtacccgtcgtagagggcctgggagccagcagcaagaagccctgcggatacctgacctgcaaggccatgctggccagcaatctgcccagctgcgacctggcttaaggtaagttgcctctgatatgctacgatatcagctgccgagaaaccttgtggcacacctgccattggtacgggttgatatgaaggaagtggcggtggcaatggcttggaggatgtaccaggtggggtaggtttgttgccccatgagcactaagaaagaacatgggaaattgcataagtaatcatgcaaaaaattgaaagaacagacgaaataatatttatttgaattggacaataccttgatcggctttccacgcactaccaatccattggccatctgaatagccaatgctgcttcgccatggttactgtatctcacaaacccaaatcctttatcctgttgaacgcgaacttcctcaatagccccaacacctaaattatagaagtggcggtgaagctcatctcggttaacctgacaagttagataagtaaatgatcaatttaaggtgtcctaaaattcgagatgagaagtaattgcagcacactgaggaaagaggaacggtctagcaccaattccagggtaggatatggaataggaaataattagaacataggaagaaagaaaactgggctagcaccagttaatttctacctcatgtccaaggttgccaacatacaccgtagtacaatcagggttgttctctggattctctttacttccggtgtcctgacttgcctccattcctgcagaataaagttgaaaacaattcagaattagcagcgaggactatgtacgtcagtagctcaaattgctattgttaaagagcagctagatatgagtgtatttgctatggatgaaaataatcgtaacaaatgaatgtggttatgcagaaaatacaagttgcagcatcttttcacttcttttgttacaggaagcacttacaagttgcagcagcgtatgcagaaaatacaaatatacatggaaatccggtcatctcagatctttgtgtgttaaatttgatctttctaaggattaacataaaaatacaatgtgggaggtccattgtgtaatattgaagaacatcagggggctcaaaatgcagtgtaagtaaaggtgggataccagattcagaacaataaccaccagcttcggtcttttagaggttgactcaaaagtttatggccatggtgtaccccacatgctatttattcagctgaatataaatataatagtgccttttggtcatgaaactagtaaaacaactaacctggattactagaactaccatttgttagtacaactgcattatggttgtcagtttcttgtttctcttctgcattgttctttgttgcccaattacaccttatttgtctgcttccaagccatttccctattaaagcatattagtttgcaaaagtcaggaagttacaacactggaatgccagtaggttataagaaaaaaaatatattatgagctctgcttgcatgtttaccagtcatttcagttatagcagtctcagcttcctgcattgagaaaaatatcatgagtgataataggacaaaacactaggtgcaactgtaggactggacatcagtttacaaatgaaacttcaggtgataatcaaatttatgttcaagctatgataaatcataaataaaaaagcaaaagaaaaaaaactgacacttggaatttgcataaccttcatacaacagcaaagatcacctatgatacagtttgaatttttggctatggatgaattacataaggaacccgaagagctaaaattagatatacaacaagtaccataaaaaactatttgaatattaaagaatatggaatcataacataaaaagtaatcaaacctaccaataccaaacatgagaacataatattatatctcatctgaaactaacagtaactggtacacaggtggagaatagttcactgaattaaactacaacagcaatagctctaagcctctaacagaacactggttgccaggaaataaaagaaagaacgcaaataggttgtcactcgtcactgtagtatagctaaaacaccagaataataggtagagaataagctgtggaacacacatcacccacgggacaaaaattggtaaacatctgcgaaatggaaaaaggtctgagttgttcatgcctgttgattacggaaggagacaaaaccataacctctggagcgtccggttttgttatcccacatgactcgagcatcactgatcataaatgacacaaatgaaaaactgaaaagctacagcaaaaacaaaaaaaaaaaggtagaaacaaagaaaaagcatgtagtccaaaacgcaacattctaacatgtaatatcatcaattttacaatgggataaagtttatatagaaaattgagccacttgaaatcaagtcagaattacaaggcataagctgcagaatgcagataaaaattatcatatagtttatcatgtcacaaagaactaaggacttacgaacaagaaggatatgctgagaaacaggcataaagagttgcatcattcacttcagaacttaaatcaccaacaaaaatatggaaatgccctggaaatagttcagtgggcacagttaaccaaataagaattaaaattagaaacaaatgaaagacatgtgaggtttttctttaataatatctcaccagatgtatcctccctctgtgtacttgcataagcccagttcaccttgattgcttggccacatctgtgcaaaaaaaagtccataatgaagaaaccctaaaagaaacttgaggctctgaaacctgtgctgttgaagttaatggaacacgggaacttacatgtgacgaccatgaagggtcattattgcaagagccgctgacctccgatcataatagtcaacaaaaccaaaggaagactgtaacgaaaaagtgaattctcatcaaacagatgaatattaacaaaatgcagtaggttctagttattggccctgttcttttcagctacttcattggattgttacggtggattatttgctccaacgactctaaaaatatattttctcaaaaaactttcttctactgtattgcttaaaccacttgctctaagctactacctccatcccaaaatataaggagttttggggttggacatgggtattaagaaagtaggtaaaattcaatgtgtgatggttgtgattggttgagaagagaaggtaggtgaggattttaagaggtggaaggttgtgattggttaagaagggaataaattgttatattttgggacagatgttggaggctagaagttgttatattttgggatggatggagtatttcttaagtttatttctacaaatctttatttgatccctacaatcacgtagataattcactgactaatctgttacaaactgtgccaaaatgtttgatgacatttgaaccaaaatcacaccaagattgttagaaaattaaaactaaaattaggtcgggaatgttgtagtgttagaacgtggcgtttctcaaactttcatcaaaccttgggcacagcctttggatgcatgagcaggatgcataaacataccttctccttccggatgagcttgcatctttccacaaggccagaactctggaaaacttcgattagaaggctctcagtaacattagggtgcacattcccaacatacctagttgacacagcatcgttaattagaaaaataaacaaaacttcaaagtagttaactagcaaccatatattatacaaatttctaccaaagaaaaaatcagcatcagccttgatggaagactgtgcataacctaattatgcacgcatgcgtcaccttgtggaattccacattggtcataaaacaaaataagttggcagataagggggaaaatattaaaaaaaaaaggaagttgtataatatatgaaggtgaaagcaggaaaagactgaaagcactcacacactgcgacatgtggatggatcaaaccctggtggaagattgccatttgaaataggctccatctgcaaaacataaaatgtcaaaagaaaaaaaaaacaagactgacgcgaagcaagcacggcaaaacaagatagaaaacaaataagtacaatgaggaaagctaaacttggtaccaaataacataagaagaataggcacccaacattcaaactaaagaggaatcacaccagtagtgcagataagatatacacccacaaagcccatctagcaaaacatagtttctaagtcatctgttatccattaacatcgccatggtgatgtggattgttaagccagccttccaaacctatgttcttcgtgcagcaggtgatgtcgcacaaaaccaggctatttggtgggtcttataagatcgtgccattaggaaccttgaataattggagagtggaagcactagcctaaggagatacggaaagcattttgattaaacagattttagtatgcaccaagaatgtacactgagccaatgaggtaagggggacagcttacaaaaagttaaactctcccagattcataacaaatgcaataattttatacaataattacattcgatgtgaatatgaatagcatataggcaagtaaacatgatatgatcactttccccagaaattgtaaaggaagtgaaaacccaattcttccaagccatgtttcatcacggccaactcaaagtttgtctctcttttttcaccaaactaacctaacaattagcagttagcacgacatttgccatgaataatgacatgcaccttttatgcaactaaagacaacacatcacttgctcaattccaaataacaaagaaactctagttttcaagtgagagcctcctctaactactcaatcaatcaagatgcaacctaaaaaaaaggaggaggaatgcacaaagcaaaaaaacaatcctcctggggctcgcgcggcagatcggcgcgcattactgctccccgacacgcgcacgcaatggcacgaacaaccagatcaagaagagagggggggaaacgggagaggggctgacctgggtcatggccgccgcggcggcggcggcgaggacgccggactggtactgctgctgctgctgcagcgcctgctgcatcaggagggcctgctgctgctgctgctgcctgagccgctgctgctgctgctgctgctgctggtggttcccgccggcgccgttcatctcctccccctccgactccgactccgactccggcggcgacggcgacgcggcgaagaccggatcgggaccccgggaa

SEQ ID NO: 49325 - DNA, 1611 bp, Oryza sativa
atgataagacgttgttaaaagcaaatgctattgctaaatccccatccataattagcaaaaggttgcataatcatcatatttaggtaacagcacaagtccgatatcatttgtttgtcattttcgcacttttgcaacatggcccaaaaccaaagacaatgtgtgtctcttgtaagtatctacatataaaatttaatagaaaagttatccgaaatcatctcattgcgacttaaccatatagcctagcatattccagatgtcccggctaatattgtctctaatgatggtgatatctaaggtaggattacagtgtatgattgcttatttttgggaccaacttcataaacataggttaatagattgcattaatgatttaaagaagaatgtcaaattacttaaacatacatttactcacaaatactctatgtctttttcatgtagctatatgtcttttaagtctagcggatgaacgcaacaaaagatgttatcatcccataaatgtgatgcatatgcatacatttttatcagtactaagggcctgtttagatcccctggcaaaattttcaccccgtcacatcgaaatgtttggacacatacatggagtattaaatataaacgaaaaaataactaattacacagattgcgtgtaaattgcgagacgaatcttttaagcctaattgctctatgatttgacaatatggtactacagtaaatatttgctaatgacggattaattaggcttaataaattcatctcacagtttacatgcgaaatctgtaatttgttttgttattagtctacgtttaatatttcaaatgtgtgtccatatattcgatgtgacacgccaaaactttacacccatggatctaaacaccccctaaactttttatatgccatgttataacctcaatacatatttatccaaataataccttaaatattccttaaaaaaattatccaacgtcccaaataacggaactaggtattttaatgtcgaaattttaccatttggttcaaataacaacctccttactagtgtcttgcggcattgtccatgtgatgaatgagtggtttttccataatattagccagtttggagatagggcatcctttggaatggaaaagctcaactggttaggttcattgtggtggaacctgtccacccgtgttcaagttctagatttgctcgcatttatgactatttattcttcagtgatagatgatatactcatcgacaacaagacacccgtagtgacttcgtcaatctcaagatatgtcagcctagtcttccagaggttctcaagatattacggtcttgtttttcggtgatgctcatagcaataggatgtgcgttcgtaggggtgttctcattatatgacgacctagtttttcggagatgctcgtagcgatagggtgtgcgtttattggggtgagtgtgcgagcgttgtgagcgtctacgtatgtaccgtatttcaaaaaaaaaaaggaattttctaagagcaattttatgggaatcaatccagattatgtaaaattcatgcctcccaaataagctctaaaatttgaagtcacacctctcccgcgattcatggatccatccaatatagtcaccaa

SEQ ID NO: 49326 - DNA, 1623 bp, Oryza sativa
tattgacactcaaacaataattgctgctgctccacacatgaacaaaagtgaaattacacaccagataaccagagaagaagaatgtactcctgcccagtatgtttgggacaaccagttttcctcttggctgctgatacgccatatttccaccttaagcttaaagtctttttaaaaagaagggaaagcaggtccgttccatatggtgcagataaataatgtagtgaacaagggaaccttaggaaaacaacggcacagtgcttaccccatattaaccttggaaagatatattttgcaggacaatgcatcgacaataccttttcttttctcgaaaacatcagcaggactcatatggaacatgttaagcgaaagatgatctgtagtatatatttttattttgaaggtattaccaccaatgtcaaagaccagtagacgtcataatgtttcagaggcatgaaacaaaattattggttgaagtggtgtacaacaaaatgtaccgtgaaaagaaattcaatagctaacataagaagtctagcatcaattttgttttttgagaagaattcagacattaaggctaaattgatctaggacatgacaaggtttctagtgtcttcatgagactgtttacgtcgcataatgtttaaaaggacagaaaaatcttcatgcacatatatacctgtaatatgataaatatcaagaggaaaccatatcgttttagctgttattgttgtactcagatgctctcttcttttagatgtcagatgtatcattttgcattgcattgacattaacaagatctgtttggcagaggtgtgctacatatatcacgacaaaatattcatcttgggaagcaagcgattttgtaatgatatctcaattgttgctattacctgttcagttaaataagatctgaaatacagcagtaaatactcaggaagagctgaggaatctggggtatcaaatccagtggctggctcaaatggacttcttcatttgagataagaacagtgaaatactatagccgtctgaatagtatgcaaacaaatccaaacaaaataacttctggacagatgttgtggaggccaattggagcaacaatacagtgacttggaatgtcagattctcgttatgtgttccaaaaaatccccagctaatttcctcaattttgtcagaacgcttcctgaactatcagcaaggatagtttcaactggtgacactgtggcaacaaggacaaaattttcaccattactgacatttatttcatacaactcagagaagacatggcgaagaacatcaatcaaccctttgtagaaggatccatctgcagcaggagggataacattcaatatgaaagccccatcacgatgtaggatcgtgcgtgaagcaagaagaatgctttcctttgtcatctccaacggtggtgcactgactccacatatagcatcagatgaatcaagatccaccataatcgcactgaaattcatatcagggtccccttgatgagcaaaatcctggatcatttgaatagcatcaccaacacggacttgaaggaactcatcctctaccaatccaaaatggctccttgcaacatccagcacaacaccatcagcctctatccctagtaca

SEQ ID NO: 49327 - DNA, 998 bp, Oryza sativa
agcatgcctggaattgttcaacatggcaggcattgctacagaataaatttcttgtgctgtgaggcagtgtgggatttccttcttttttttttcttctttgaaatcccacacatgccagtcatctagctaagaggccattttgtgccaatgattagaagcattagttaattggctttattcaacctggattgtttaagccagtaattgttgacaaggggggcagacattccatgccatgtggcttgagttatgcattgcccccaaaattctgtgaaattccccaagtaatgaagaaaagggggttaattcccagagtagcctttgtacgaatgtgtgattcagaaatgctatctgccattctttttctgcaaattgccgtacattacaacaaaattacaatgtgattcttgtcggatgcatgctgttgtttctcagaattaagacagcaggaggtgaagtctccaaagatagatagccatttgccctctgcagcagctaaaattcaagtgctttgctctcaccgaaaagcttgtcctgttctccaatgttacctttcactcggttcagagatattgcaccatgatgtattgtggaaatgaacagagatcactcagagtaacactacaacatacagacttatatttttaactgtcagatgaatgcattccaataattcttcagaaaatcttgcatgaaactatgtagtaatcgtaagcatactcttgttattattgtactaaatggaggtacatgcaacttcttgtttataagcttacatatattagacgttcgacctgtttagttgttgtttaagctcaacctctgtttgtgttgatactgaatgaaagctctgtttggtaaacagaaaaaaaatgcattttattgaaattcaaatttttttgccatgaagtttacttaaaaattatgtgctctagttacccattaagtgttcaattatataatgcatggctattagtggttaacacagaggaaggcgt

SEQ ID NO: 49328 - DNA, 4730 bp, Oryza sativa
gggattgcaagaggattatcaaaaggtttggaagaggcttacgaagagaaattgcaagaggcacataaatcgtattaaccatcgtgcctccagtaccataatgattttggccgtttctaatgtaaatgcacatcattaagggcggggaatgggaagaagcatggtgattaccgtttctgctagccaagaagatggggagggggcggttgatttcaccatggatggtgccagggttccagatgcttcttcccatcggatggatggcgctagggtttccgagtccagacgcttctccccatcgccgtatcgctggttgccgagtccagacgcttctcccccatcgccgcatcgctacacagctccccatcactacctcctactgcgaccgagatgagcgcggtccccaccaccacctgcgcgccatcgccgcctcctgcgaccgagcgccctgtccccaccgccacctgcgcgcgatcgcgacgcggtgggcgagcgctagggtccgtcgcactacgccgctgctgctctgctcaggaagtcaggaggagatgagacataccgaaccctaaaatctctcattggactgacttgggcctcctgggcctcacgacttgggcctcctgggctgcagtatatgtgttgtgttcgaccccgaggcagattgcatccaacggtgcagatgcaatctaatctaccgatctaagggctataaattaatgatgacgttgatcattgaggtttaagctctaggatcttaattgcccgtagtgggggataactttataggaaaaagggatactaaaaaaaaaagctaaaaaaaagcgcgctagctgtgcagcccacagcagctaggccttgggcccttggcccacgcgtgcagcaacgcagcaagcaagcgagcagtagcggcagctgtagctagcttagtaccacctcggctagctagctccatctacactagcttaaataggaaatgttgccggtgactgtaacatatcgattccagaatttatgcagcgtgttacagtgttaggtgactaagagtatgttggaaaactctgttcattttttaagggtatgttgtcttatttctgcatgtctcttagaagtcaaaatttataaatatttagtaacatagatcaatttgtgatatgtcactatagaaatatgcatgttcaaattcaacttactttgatctatcttactttttttatggcattttaaatgccatgcacgaatgttcccttgaggaatttttttaaaaaaatccacttcctgtttggtttgctaccaatttttattcacgtagttcaatctctatactaacaatttgataacgcaaaaattgagtccaaatcaaacaagttaatttcgcgcatctggatcaacttggatcccgacagaaactcctaaacttcattaatattgttgaagtaatccggttttgctggggatcatggcgtgtgtatcgctccgacgcatgctgcgttcatgcgggagctctttccagttttttagtgagtgcgtgcgcttcgtgtgttctccgatcgtgggatggcgcggtctagtcaggaggcatggcgaagtggcgggagtttaggaacgcatggcaacagcttcggtcgtgggatggcgcgatcaagtaggaagttgtgggcatgtaatttactatttaaagtttcctaatacaacagaaaacgctgccaagtttcttctcgctcgttctgttttgatcggctaaacttgcggtagttcgctaacaatcttcatattatatatgcagcctgcctccatcacgaccacgacgtactcacaacctcgccggagatccaagcagcccgttcgataataatcctatcggcggcggcggcgatcaccgaccggccaagcagcatatataccttcggtttcgtaatttttctctcttgttcgttctccatggcggcgaatttcgtctgcttcttcgccggcttgtgcatcggcatatcgatccaggcgaacgacgaagagcagcagcggcggcggcgcctcgtcgagctggagcggcgcggcgaggagcgggagaagcaagtcgccgagatggtgagtccggaggaggattgtgagcgggagcggaagaagaacctggacaagctcgaccagatcgtcaagatcctcaggaatctgtgatcggatagccgccggttgccgtggagatgaggcttgccggagctaggagagatgacaataacagtgttattactactgtactagattattactccctccgtcccacagtataaggaattttgagtttttgcttgcaacgtttgaccactcgtgttagttatattttttttgtaaatataaaaaacgaaaagttgtgcttaaagtactgtagataataaagtaagttataaataaaataaataataatttcaaaaaattttgaataagacgagtgatcaaacgttgctggctttctctgtaatcatttgtcccatatttttcgcttttctttgtgatcacttgtagtaccaaatttaggctttgttctaatgtgcaagtcatttataagcttttcgccaaccagtgcgtaaaacgagagaatcaatcacaccgtttagtagtttaaaatatgtgctaatgaaaaccgaggaacatgacgtttgaagtttcagaaaagaacgctgcctttaacatgaaagttccaattcttacattccttattgatgtttgttgaaaatatatcctacagaactgcatgatttattagccccctacattcaaaaatataaggaggattttgattgtctagttctatgctttgacccttggtaataaaataatatataggttttgctatacaaaaatatatttgttggattcatgttcgaaactcctatttaatgactatgatttcgtaacagtaagaaatttacggtgaaagcttgtctttggagtaaatattaagaaatccagacctccattgctttgttttccacaaaaattctctgaggttcctacgtttgaatcgtgcctaatagcctacacgagagagagctgtgtgcgagtaaaattaagctgatctccatgaggctccagtatttacaagcttgatgtatgcatccttgaagtcggcaaaaaatttagcttggtcctgtgcatataaattgatccatctgcaagtagtttggcatatgcccaatgtcaatggcctgaccaaacatgtgagcatgaaggaaccttgcaaatatatctatttgtcctataaatttgtgacttaaaacctaaagcctaggtcctgactgaaagaattgaagatagagtaggattagtgcatggagtttggaagcttatgattatccctagtacttcttcagagcttgtaacaagtaagcgacattatttagcatatctagttcaagaaaaaaaataccttaagcattcatcatcttcagtgagtgcccaatccgttcgcagtcctaccattgccggcatgccagcttcatagaagaacacaacacattgtattaaggtgatttacaaataatgccaagtcgattgtacattgtacaaggatgatttacaaaggcatgagctaagttgagattcagttatggcttatggattcatgatgacagtatttaaagggcatgatggaaaaaatgaatggacttacatgaagatggctgtggcttctcaaggagtactttaaaataggagttgtcgaaaatatttggattcccgaatcctttacctccaattgtgtgtgctccagataacacaaccatctcctgtgtcctgccaagtatcaagtttaacttcagacatggaaggatgctaagttttgaggaacattttgtagaagcctagaggggaaatcatgtgcagatacgtatcatgtacagatacataatttttaaccacgcattagtaaattttcataaataggcaatgggaattgaattcacaagatgtttgtgtaagtagagaaaaggaggactcacgaaaagccctttttgctgaataatgttttcagcgcagtggcatccaatgtttcttcaggaagtttaccagcaggatcagcagtactacagagtcaaatgcattatttcataagaatatgggtattactttgagaaaatatggatacctacatgttctttaaaaaatatggatgcatactaaatagaagcactgcctggaaatgaacagcctaaaattttgccaacattgcaagggaactgttaaatgaacaaaccactgtgatgttgcacctggaatctaatcgacctagtcttactggaatttctggccctccacatagcgcaactgactcagcaccagccacggcaatcaaatccgcccatgatactgttagcaaagtaacggtatatgtgtgcttgaagatacatcacaaccgaagctcaaaacagaaagaacatataaaaagggtgtaaaccatgtgccttgctgcacaaggtcaattacttctttcggcttttccttaatacttgttcagttataagtcattaaaaacagatatgggaagtcaaaacatgttgttcttcagtaaggatatgttactactatttatgataaaagcaagaaaaaaaaggaggaaaaaaacctttatggatttatttagcccagtattttcaggtctatcaacttcataaattatagatccattcatgccgcctgcaagatattgtcataaatatccatctactgttttacttctcaga

SEQ ID NO: 49329 - DNA, 1457 bp, Oryza sativa
ccccaattgacccatttaaccataaataaaaatactcatagaaatgtaaattaatacggttagcaactcatagctatggaaacttagagcagaataggaatatgattatggttgaatactgcacttacgcactcgctatatgaacatgaggaagtatgaaagggagcagagcaacagaagcaaagtccctccttgtataacaaagagaagatatgggacctgtggtcaccatacacaaagcaaattcagttgggcagaaatatatcagtaggcactggaagcattctctcagttcttgcaatggaaacaactcatacctgaaaagaaatctgcattttgctgctcagagggttctgaacaagcagaatcatcactactgcacctacgaccagcagcagaagctcctatcctcgtcttcccacttcttctaatcctgtatcatcacaattttcacaggtcatgtgccttccatgaacaaatgatggcacggttggtatcaaagcatgagagaagatgcaaacattacctgcaggtgcaacgactgcagctggagaagaagcgggaggaggctgcaatatgggggacattagtgagctccattcccgtccttctggccttgttaactgtcagcaatggctgctactatcctgaactgaaagaggaaaaggacacaactcactagtcactagtcagccagcctatctctacctggctatacatgtgtggttcccaactgatggtccccaagaaagcactttggataagctgtacttcagtggtaaatatctgcccaattgtagttctgaagaatatgcctctgatactccagtgattatttttagaattcataaatgccattaatgtctcttcctatgtggatatctttctttcaccagtaaatactcccatctgttcattaaaccttttatggtaatagagtatgatttgaactgtttgtgccttactaaatttgcaatttcaacacaaatctataaaacaagctaagcaaaaaagaaaaaagaaaagaaaagagcaccaacaattaacacaatttagaaaacaaagtaagccaagatcccaccgttaaactcaattacaagttactgctgatgccaagaaatcatgttcacagaacaagtgagaaaaatcatagtttgttgatgtaaacaggtagtacagaactttctaagcaaactgcaatgaaattatatgcttatttacaacagtcattgcatgtttgaatgtgaattatctgcttcagtgtgtaatatgtattgtcacatataaatgagagaacatagtggacacttacataaataggctacaaatttcgcaaacaaacacaggtggtacttgggagctattaaaagtaccatgtatacgcttttctttgtttgggaagctagctgtctgtgccttaaaattacagggaattattcgtctatataacacagatt

SEQ ID NO: 49330 - DNA, 6821 bp, Oryza sativa
tggttggtttccagttgccaacgaatacatcatgggctgatggttgcttcctcttcattggagtcatccacctccagattgctgcttcaaatgctagggtcgcattctgttccaataactctgggtggttcaacagatcctgtttgataccctgaccgataataccatagttgtagttcctgaataccatgtacaagcagatttaattagtcagtaccttaacctaatcagttactaatcaacagctatcaagatagggataggtcagcctaaccagtaaacaggaagagcgcctcgaccataatactcgactccttcaacacaaggatacaattcgttgctgttgtcacaatagctttggcttgggctcaattcatggttgtagcaaagcccccaagccaatggaccaccagttgcgacactatatccacctgtagaaatcacaattccaatactctatcagatgctactagcctagggtttttttattcatctgaagttcacgtgttcggtgaacaacagaacatatcacacagttggaacgaaacttctgaagattgctaccaattgaacaaaccttaggttacaatcttctttacaaatcaagtacatattcaaatcggaccaaagtccactgtgttgtgatattcagaatttcagatgcagaattgcagttgtctacttttaatatggaaatgccaaggatgatacacgatgccaatcaaaactaattaacatgctccacatatagctgcattcggcagcaattaactactagctgagataaaaaattgttacctcccattctacacacggatccagattactttcagatcttaaaagcaacactccgcagagcacctatcctaaagattacagtaggccgcaaatctactaccaattcgtccatttcccccaatctatttctcgatccacgcaacatcaaattggtaaaatcacagtaacgatcagcgagaagaagaagaagaagagcagcacacgtacaggaggtcttggcgccgacgtggccgaggaaggcggcgacctccttcatcccaacctccttccctcccgtggtgccgaacccgcggggctcgaagagcgcggcggcggtgatgaaggcgtggtagtcccagaacccggcggcgtgggcgagcgagcggtcgttgcggtgggcgaagagctcctcgaactggtacgccttgaagtagtcggtgatggtgtcgttgcagcagaaccggctcccgctgcactcccaccccttgtcgcacgccttcgcctcctcgtcgccgctgccgtccttgtgcctcctcccctccgccgccacgagtagcgccaccagcagcagcagcggcagagatgccgccgccgccgccgcacgcgacgtcctcatcgtcgccggcgatgcggatgcggagcgcgtgatcggcggaggaggagcggagaagagagagtgtcggtggtggggtgggttggtgggggcaagctggaagggccgatgtgatatcgctgttcgggggtattttcgtaatttggtgttattgggttgtttcgaacttcagatgggccggtgttctccggctgtctaaaaaggcctcaaggcttaaggcccattttgtgatacggctttcattggagtgaaattgagcaatttcatagaagaagttcattattcatcccccaattatagccccaaattgattcattcaacccaaaaaccagatatggagcatcccaaactattaaaacaagatcaatttatgtccctaagcggtttggtgattttatctaacgtggctgcttacgtcgcatttcattttagaaaaagaataaacaaagctattggtggaccccaacatttcaacaacactcatctctctcctcccttctttctttcactttccattttctgatttcaatggcgacacacattttctttcagacataggatagggcattataagttctgcaccgtttctcttagtacgtgtattcattcatgagagttaagatgtgttattttcgcaacggctattattggaaaaagaaatcaagtgtactatagtattttctattgtttattggtaatccaatgtactaaacaaagagattaagtaaatacaccatatctttttactaatacaaaaagatttatatgttcggcttttggacgtacatctttacatgtaaggataaaaatagtcataaaaattctcgatcgatctagaattgttttcgtatgagtggtaccgtttctgaccattactattttaaacctaaaaaaattggtttttctaagagtgaattacaccttgagccacctttgattaccattgttacaatttggactaggctaaagccaaacttttcactttgggccaggtatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggcccggcaatgacagacagttgctgctactttctgaactgacgataagaactaagtcaagtagcagatagccatgctcaagctcatgctcgacctccgctagtgctacatgttatgctgcacgcctgcgctaaatttccacatgtgtcgctcgagcttcaacaagttttgcaacgctcaagctccgccttcgtagtgccgcctgcatttgagctcgaaatcaacttcggcgggtggctaccctatgaagaagggttttgcttcttgccttttcatgcactacacctgatcgagaaagagaccttgagctgtacagagaaaagagagtaagaaagggagttggaggaagaagaagagagtctaaattgaaaccttgtgtaaatatacccggtccaaagtgaaaagtttactttttcactggttcaagttacaacacaggtaagaaaaaatagtccaagatgcaatttactctttttctaatttcgttcggtgtcgcattaatctcgatacttaatattttaattgataaatattatcaattattaaacagataagcgtcgttttcgaagatacgttacccgatttccaattggtctcaatcctaattcttatcgactttttgtttttctccatttgaccaaagcgttttgagacggagggctttgttgttcagccagcaaataggggagtgtttccagtgtttttccaccgaagaaaggcgaaaaaaaaaagagaaggcagcgaagatttctctagaaagagagacgattgtcccatatccaccgatgccggattagatccggtggactccaccgatccacgggccgggggcccattccaacttgcccagccactggtgggcccaccggccacctcatttccctcaccccccaaccaaaaagataaaaaataaacaaaaagtttaattcgccgccacgcgctttgccggaaagccccaaaagcccgaccaccactgccgccgcgccggcttctcctcctccgcctccgccgccgccgccgcccgccggccatctccgtcgatccaccgtccggcgagcagacagcagcccggcagatctgcccccaccacgggatcgaatcggcggggggaaccgaatcggggagcgcgggaggcggggagcttagtttgagctcggtcggcggcggcggcggcggccatggtgaaggagacggggtactacgacgtgctaggggtgagcccgaccgccaccgagtccgagatcaagaaggcgtattacatgaaggtaagtaggattcgtcgacttgtcgtcgtcgtcgtcgtcgcttgattttggtctgatttgtgtttgctggtggtggcgcaggcgcggcaggtccatccggataagaaccccaatgacccgaaagccgcggagaatttccaggtaggtgttccgccattgttctactactggcaacttatacccttataatcaactcggtgcaagcagctcacagggtagtgtagaaccctcgattgaatcagattagatgcttatttagctggacagctgatgcgcaaagtccgagatgttggacagattagatgcttattagctggatagctgatgcgcaaagtcactatcccagcacgctgttctctgcggattggtttcgtaagcagtcgtgtttttgtttgtttggctagttaatcagtaatcactttaagtttaaggttatacagctaaatgcttattagtaaccaccattccaccagtctctattactctgaaaacataaaatgtgtctttgccttttttacgtttgagatttggttaatggtgattagctatatatgctaaactaagtgtttgcctatctaaactgctctgtgaaactcaacatcaggaagtttaatatctaacatttggaatcagaattatattgctgagatatatagtaagttctagttaggccattcaacttaactatgcagatcgaccattccacaaatgaaatctgtgtaataacatgccagttaatgatcgcgaggttatgatatgatatctctaatctacttaaaaaggcagtcgtccgtccgcactcccctccctccaccacgcacagtgagagaaaaagaggcatgcagcgcatgccccacttgccccacttgctccacatcctcgcctccccaaaaaactggatttccttaacagctgacagaaaacatgtaaaaacaattaaaaaaattggctataaacagaaccagggcccaattaatattttataggtccgttgcaacacacgggcatttttactagtattagtaacatatcacattcttctctcctccctaactccaaagcagcaatgaatatatttgaagctgttactgcatagccattgtagtattatatggcattggctttattagaaagggtgctttttttttttttgcatattttcctattccgtactattgttacttataggaattctcattgcaggcactaggagaggcataccaagttcttagtgaccctacgcagcgccaagcttatgacgcacatgggaaatctggcatctcaacgtatgtgctgattttctcaaagaaattatatgatgctcttgcaaaatattgaaaagctttataggattttcatggttattaatttgccatttgtggcaaagcaacgccagtactatagttgaacttctttttttttcttccattcgagagatgcagatttttgtgggatacttagtgattacctcttttttgttttgaataataataccagacaacaatgttctagctcatttggttttgaaattctatagggaagggataattgatccagcagcaatttttgcaatgctatttggtagtgagttgtttgaagattatattggtcaactggctatggcatcaatggcttcacttgataatttcggtgaagatgaacatattgacacaaggaggttgcacgagagaatgcaggcatgctcctttagctggtttattttatatcatcttccatgctcattgaataacatgaatacagtcaatggacattaatgtatgattcttttggcagctttcttttcatatttgttgcatttttcatattcttctgccacaatattctgctgagtagtatacttcaattcaggctgttcaaaaggaaagggaagagaaacttgcagagacactgaaaaaccgactgcacatttacgttcaaggaaataaagaggaatttgtccagcttgctcaagctgaggtgaccagacttagcaatgcaggtttttgtcaatactacccaccctcttcctcaactctgacttccccccttgctctcttcctttcctgcttaagtgcttattgctgcaaggacttgctcaacacttatcttagagaagttggcatatgatatttaaggaactgtacctatttatcacatgattgaatagataactgcataataagatatcttgacaagcatatctcatgagatggcatctagaatcatccacttcagctgaaacagatccaaaaattagtatgctattctttggctacacatacttcttgctgagcttattaattgaagtgaatatacaagcaccataagctcattctttttttttttaattatgcgcatgttgtaaaaggatgtgaatggcctatatgctattcctgcaagtatatgatgatgttagctcgatggcatattaccaattttccctatattaaagtatatttgccaagttcgtaaatagaacccattaaatgttcgttttggtatattttgttgtttttgctctgttgagtgctcattgtgacttcggttggtctttaagctacattatgtgaactttctcattctgtttggtcatgttttgcttcttgtgcagcatatggcactgttatgttaaacactatcggctatgtatattcgagacaagctgcaaaagaacttgggaagaaagcaatattcttgggtgttccatttgtagctgagtggttcagagacaaaggccatttcatcaaatcccaagtaacagctgcagcaggtaacataactcatcaatatatttaacttgaaagtatatgatacagctaatgtcatctattgtgctagcattatattaatcataaagaatttggttgtctcatggttctgtaggtgcaatagctttgatgcagttgcaagaagacttgaagaagtatcttagtgctgaaggccattacacagaggagga

SEQ ID NO: 49331 - DNA, 3424 bp, Oryza sativa
cgaagctgttcgtcgtcgtcgtcgtccctgggtactcgagcttcaactcggcgaagctggatgatatcatcatcgtatttttggtgtattattaattaattgcaaaaatatgccgccaaacggacaaattaataaagtttatatatatcgaaaatctcgcggacacgctctgcgtatcatgacgtgaactagagtagttcatgacgtgaaccatagtacgttgtaggaatttattttcggcaagataaatgattccttttttatgtacgcatttgagtcatattttgattggtaggagataataagtacttggtgttttatgtttatgctaaactaaacatgtctatctttaactattaatttttaagaaaatgtatggtttaacataataagatgttatgtttttagattcaccatgaaatatatttttgtaatatagatatatttacatgttgtcaaactatatgattttttttattgtttgacttcagatacaacaatgaatttgtcaattttatggattagatatgtcatataattggattcgtaatcaccatagataccacatatatacctaatattatacgataaggtatattgaaatataggaaaatagcagataagaacaacaactcttcgtacttgagggaaggggattgggagtttacacgagggaattgatggtgagattaagataggaatttgatttttcatcccagtctcttgtttggtagaggtaatggaaattgatagggagtttagttggagattagatcattaatgaaaatggatggctgagatttgtttaggcgaaataaaggagaaatttcctcccaattacctgcccctacccaggtattgaaaatgagggagttcatttctcaattctctatccccatcccactaaaattcccatgtcccccaaccaaacaaaacagttaatagcctcatccctctaaactcctaatctcttctaaaaactccctccaactaaacgggccgctaaggaaatatatataggttgtcaaaatctgacctaaaaagggcaaggtcttatttactcaaagttttaacacgaagtgtagtagagctttgaacgtggccgggtcgatgtcgtgcatcgtgacgcatggcatacggtggtctccaccatcgagccgagggactccgccttgaacaccggtgagcgagtggcgagcacagcccggtgcacgtggaacgtctcgacggaaagcttctggtttttctttcaaggagtaagggcaaaagctctgccgaaggatttcattaagaagggaaaggcctaaggttcacatcatacagattacaaggatcaaaagatcccagacaaaaggcttctggctattttttggtagtcaagtttgtactcgatgaaaccggaggccagcatgttgccggcttgccgccggcgaaggatgaactttctcgagagagaatttttttacccacagcaatgtgaagaagatcgatggtgaggaagcgacggtagttgctgccgataccgctggcggtttaggcggcccatgaagtgcgcagacctagtcaaggcccaagttactccagtctaaagaagtctaaccgcaattcccaagccaaccaaactattcgcaaaataacttttttctttttaaatctagggcctgaacgtttgcttttggagtggttctccagtgctgggaagttatatggttcgttaatcaactaaaatctaatggtccacggagaaaggtatcttccaaaaggtagtaaaaagtgggccaaggtacttaattgatagattgggtggaaggataaataagtaattatcttaattttacagcgataagactactgagagagagtaattcaatcatgagtggcgtgatcgggaattttttttatttttaattttttttattaaaagttttacaaaaataattttccattttgaaaattgacggaagtagtcgcctaccgccctctgggagggtgatttttaaaaatcgtcatcccagagggcagcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggaaggcgatttttgcctcccccctataaagcccagtcccccctctctgaaatttcattatattcactaaaaatccaaaaaaaacgaaaaagagagaggggagggcacagaagggaacggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgcttataaggatgagatgaaggaggcggtgaagcattgggcagtttccttgcagagagagtttagggtggtcaagtcaacaaattatgtgtat

SEQ ID NO: 49332 - DNA, 917 bp, Oryza sativa
tgttaattgcacacttcattgagtcacttggtaatgatcttaatagtcaaatttatgaatcaagcagcttcgtttgaaattatctttagagttctttcactactttagattgtgcattacagccttcgcgcattgcaagttctgtatagcaattctctgacaggccggtaggggacacacaaagcgtcttcgtccttgcaatgacagtacgtagctgtcgtagcacatgtttatcttctagaaggtctacgtgttgtccagatcccgtggatgcaaattaattgctaataacggccatggatcccagattgattcggtgctctggctgccacccaaaagaagcctcatcgtttaccaaataaataaattcagctacagttaaaacttaaaatttaaaattgattttatggtatttttaatataatatctcttttaacatttatttttaagtcgttaaaaacacatatatataaaatttttaaattatttttcaatcactaataaagctgtgtgccatataatcagctcttgattatattaaccgaataaccgatgaggctattggggacatgtgccattagaaggaacccaaggagctcgagagctgaaacatgaaagttaatcctgacattggaaaacataaacttaattaatgaacaaatttacagcattgaccacagttcaggttcaggaccgatggagccctgaggatccaatggtttgcatttgtctctgtactgtggtataaaactcaattcggaccttctcaatcacattacatcaagattagtgaattttcgtttgaactttacagccattttgtagagcacttcaatttctacgaaaatctgggcagtagatcgtataacaaacgagtcacaccctagatacacaagctcgaattcccgcagcaaatt

SEQ ID NO: 49333 - DNA, 1744 bp, Oryza sativa
  unsure (1)..(1744): unsure at all n locations
nnnnnnnnnnnnnnnnnnnnnnnnnnnnnnnnnnnnnnnnnntttagtaggctataacctggtcaattggtataacttgtgtgcttcgatcatggttgtcaagtcgtaaagtcgagtcgaggtacccctgaaccaacttgtcgacttggtcgactagtccacgactagcccacgacttggtcatgcaaaaacagtggatgcaatatataatctttactagtattatactgtgctaaggaatgtatataatataaactatggactatagagttgcaaagcaaaacaataagtcgacaagaaataaaactaaagtactaaacacaataagccaattagcatggtgaattggtgatttgctatgactaatcacaactaatttacggctgaatttacgactaatctacgactaaccacgagtaaccacgactaatcgcacgacttgctatttggtcaagtcatggctctttagtcgactagcttgaccgactttacgactaatcacgactagtcgggcgacttgataacaatggcttcaattgtgcatatccatttgacagaagaaagtgaaatatttaaatgaaattttcatcaaaatagtaactcggttcggtctatatacttagctttaattaataatacttatattgggaggaacaaaattaactggatacttaagatgcctcttaagattaagatttttatgtggtatttgcttaaagggatagtgttaacaaaggacaatttggttaggagaaattgaaatattagtgtgagatgttgttttttcaataaaaatgaggggatccatcatttattcatggagtgccattttgctctggagagcattacaggtttcttatggtttatatcctccacatagttcatctcatatctttggggattggcttgtgggtattgataaagaaaacatgaaacttattattttaggagcatatgctatatgttggattctatggtttaggagaaatgatttgttttttttttgacaaatcaccgctcaaatattatatgtaggttttttttgggcaacgtgctggatccggttttaggctcaactataaaggtgtgatgatgacattaagctaataaatactgcatgtcgtaaactcgagtcaaatggtatgcaacttttcaccatcttgtggggtctttaccttgtattggtgcatattagtttatgcttgcttcatgttatttgggcgagcttttttagatttgttggtgtgtgctcgttattgtgtgaatttgtgtaataattggttgtaactcattaagtaaagatgaaattttattatgttgtctactccctctgtttcaggatataagatgttttgactttggtcaaagtcaaactattttaaatttgaccaagtttgtaggaaaaagaacattttcaaccaaagacaaatttattatgaaaatatatatttaattatttatttgatgaaatcaatttagtattataaatattactatatttatctgtaaaattagccaaacttaaaacagtttgactttgattaaagtcaaaacgtattataacctgaaatggagggagtagaaaaaatagtaggcgtcgggaaacagtagtgggtgtgtgcttttaggtcttgatcgaaagtgcttcctcgtaggtaaaaccattcaatctgagcgtagctttattcgattgatctttctttttagttgttactaaaacaacttttgtagactcttcttacct

SEQ ID NO: 49334 - DNA, 1847 bp, Oryza sativa
aacctcaatagtagttttattatgaaagatgagatacacatgccaacccaaaagaatggacaatgccaaagctagtggacacaaaaataccccgcaaatgatctgcacatttgaaacatattattcacttagcatattatacaaggtcatattatacagcatgactgaaacagcccttctgaggtacttacaattgatgttctagaagaatcactgcctaattgttcatttttaggcaaactgtgcacagcacctcctataaccagaacctgttataaatgttaatcctcacattcttaatttcctaacaaggaatagctgctaaaataaaccaaggatattgaagtaccagtgaatataagcttgcttctacagcatacagcacaaagactaggaaaatcttgttttttcatgtccaacacaattgttaatccatatacagtgatggtcctgcatatattaaaaaaagggaataatgcaaattggaactacaaaatagaaaacattgaactcaacactattactacaagtcagcaccattcttagaacacatctcttgcagacacgacaatgatgagcacggggaggcttataatgggaacatttctgacaatatctcaaatcgccaccctgcaatgacaggcatgcagaaataagcaggcaaaacacataaagaatatgtgatgagaaataattccagtactaacaataatgtatataagtgtaatgttccaaagagacccatggcttttcattatagagcaaaaaaaaatagctttccttttcaaaacctttttctttacacaaaatgcccaattggtgtgttcgtgcgctaaatgcatgtgaaatctgaccagaataatcatcaatgtttcatttgaaactactggaaacaaaagaatatcttctaatgcaagaacatacgagcgcaacaagtcaacaaccggtaagtctactgaaggcaggactagaatacgccttaatggttcaacaagactaactgatagcaacataattatagccaatgaaaccttagtaacaagcaaaagcaaagcagattgaatgcaatacattatctttatgcaggcacctattgtttaaacgccccaaatgatgtaaagcccttacacactgccaaatgggaaataaataatactatcagctgagctaccataagctcagaaaataattaatgataattggtaactatccagcttcctcatcaaccatcattatgtatttaatgtgtgcaatagatcccaaaacattaattttcgaaatctattgcacacattaaatacataatgcaaaccttccaattcaccaaccaagcactcggcatgcaagactagacctaagattcgtacttagatccaagactatataatccataatacaaaggccctcatctcgcaatatgtgcattcttagcagaagtacaccccgtaagttcaaatatggatcataacagtatgtgaagatcgaatgcaaaacgcgctcacctcaccccctccatagccccatatcctcggatgcacacctacatgctgttactctcttcctccccaaagacctcaacgttgagctcaaaattgccatcccactctgaagatctaaagcccacgcacggaatatcagctcaggggatcttcctaatcggcaatgtccgaaatctaaacccaaaggtatcaaattttgaggccgaactgtccaattctgctagcttcccactccaaggatctaaactttgcagcgcaccgcggggggcgcccgcgagatctgggtggccccgacggaagagggtggaccggccggtgtaccttgcgcttgatctcgtggatctttta

SEQ ID NO: 49335 - DNA, 1258 bp, Oryza sativa
tattagcaaatgtttcttgtaacatcacattgtcaaatcatagagcaattagtctcaaaagattcgtctcgtaaattagtcgcaatatgtgtaattagttattttttttatgtatatttaatattttacgtaggtgttaaaatgttcgatgcgatacgatataaaatttttgggtgagaaataaacagggcccaactagtagcaccacgtggagttctagagtcaatcagtgtcactgtgcacgcggggttgaaagcgcgcgccgcaggtaggttgttcactggcgtagtggcacaccagcggaagcaagcggccggagacattaattccagatcatgttcagagaaatacaggatggtgcgaagacacgcatgctttcatatacatgcacatgccatatatagtctgaatcactgtgctgttgaataatctccaagtgcacgtcatcaccgaaaacgtaattaattacacgaacgccgaactgcaagaattaacatccatctgcatcgcattaaaacggcggctaatgaacacaacagcgatgttttcagatgagcagtctttttcagagaagccgaaatttgcaggatcacggcaatggtaacatcatctccggtgaaaatgcaggagttactacaagtgcaccagctcccgatgcagcgccaagaagcacgtcgagaagtccaccgatgacccggagatgctcatcgtcacgtacgaggggtcgcaccatcacggcccgcagccgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtagctgaagtgagtggggagttgacttgggaagatgactcgatagtacagtactggatatctacttgcaaggtgt

SEQ ID NO: 49336 - DNA, 2248 bp, Oryza sativa
  unsure (1)..(2248): unsure at all n locations
nnnnnnnnnnnnnnnnnnnnnnnnnnnnnnnnnnnntgtcgcatataggcaatgtgtttatccatataaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacattcacacaacacgtccacgtataagaagcaaacatagcacagcaactcagcaagaagcatcggtcacggcagaaagttaccgcccagctcggcgataaacaattacagacaagccaggtcgtcgtcactcgtcacacacattggcggcttggcgcgaacaaatcggcaaatctgtcgtgcgcggccaagacgctaaaccaagatgataaaagccgcggacacccagccgctacggacgaggagtacacgtggccgtgcttccctccaaaaaaagaaaaatataccgttcacactaggtcaccactcaccacaagtgcaggttcagctcaatacaggttcactgaacacgactagcagcagtacatgttggcaggaagaaatgaacaatgcgatcaagcagaaagatatactactccctccgtcccataatataagtgattttaagtttttgtttataacgtttgaccactcgttttatttaatttttttttcaaaaataaaaaacgaaaagttgtgcttaaaacactgtagataataaagtaagtcacaaataaaataaataataatttaaattttttttgaataagacgagtggtcaaatgttgcaagaaaaaactcaaaatcacttatattatgggacggagggagtagtactttggtgtctgccctgggtattatactgctcaactggattcggttcgcatcagatgggtatatacaaaactcgcaactgcatcagtttttataatttttttatgtacggcgtgacagcggtggtactgtttgtgtgaaggccaagttgagaattttgtttgcagcataatgttccctcgagtcgtctccgtgcagtgtacacgtgaagaaagtagggaggcagcaggatgtacaagaatgccgtcatgcaagttgtggtgtcaactcgcgcctaagacggaaaagaaaattggttttgtctgcccataggcgtttgacggagcaaacaggggagaaccgattgatccatttggattagtgtcaatcaagtgtcaacgtctctgggaagcctagatgaccctgctttggtcaatgttgatagcgacggatgtggagagattacagtgttgagttgttgacgaggcgaaattacatttggaattcgcaaagagtacgactggctaaaggaagaagatgtgaaactcgtagctgggccaagtccgggtgagccacaggcccatagtcttagatgctgtggcccgcttaggactatgaagcccaaatgaaggcccacttaggaccatctgattagtcacaaacgaagattagtcaccgttgcgctgcattcacttcagatgaaaatttcctccttcaagaagtagatggcaatgcgacatgtgcgcttaaatgtccagttcttctttcgcaagctgggtcggctcaatttggcgttagctgttatgtagctatctccgtgtgtatcggaaaattgtacagcccaatcttctttgtcagcaaagacatacgagcacctttcagttatgctgtccatctacctagaatcctccttgcctccttcgctatgtatatttctcaatagcgactagaatccgcataattgtcacgtctacctagaaatcgctagattcagaccgaaggtacatttgacatgggcatcgattgtgacatgtttatgagactagtttttgttgatttttctgctgtttcaggtcatattgggtgatcactgttggaaatttggtcataattcggcatattttaatccaannnnnnnnnnnnnnnnnnnnnnnnnnnnnnnnnnnnnn

SEQ ID NO: 49337 - DNA, 1340 bp, Oryza sativa
acagggtggcccatggacccatactggcagcggaagctccgaactgtctccagattggtggcaatcccttgccgcgtgtccacctgccctttcatcgacaccaacaaatttcccttgagccctctccgccgccaccatcaaccgcgtccctcgtgacctcgtctcgtcggttcgtcgctctctccgcgagaaaacgggggcacagtacactttaccggctagtttcgatcgatcacgcacgcggagcgcgggcgggatcaaaaccctaatacggcccgcccccgcctcgatctccgtacaatgcgctcgccgccgccgccgccatgagcctctcctccctctcccgcgccctcgcccggtccgcgcgctcctcccggcagcgccaggtgagtgcccgagccgcaccccctccccttcccctctccgattggtgtggcttcttcctgcgcgtcctcgccctaatggctcgggcggcgtgtgcggatgtcgttgccgtagggttctctgctcggggggcatggcgggctccgtgcttcgtcgccgccgctgccctacggcgagttgggttttctgcgcagctatgtgacgtcagttatcgggaatcgggcagcggtggcctccggggcagggaagggtggggactggaggttcctgcttgctagccggcagttccggcggctattctccgacaagtcgaagaaaagtaagctttctggctggttaggtggtttttgggggatatctggtgactctgttaatatttaacgttgccttttttattcagaccacgggaagcattcggaggaggagaataaaggtaaaggggatgagagtgacaagtccgactcaaagagtaagtgcttattttaacctgcattcctcgctcttgtgttggatatggtttattaaggtgttgagctttgcaaaatattttgaaagagagtagacttttacataccagtggcgacttaaccttccgagtgctgccctaaaatcatgctatatcataacttgtgatttctagttttagtatactgataatagaaaacaatgttaagaagatgatatgcagagcttttgtaagtggcaatacatgttaaacagagtggggctagttgatgttttattttattgcacaaatacccctaacagtatgtaagtatcatgtatagctgaaaatgctaatatttgagttttagtgcctcataaactgcccgctcacctttaagggagaggtactagcatgagtattgtggaatacgacaacatgagcctttagcccaaagcaagttggttgcgtacaatttgtaaagtttgatgcatccgtatatagcattata

SEQ ID NO: 49338 - DNA, 716 bp, Oryza sativa
gttctaacagagcttcagcgagtacagaagatgctaaagaatttaaggaattgtcaacaaccaacaaacgaaacctgagctgctgtcaaaatggtttcttgactatctctggcaatgattttgcaaaaacgggttttattattgttacacagagcagaccctggctgtttcgcgacaaagggaaagcacaagacaaaataaatctgacaatccaatgaggaatactcttattcagctataatgacgttctaacactataattttttttcgttgttgttttgtacacacctgtggcttctacaatctgaattttctaactgtaaattcacaaagtgcagcgagcaatgtattcttctacagagtgtcgctcatcttttgtacaccttggttagaagagatgggagaatgattggtggaccttctgtactcagtacaaagcttcaattctggaattcttctccaccggttttgtttgatcttgttgtggtttaatcgtgatactttgagaaaaagctcatcagctcagaaagacacttcagctcatctgtcctacttcatcagattgatgtcagttcctacaaggcaatggtaaaacaattatgcacacttcttccatgttcaaatcaattaataaaaggacccaactaccaacatggatcagataaaccaggtagaatttgtagactggctatgaaaagtataatgcatctcaattg

SEQ ID NO: 49339 - DNA, 1458 bp, Oryza sativa
tgtttctcaactgttttcgtgagagccattctttttgaccttgcccggtattgtggtgaaacatcaaagctctttacagaaccatcaagagaacccaatgacaaaaaagatgtagttttgaatgactctggtgtagctgtagcaggttccatccccatgggagtgtaaaatctatcagtatttgatccactgatcttcatctcactagctgaaacaggtgttgatttatcccgttttcttctttttaatattgaaggagtacctggaaaactgttagcagcactcttcaaaattgaatcaacactaagctggcttgttaattttccctttgttggagggggagtagtgcagccagcaggtgacaatatatcatccccacaatgttcagatgtatggttcccagtaagatggtcagaaaagagtgaggaactcacagggactacatcttccatgttagggatctggtaacaaagtggaccaagagagcgtgcctcattcttcaaagataattctgcttcacctttggatggtgcagcttctagttgaatggtccaagagttcccggtatgatcaggtgccgagttaacctcaagacctttctcatgaacagaatcaatttccaagcccttaccacggacagaatcactttccagagcttgcgccactaaagtgacagcggaaccatcaactacagatgcctcacgggaagtaagtggctgagcagttggtaatgaggaacgagatagaaaccctgagcaattagaccgatgagctgttccaggttggtcttttgaattgataatgggtgccttgttcaaatcaagatgaccctccatagccatcagctttggtttatccttgaacttatcatgaacaagcagtttcggaactaccatattattgctggtattgtacatatcttgcttctttctgagagaactattccaatgatcctttatagaaataatcagtcctggaaaagcaaccatacgaagcactgtgaaggtgatgtaaagtgtgtcttttcaaaataataacacaactcataattctgatttacgaacaaccaaccaatattaaatagtttaagaccatcgcacaggtatataagcagttgaaagtagaacttgaaccaaaaatcaaccaaattaaattgcacaagcgcgttaaaagatcaaggccagcgtgattttgacctagctcgatgaattaatgaaagcaaaaaattccaagggaagtaagctttataaaggtaccttccaggaagaacttttgctatctcggcccatttattcccataaatccgatgagcatttatgagggcttgttcctcctcagtagtccaagcatctttccttatttggggatttagatgattgtgccacctaagattgtatgacttcatacttagctccgtataatgtattgtatcatgccaaacttaagcacttttttcat

SEQ ID NO: 49340 - DNA, 1347 bp, Oryza sativa
  unsure (1)..(1347): unsure at all n locations
cgagctcggtacccctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcaccgtaaaaaataccttgtttttcttttccaagcctccgataaccctatcaattgcagattcaaaatgttgcattgtaatgagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaagnnnnnnnnnnnnnnnnnnnnnnnnnnnnnnnnnnnnnnnnnnnnnnncaatacttatctgacgatcaaatcttcctggtcttagcaaagccttatccaggatgtcaggcctattggtaccagcaagaacaacaacaccagatgtagttccaaacccatccatctctacaagtaactggttcaatgtgctttcacgctcatcatgtccaccagaaaaacctccacggcctctagcacggccgattgcatcaatttcatcaatgaatacaatactaggtgaacactgccgagcttcttgaaataagttccgcaccctggatggtccaacaccaacaaacatttccatgaagtctgaaccagaaatagacaagaagggcacaccagactctcctgcagtagctttagcaaggagagtctttcctgtgcctgggggaccaacaagaagagcaccctttggtatttttgctcccagttcttcatatttcttgggatttttcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtg

SEQ ID NO: 49341 - DNA, 753 bp, Oryza sativa
  unsure (1)..(753): unsure at all n locations
nnnnnnnnnnnnnnnnnnnnnnnnnnnnnnnnnnnnnnctcaacataccgagtacatcaatataaacatataatctcagtattaaactatgctaaaatactattaaaatacatttagcacctcctatcttatcaatcaggacgaaaaaattgaaggggggactcaggggggtatccatgggtccgataggtgtaggggggatttgagtccgctctacacccacattggatccgcccctgagaaagcgatgagtggaaagggaattcatattctgttcgctcgatcgtcgtctcactttctgcaaggttggttgtttggtgagagatagcctggtttagtttccaaaatttttttcccaaaaacatcatatcgaatctttggacactcaaatggaacattaaatatagataaaaaaactaattgcacagttggcacgaaaatctcgagacgaatcttttgagcctaattagtccatgattagccataagtgctacaataacacagacgtgctaatgacgtattaattaggctcaaaagattcgtctcgtggtttccatgcgagttatgaaattagtttttttattcgtgtccaaaaaaattttccgacatccgatcaaacatatgatgtgacaccgaaaaattttcttttcatcgacgtttgaaaaaggatgtactctctgaaggagagagaaagagagggggggaggcaactatgctctatttttttcccaaaagaaactgtacgctgttttt

SEQ ID NO: 49342 - DNA, 718 bp, Oryza sativa
cacccctgcgccgtgaacgggacgtgccaaggtcccaacgggagccggttcgcggcggccgtgaacaacgtatccttcgtgctcccctacacggcgctggtgcagtcgcactacaccggcaggtccaacggggtgtacgcctccaactttccggccatgccgctgtctccgttcaactacaccgggacgccgccgaacaacaccaacgtgtccaacgggacgaggctggtcgtgctcccgtacggcgcgtcggtcgagctggtgatgcagggcaccagcgtccttggcgccgagagccacccgttccacctgcacggcttcaacttcttcgtcgtcggccaagggttcggcaacttagacaccgtgaacgacccggccaagtacaacctcgtcgaccccgtcgagcgcaacaccgtcggcgtgccggcgaccggctgggttgccattcgcttcctcgtggacaatccaggtgagaatcattgcattattgcaacattttattgattttttttattcttacattgcatttctgatcaataagcgagaaaacagatttggctgcgcacacatgagttgaaatttgcaactaattcgctacttttgcttgaacgtgtgcaggggtatggttcatgcattgccacttggaggtgcacgtcagctggggcctgaagatggcatgggtggtgcagatacgggagcctacccaaccagaagatcc

SEQ ID NO: 49343 - DNA, 1263 bp, Oryza sativa
ctgtgtgtttgcgtgtgtgtgtgagagagagagagagagagggttttgattactggtgatggcgctcagctcacaggggcgctcagatacggaggcgtcgttttgggagtaaataattcgatgcgtcagcacacttggggcctctcctcctcgggagtgtccacactccacagcttcattccgggtcagggggctcatcagaatgctactagtggtaacggctcccctcttttacctttcggaatttggcccccctcccttcagtcgcatgcagcgagatttaccgcgagttactgcctctacgcgatggtaaaaatcaccagcgtaaactgtcaaggattgtgctttactagttgcaacttgcatgatgccgagaacggatttaccggaaagtgacggtggttttagtggtagctttcttggtgtgttttttttttggggtaggagaacaagaaacgcaatggaatcctctgccagggtgaggaaaatggcaggtggcgagccgtccaaatctagattcagaggagtatctcttcgcactccgatgaaccaacacgcacgcgcgcacgttgagggagtcaaacacccgaaagcggagtagaaagaataaaagtagcgccacttgcccaacagaatcccaaaactacccacccattttgatcgagtacgtccgtctatatttagatgctcatgcgctcacatgacatcaaaaaattagaaataaaaatgcgcagtgcagcgaccacgcatgctgggctactggccggcttactgcaccactcattcgctctactcctcagagaggaaaaaaaaaaggaaaggaaaatgaggaaaagaaatggaaaaaagatactattctctttacacaaagttccttaagtcctagagagagagcttcatcgcatttgctcgccccctccatgaatcgatcgatcgatcgagtaccctctcattggtactcgtgccagcagacgagcatcgtgacgcagcggcgcatgatgtagaacctcgcgcgctgctccttgacgagccgcacgcaccggcaggtgaaggacggcctgctcttgccggcgccgccgtcgccgccgctgcgcacgcacatcgccaccttgccgccgccgccgctgctgctcctcttcttgtacagcctgcacggcttcaccacggcgtagagctccatgggcactgtggcgaggggtgaagaagggttacccagtcagtcgccgagacgatgggaaggagaagatagctaaagcagagggg

SEQ ID NO: 49344 - DNA, 1179 bp, Oryza sativa
aatggtgacgagcagggacagtgcaggaggaggcatcttcaccagaagagctccggccgttgccacggctaaagagagcaaggtaaagaaggcagcaacactacggcggtgcaccttgaaggagctctcctcctcctcggtcaagaaggttgggggagccatgttcttggccgtcgtctccttgccaatgtgctgcaggtgctcggcgtaggcgtacccgagcaagccggccgtccagcctgtggcgaggtgcatgacggcgaacccggcgtcggggccagcgaacgtgtcggcggcgacggccacaaggacgccgtaggagacgcggaagaagactgtggagggacgcattgtgcgtgagaggctggagatcaagaagaagaggtgggtgcacatgaggagggcgatcgtccacaggagggccagcgggtcaccggagtggcggcgcagcagcggcggagagcatacgaggaaaaggaacgggactgagatcaagattatgcgagctcgaatacgattggagccttcattgtagacagtggtgactctgcggcctcggcccgatcgactcgccggggagatcgtcgccgagcccgagtggtcgccgtccgagtcgcgcgacggcggccgaatgtcggagggattgtcgtcgggggaggatgagtcactcgccacatgggtggtgtcgtcgatggcgtctccccgcaagaagtcctctgtcttggcgccggtgacgatcgacggggtcttttcaccggtgatggtcgacggggtcttggcgtcgacctcggcgtctgcttcgccatccgcggcgatggccatctcagtggtagggtactagggttgtggacttatggggttgtaaccgcgagcggggtggcgggttttataatggaggaggagctgcccgtagcgggtagcggggcggaaggagaggattcggattacccaaaaaggaaaaaggaaaggcgtgcaaaggaacaggaaagaggaaaaaggaaagtaaaggaaaaaaaatacggtaacgctaattcgctgcgcgttaggattaatcgagtgtggattctaatccctcgaggggatatccccttgtatatctttttcttccaaatttgatgcaaatagttgtgaaaaattctgaaaaaaattgataatgtagagtataatgatacggggatc

SEQ ID NO: 49345 - DNA, 1175 bp, Oryza sativa
aaatagttaatacttaattaatcatgcagtaatacgagcttcattttacgtgtcggaggagggaacacagcttagttaactactccccctactcgtaaaggaagtcaattttggacagctgactcggtctctgaaacacaactttgacttcttgtttctataaaaatattgaaaagtgtatgatagtatttttttaagacacatctattcatatattttttacattttaaacccaacaacttgagagttattcatgatttatattcctaagatttaatttaaacattgttccaaacgattacctttatgagtacggagtacggagggagtacgcagctagtactagctgccggattaatttggagatgagcagatctcctgtcgagtctataactattcttaacgtacacatctgattcagtactgttactttgctttaagtgtgtcatgtctttgtgtctcgccagcttttaatttgtgtggttaaaaagctagagatgggagaggaataatttgactggccgtctcagcagcagaatcgtcaggtcagggtcgatgtaaagctagctgctgctaaatatctcgatgcaaattatcttcttcttcttcttctgaaagagaagaagaaaaaaaaagaagacaaaggaaaaagaaaaggataaggagatatctgcatcgatctgtcacgtttgggttgtacatttttcccgtcttgatgatccatcgatcttgacccctgagacacgctacagtttctgcctctttaatttgttgacgtccaaggcagttactccctacatctataaaagttacacatattacttctgacaccaaaaccaaggagaaattaaatcatcttagatgttataaaatcaaagagtgaatgcaagcatgcaaccaatgagtatttagatgactccttgggttctaataaaacatttaatttatctcttcatttaagttttaaatacataaagactacagataggaacaacttatttggaaaaactcaaatgtgaaatagatataacttttgtggatggagggagtacaactttgtgataattaatatcaaatttaaaaattattaaattaaggaataatagattgagacattgagacaggtacagctcaatactcgtatttattaatttcaaaatttcaaaatattaaat

SEQ ID NO: 49346 - DNA, 3598 bp, Oryza sativa
catcgtagtatagtataagtgaagtatatagattttccaatgcacacccagacgatcactggtattagtttctattattattatattatcgaggaccaccgcatattatgatttcttgatgcattaatggtacgtgtgggtgggtgcagtaaacaagatcaacacttacgaactaatctaaaatgcaccgctagtaactcaactcgtgaggtgggtgtaatttagtcacccatcttgtaaaatgctcgaataagttactcatcttatcttgtttttagggtgcaaatcacataaaacatatgttgtgtagggtgttcgcaatgaagttacgtgttgtgttgatttgttttgtaaacatgatcacacgatctataaataagccaacgtgcaatactaccggtattaaaatccaattaaagatgaattttgttattgattattaagcataatatggtggcgttcattaaaaacatgagtattaggatatacataaaaaatatgtgtattaatttgtaattgtaatgcttgccctgctcacatagctaaaaaatgcacgatgttaggtcaatacgacctccaatttgaaaacaaacaatccatgtgacaatgtattcggtaagatttgcaccatcgaagcaaaatgagtgacatatttgagcaatttataagatgaataactaaactgcacccatcttgcaatttatgataccaccgacgtattatactcgaccgttaagttatagcaattaaatatataacaaatcttgggctgttcgaaactctatattgaagtagcatattagtgacacgtaaaacgaacaactcattagtgtgtaattaagtaagtattaaatattacaaatttaaatataaattatttaattttttaagaaaaaaattatacatattttttttataaaacacatcatttaactgttcaacaaaagtgctaatgtaaatagtattactagtactccatccatttcatattagagcaaggctaataatacagtcgacctgttggctataaggttctttgtagctttctctcagtctacctatatgatagttagctatttataattaatatagggcccacttgtctctctcacagagtttattggttattgtgcccgcttctcctgtcttctctcctccacctcagcatttagctggcttatagtctactatattatacttgctcttataagtcgtttgacttttttctttatcaaagatctttttgtttgactaaatttattaaaacaattagcatcatctacaccactaaattagtttcattgaatttaatattgaatatattttggtaatatgtttgttttgtattgaaaatattagtatatatttttacaaacttgatcaaatttaaacaaatttgattaaaaaacaaaataacttatatataatacgaaatggatggagtaacatgaattaacgtatttctttttataaaacacatcagagtacagcgacagcttacagagtacagtacgcatatacagtataattttcccagctatctggaagtcctctgcagactacacgtcacacgtatacaaagtcatcggaacgtagtgcaaaagtctgcactaattaattgtatcgtgttactaatagaggtcataaatatatctttacatggaggactgaaaaatgccacgtagaagaatatatatttgcatctttatcatggtgtggggtctaaaatgaccatagctaggttgatcgatttgtttactaaaaatacaaattctatttatattgatataaacgaaacagtacgtaaatacaaaatgtttgtacgtatttataaaaaccggagcgagagttgacttgcaaaattaaattaatttagtggaaagaacggcaaacatatggacacgtatatgatcatgacatcgatccagatctttttgcaaataaaatgtggattattatttacaatttattcaaaacgtcagaatatcaaccatttggacttgaattagcataagccaagtccaagccgtgcgcgtgtatatatatatatatatatatatatatatatatatatagctagctagctgttcttcgctatctagtagtgaacgggccgtttagttcctaaaaagtttttctcaaaaatatcacattgaatctttggacacatgtatgaagcattaaatgtagattaaaagaaaaactgattgcacagttagggaagaaatcgcgagacgaatcttttgagcctaattagtctatgattagccataagtgctacagtaacccacatgtgctaatggcggattaattaggctcaaaagattcgtcacgcggtttacaagcgagttatgaaattagtttttttattcgtatccaaaaacgccttccgacatccggtcaaacgtccgatgtgataaaaaaaaattttattttgcgaactaaacagaccctagtgagagcatcattccgatggctacacataaataattattgattttttttaccatactactgtttagtggttctgtttgatgttacatgcactctaatatcacggggcgtatacatgaagaaatagtaaattttggcgtgcatatcacactcattttttggtctcgctcaaacgttttatagactgcgacctatgtgagtacatacggtgcattgcagaaagagaaagaagaaaaagaagaatgcagtggagtgtactccctccatactcgtagaaagtcattttggacagcgacacggtctccaaaacacaactttgacttcttatttctataaaaatatttattgaaaagtgatatatgtatatttttatgaaactatttatcatgacaaatttattcatataatttttatatttttaaactcaacaacttgaaagttatttataatttatatttccaaagtttgacttaaaccttttcctaaacgactttgtttacgtttacgagtacgacagagtattcagggaagccatacagtcgaaagctcaagttgcagttgactctccctacacgtgtagaatacatgcacatgcatatatacacggaccaaactgttcaggatttcagatctcatttaactagataaaacttggtggatatatggaaatgaatatatgctaaatattatagaaatgaaggacacatttggtttgggttaaaatattatgaaaatgatgtgaggaatgataatttattatgctttataatgtaataaactgtagatgtaattgctaagcttgaatcaagtactattcaattcaagttcctctatttgaaaaaaaaaacataaatccaagtctaactaacgaataggaagagatatacactactaaaaatgatttttctgtacgaacacatcaataggttgcaaacgggttataagtgtccgcgtctataaatcgacccatattttcccatacagctcctcaagagacgcgtatgcaaaaaaatcaatttttccagtgaaccacttaaaatatccacacgtgaaaataagggtattttcacgtgcggggctcttaactcaccctcatgcaaaaaatccccccttctctttccactcattttttttattctccccc

SEQ ID NO: 49347 - DNA, 964 bp, Oryza sativa
gtatattgctaatcaacccataattaattcgtattttgctggggtgggggggggggattttctagcgagtagccgatcgagtagtacctaacttggatgacacgcgtgatgcgtgatcgatgccatgcaaaagcgatgcaaagccatgcaggattgcagtgcacaactggcgtgatcagatgaactgcggcgtttggagctgtggcggcaggccggcatctgtggtgatattgattgaatatagtgacattaaaaatagttttgcaacactgtgacacagatatttctaaaagaaattgcaccgaaagagatttatcacatcttaattgcaaagggaactggaataatagtcttgtcctcgctggtggagaagtggtttttacttccgattgataacttttgtagtcctggtttttcaaccgggactacaaattgatctttagtcccgggtaaaataaccgggagtaaaaatcaaattttagtcacggttggtgttactaaccgggaataaagatagagccgggctaggtccggttgctcctttatttttttttcttcattgtttttaatatattgatttcactccatccctgtccccgaatcgtcaaatcccaaatcaatcatccctgaatcgtaaaatctcaaatcgatcatctccaaatacatcacaaaatcttaaaaaaaattacatcacaagttttgcaaaattcatcaaaaatacatcacatattcacatcacatacatatcaaatacatctcagatccaaaccacaaattctcaaaaaataacatatctagccgctgctgcgccgccgccggcggcaggcgagcagagcggccgccggtgcgccgcccgccgccgcgcaggccgccgtcgagtaggccgcctccttccgcgagctgcccggccctccgccgccgcgtgcaaagaagtggggtgtggggaggagggggaatgggagga

SEQ ID NO: 49348 - DNA, 6689 bp, Oryza sativa
tgtttattaatgtttcctgagagtattcctataatacttagtactaattataattacttcacatatataataagcaaaacaaacactaatattcattaaaaaggctaattttctaaccaaagctaatttgactataaggagaatatttccctaaatgtgacaagccgctatcatgcatgctacgttattcttgttcgtcccaccaaccaaatatatggacaaaacctagtcatgagacgttcctttcctattcccttggtcgcactaaccaaagactagctataattgtgcaagtagtgattcgtgtacgtacacataagaacctcatggtgcttgattttgtctgttaacgtaacggtgtggtacgttaaatttttttttgccaagatttaattagtttatctaattaatgtatcgattactcttaaatttaaccatttcatcgacacctaacgatccatttttttaaaatttgtgtgaaacaaatattgttctaatttaaaacaaaattgtacgtactttcgtgaacccacagtccatatacgcaataatatcaaatatatattgaaaaaacatatctaagaaatttcagccgactaccaaaaatgctatttttcataggaatgttggaccaggaatcagccactgcaagttggattaatggcagccaacaagaagccaatcactaacgtagctgtttcccagaggatcaaggctccattttgtgctcggaatattaaacatatagctaggtaactggtaagcgcgcactgccaagtaaaaaatgtcgataaaaactgcaagcattctccacgtggaattaaccgtcaaaattgctagaaattaattaccaaaagttaagctggaaattgaccgtgcatttgtttgcttttatcaccgcgttagtccatgttgtcctcttcaggcgttctaatttgattgtttttttcaggagttctttaattaattatttccagttgcatgcattttttaataaaggaatatattattccggcctctacataagacatgcactcaaccattcattattacaaggatttccaatttcaaaataaataacactaacaaaatagcacgtttataaaatttgagcttgaatgagaatgcttaagcacaaaacctactagtaaacatccacccatgcttgcacatatttacagttgcatgtatatataaaattacaaattaaatttgcaatgttgcatgacacgtttttccaaggaccgttatttctccacatcattgcgataagaacaagcaaaaaactttcgcactaagtgttcatatgcatgatagtgggttagctgcaaagaatgatccgtttaaattctctttgatttcaaggttgatctggtcgctgccgtgacaatttgctgcatgactccatgaggattgaggatggtcgcaccgtcctttgatgttgcttttctctgtaccgggtatcgattccgtatagaccatcttgtcaattaaaattcggtggcaccacaaaaaactaccaacagcgataccttctgcatttgtcgtagtccaacttgtaaagtgtgttattggtcgtgattcgaatactgacagaacttggttcctccaaagcacatgaaagctctgaggaatttcccaatgcaagtttatatctcttccaatcagcggcggattgatagctcccgggcaggttgggcgcgcggccgcccgacctccgccgctgctatctccatcgccgttagccattgacgtgtataaaaatcagtcggtcaccgaaaaatcactattactcgtccgggtttcacggtggtgctggttccgccactgcttccaaacgtatacagcttgatcgattgtttcgaacatatccgctctacaatttatatgaacttctgtacgtatggataggccgttccaagtggtggaaaaaaaagaacaaacaattagttaaacacaagttcctttatgacagtctctattgggtacatagtattactagtaggtactttcaatattattacaagtatattatatcttaattgtttaatcatgaattctactactagtataaaaaaattattctactaccgtacaattagtatatatgtaaaacgtctatttgaaaaagtgaaagcaaataattagtatacatgtataaaagtattcggtgatcagaacattggatttgcccttcttttcctatacttacgagagtagaatgatacggggcgccatttggctcgagataaagttttgtttcgccagggcatccacaatgtggcgtaaaagtagtccataagcaatagaatattctattcagccacctattctcattgtgcaactagtccatataaaaaaaatagcaaaagacacccatatgcatatagactaccaatatggaataaattatattatctatctctactcctctctcttcttctaatgatatcttgtatctatatacattgtgaacattgtcatagggataaactatttatgtgggttccatctatatggattactttgccatatacattggtgatgccctaaagatgctttaacattttttttgttttagttagtgtttatccacctatatatatcatcctatctttattttttaataaataatgctgttaactttttatcacacatttgatcattcgtgttattaaaaaaaattacgtaattataatttgttttgttggatcgagttgtttcgttacttaaagtactttaatcatgatttatatctcacatattttcatagaatttttgaataagacgaatagttaaatatatgttaaaagtcaacggtattctctattaaaaaacagagggaatatatgactaaattttaatacttagtaaccttagctagctagttgacaaattaatcattctacatctccgtacgtgcatatatatatatatataacggaaatatcgcctagctagttccccctagtgtaggcaatcttgtctaagatccacatatctactaaactcaattagattttagaacactggagaaacatggatcttgttcccactgtccatacataggaggaatataatctctctccttcttttcgggaagcctgtaaatggaacgcataggagcatgcggttctattcccacatatactactcttttattaaggattgacatccacatacagagatgtggcttactcctgcagataaataattagaccatgtggaggcctcctcctgcctagactttctttttgcctatccatcatattcatatactccttccgtttcaaaatgtttgataccgttgactttctagcacatgtttaaccgttcgtcttattcaaaaacttttgtgaaatatgtaaaattatatgcctacataaaaatatatttaccaatgaatcaaatgatagaaaaataattaataattacttaatttttttaataaaacgaatggtcaaacatgttttaaaaaatcaacggcgtcaatcattttaaaacggagggagtatattgaaccaaccttactaccaccttgcctcacctaggtcattcttttaaccaattatgtatatagtgtaatatatatagtccttttagtttagtttattaccacttaatcagttttggatatgaatgttctgtgacttatcgatcgcgattatatgcatttggataaaagttttagttagtgtaactggcaataattcaactaatttctcgactaaaacaaatgatccctaaagggaaaaaaaatactctgttgggtcaccattttcacgggagaaaaattcaatacaaatggaagaattgtggactatactactatttgaagtgaaaaaaaatgtgattagtatgaatattggctgattttggctacggtaactgagctgcataaaaaactcctatcttttaattgtccgatgaattatatataataaaaaatagacttaaccgggatattttataataatctttactggtagtagaaatcagtctaaaccgtttattgtttctaatccaatgtaccgtttctgtttttactaccatatcaactaccgatattacaatagatttttctattgttacaagtcataaataaattattggaacttgtactgtgataatgctaatagtacgttctactacttgtagagatcaacttccggttgttataacagattatttaatcttgtatggaatctaatctctgtcgtttataagagaatcttgtgttctgattcttatttggtcactatccatggggtcaccgtcttttcttgtttgttcaagtggaatatctcttatgaattattgtaagaatatattgctaatgccttttcttccactgatcgattcactttattttttgacatccttttaactgtcttgtggtcgaaaacttctacagactgcaggcaatttgaacttgaggtcgcttgtcgatcgtccataatttatagccgcattttaaccatgttaattagccaccagcaattgtcggggaattcttcaacacatcatttggatcactaatcttttatataactttgttttaacccattattaattgcaagcagcttgctagccacaacaatatgacacagtaggatagtacttcctaatttggtagcaggacagagcaaggatgaactagtgatagttttttgtcctacatctgaactgcgaattccctttggaataaacaaacgtaaaggctgttcttgggagaggcaggccaaccaagctacgattgttagtggcatccaatgtacacacaacaagatctctcctcgaattgctttcgtgagcattagaagtgtggagaagcattgctttttatgctattggctgcaagaacttaacgaagaagtttcagaaatcatgttgagatgttttctttctttatcttgaaagcaatggcgaggctttatcaaagatctcaatcggttgtggtgacaaaaactagtacagatgacagttgtttgtttctgtgcttaaaaaaaaattgtaccaaacatatgatttgttatgcgatgtgttcgaattatgtaactgaagaaagaagttgactgatgtatagtttaagtgacgagcttccatcatgtcgcaaaataaaatatgagaccttgtaaaaaaagtacaggtacgatgagatgatcctcctctcaaacttggttgtatatgtttcaatctgatcatgactttaaactatctgttaattttttattagtaattttataatgatcgatcatgttcaggacggctccagaaatttaggtcgcctgaactaactgcagcacatgatagtgattagtgtgtaacctacttcagagctgcatcatgtcaaggaaacataagaaaatcaaaggacaagactaatacctagagcatccaagagcacatcaagtggttgactttagatttaatgaacttattaatacgcttactttgtctatcaatgaagttagcagccacaataataaagacctggtcccagatcaggagtacgatgcatcagaagaaaatttgctctgctttgctggttcattctgattccaccagctgtttgctatgatgaaacctctctagtattttctgaaacttcacatgtcagaccgtttactttggagtaacataagaattaagaaacgcagagtatgaaattgaaagcgagattaaagaaaaggaagaaacaatataatacttttagtggtccaatcgtcggttaattaagttattatccatgttcagccatgttatgggcgaaattcagacgtttttaattaaccccataaaagttgatagattctgcaagagcgatatgacattacacgtatctttcacacgcaggcagggctgcgcacacgtgtgatcgctctctagcctattttgctgaattgaagaaagatagtactccctccgttacgaaatgtttgacgccgttgactttttaacacatgtttgaccgttcgtcttattcaaaaattttaagtaattattaattcttttcctatcatttgattcattgttaaatatatttttatgtaggcatataattttacatatttcacaaaaatttttgaataagacgaacggtcaaatgtgtgctaaaaagtcaacggtgtcaaatattttgaaacggagggagtacatagtcatgcttcgtcggcagggtagctcgatcgatgtctgcaggctgcaatgtcgtcagctagctcagcggctatatatgcgtctccttccttatctgatctacacaagatagcccaagattggaacgaaatgtcactcgatccatgcttatctttttcctgcatgcatggatgcgtatgcatctctgcctgccaagccaatgccacctctcacgcagacaacccgatgcatggccggccggctgctgctgatatatagctggagctagcgcgtcatcgctgctgatacagatatacttgctccgtgtcaaaatgttgctatctaatatatgatcggatattttctagtacaacaaatttaaactgaaacctattttgatttgttatactataaagtatctaatcattagctaggttagtagtaatatttcgggacgaatatagtacaatggatcagtgacgaaagcagcggtttcggatgcagataccttggccatcgcgacgagcaatcaatcgatcgatcgatcaagg

SEQ ID NO: 49349 - DNA, 12051 bp, Oryza sativa
  unsure (1)..(12051): unsure at all n locations
gacgtgtccgcgtcccgtccactcgcccgatgaggaaatttcccttctgtactgtttcgcacgactcttccgccgacgaattcccccgcttccccatttcgtctcgcggtgagtttttggtagtttagtttgatacaccacttcgtttgataccctcggcgaccgcgcggcggccagcgggcgcatccatggcggcggcgggatccataggcgtgtacaggccggtgttcgcggcgctgggcgctctcatgctgggcaccctggtgtacacctgcgtcaccgacggctcgccgtttcgcctcgagctgctcaccccgtgagtgcgttgatacaccacttcgttttccttccccctccatggaagaggattgggtgctagttactgccgcgaattttggtagtgctggctaatttcagatgtgctagttactgattgttagtcagctattgctttttttactaaagtagaccatttcaagcttttggatttttgttttaaatttaggcgtaatgattagcaaatgttgggagtcactagtactattttaagtattattccaatgttattgtctgtgacctgcacaatggtgctgcagaaagacaggaagtataggtagttctcgatggatgcaactttggataattaagtgcaccaattatgctctagacctctaggtttgtagtttgtgcccaaggctttgagagagtttgtatgttcttaacgaatgaactatgtgttgcatcagagtagggaggtcagaactattgtccaaaagcgccttaacttgaagttgtaatttttctctgtgtaggtggttggtggcaacactgattgatttttatgtcaatgtgactgcgatttcggtaattcatttatctctgtgctgtactttgcgccctcttcaccaactagttattttgttacgaaggaagtgtttacaagcagtatgattagaaggaattattttctggagcgtgaagtgaaagcggcagcagtcaattgtttgcatgcattgtacaaaagtgcaatatgttctaccattttttaaatctgttatttacgaataaattcaatgttgccaaaacatatttcataggagatataatgcttgagttagaccttttttttttctgtgtgtactcaattgataaaatgtttgctaaatttgcgaatctggtgaaattttgatttccaccaaacatagttcctgatctgtatgagggaatggtatctaactggttgaagctttatctaaattgcatgacgattgatctcagatatgaaatgatagtagagaagttttgttgtattatctctcttaacatgtattttttttttgtgtgtgtgtgtgtgaagtttggagcttttgctgatatttctgctccaactccaatctgtgtaccactgaaaaactaacagagaattcttttgtgtgtcttatcctaattagctcctttcccctgattaagacaaacaatttctagattccaccttaaatatatacacaaactaaaggatatttggatctgcaagggttgaccactcaaatgctttgctctacatgatataaataatgtaaaagaaaatcattatttatttgtccgcttcatgtatggagatacaattttaaatattatttcatcttgatgtgagctagagatgttcttgcatgttgcagacttgggttatctacaaggaagtaaattggattagttctttcttttgggtagttctgttgtactgttttggcaggtactcatttccttcttgataatatttgtggcttgtcaaactttcataattctgtttgaatggagatattcattttacctaatgtgatcatccttttttcctgttatcttttcagtattgctacatgtgcttatgttgttgtgaagctttttgaaataaaaacttccggaccttcacaagatccacttgatcttttattcctcaggtacagattcaaatttttcctagcgtatgcaggatgaaaagattttagtttgatgcttttgacagcataatttggcaaatcaagtaaaaaaaagttttttttttacatgctgatattgaaaacagaaatggatttggcaattttgttctttttctgggctgggggcactgatggtctggtggacatggactataagaagcttatattggttcatggttacgctatgttctctttcaactttggggggacctgtgaaatgtgttatcctgtagatttcaacacctacaacaagaaacttttgctttcacagtttttgcatcttttgggtctagatccctcatatgttgagtaatatacctaacactccaaattccatagttccatagtgcatgctctcaccaatgtggtgaccttgtgtcacattctggatgtctaaggaatattgttgttcatatatcaattgttattcttatcttctgtgttttgaggtgtttctcaacttcttttcaggcaaggagatctatccgaaagaaagtcctcttttgtcataattgggagaattattttcagcattttgggggcaatgatggctgcagtcgtaatttatactgtcatcactgatggactacctttcaggaaggacttgttgaccccgtaagtgaaccatatttgctcagattatttaagaaaccttattttctttaagtacattctaagtccagttgaatgcagcaagcaaaatggataaatcccagtgattgaatgaaagatcacagaggcatagattgataatacagctaaaggaaattttgaaaataatatatttaataagcaagacaaatgtgtatttacaagtgctataagcaccctatgctgaatttacattcaagagttaaactagtaactgtcttgttaggagcacttagcacttaccatagttgtgtacaggcaaggagaacattttacttgtgttctggacttatcttctaaaaatttgactgcaaatagtcataaaaaattctgaaataacttagcagtatagatcattatctataaaaacaatgtgtaaaaattcaactgcaaatgtggcttgtattgggagaaacaaaaaaacaaatatcagtgaatagtagctttccctttttctttttgccattccactttccgttgaatttttcctttctatttcttcatgtccacatcaaatttagatttgaaattttctatcatgatagttgatagatttattttgtatcaccactaccaaattatttgagaaattttcatgactattttcaccataagagtaggaagcacaggaagtccatgcagagttaaaaaaagaattttggaggccagccctaagtaatgctctggaagtacattttcgattagtatagtgttgtatatgttttcacatgatttgttaaatttatcagtacatgcttcaaacatgctaactctgtagatgttgtctggcactttttattttcttttttccttattatacttgtgttatcaattagaaaaatatcaaatttaatattttcctttgcattcaggtggatggcggcaaccttaattgacttctatataaatgtcttcgcaatatcggtaaattacattctttggtttttagaaattgttccaagtaattttgtgcgacacactagtttgcctgcatgaatgcatctgcatcttggaaattgttgttcatatttttgtgcaaacggtgggaaacgatttttatttgctaaaactacttttgcatgactctattgttatttggaacagttgtcttaagctcagctctaatcatgccatggcacccacagttttctgctaatagttttttggtatttgttatgaaaatatattccattaaaatctacaacacattaatccttatgtccagtatattttatcatttttttctttcctctttgaaaatatgtgaagataatcttattttttaaaaataaaaacataagcgctaattagcaatgctagcacaacctcccacctactgaaaaggtgtttccatgaagtaattaatacgtcctgcaactataaaatggcagggcactgctggctggtagagtggtagcgtcctaggcactgcatgtagtggctatatcttctatcagtaaattaaaaagaaaaccatcatagtggctatatcttctatcagtaaatttttggtgatatgtctgcaggtatgggttgctcacaaggagcaaactggatatctactgccatctggatatgcttgttaatatgctttggaaggtacacaattttttgttgaggattataaaggaaacatctcattggatatctactgccatctgggttgctttcgaaggattatattgctacattgcattggggttatatttgtccttgtgacttggattttactgcatgaactttgtagaatattttttgtttgcacttcttaatcataaggtgcaactagtagttactgccacctatcaaatactgtagataaaatattctacagattttggcaacaaattagtcaaattcccaagtatagataatatacaaaaattataccaatagattgacatttcaaagtgcgttcatacaatataagtttgataactactgatatatattttttgagaaatcaattatcgaagtttaatcttgaagacttttaaatcaagtatgccttataaaaatcaatgaaggttgtgccatgttagctgtatgatgcatacatttttcctgccacttgtattttctagtgcttctccttatgagtagtgtctagattatgtttatttgtatatgggaggcactttcctgctcaagaatagttagtcacgtaatatgaacatctatagtaaattcatcagtgagttatgcgcatcatgatgtatttatttgtaaggaacttattgaccctttccagctttttttcatttgatctagcatcacgacatgtggctacattgtcatgcaacttttgccaagtgtcgtaccgagacccaatctatcatgtgctattgaactctcataacaagtatggcattgttccctcccactaatccctgatcttctccaagccttgttagcttgtggttgtctaaactttgcttgacatatggtcatttatctggtatttatatgtctgaaatgtaggaagatttgaaaatatcattgaagagttatgttattcttggtatacaataatattacctcaataaatggtgtatcgtctagacaaatagggaattctcggtgtaattacatatcattctcagtgtaatgacataactttggcaatttctctacaaaaggaccagactatatgcagtttgcagctcctttatctgtcgtgttttttaattaaccctttatttgtatatctgatttagtcgatttgcaaaagttttcttcattgtagttgttatcaaaattgtaaggtcatgtaacacaaagggttactaaagtgaagtaaagaaaatgtgactgtcttgtttaactgggaaattatttgaattgccaaataagtttgcagtcttgctgaaatcgggctcgcaagactcttttgatttgatacatctctatcttgagtgtgtgaaggagcctcacgcagagcagggaagacttccaagcattataccccctagctctgccaaagtatgaagaatatgtaagccatcttttgccagttcttttgcagacagaattccaatatgcagggattcagatcattctcattttgttctttctgttggagttagaaaaatctttgcttcggcatactctcaaatataatagctttgaattctggacccctggaaccaattcttggtcacactgtcaatattttaacaaggtttcgatgtgtaacacttgtaaaactcacattctgtaggaaagctttgagatgcctattgttgatgtatcctgtaggttgaatagcttcacggcaaggttaccagaagcaaaccatgcttgccgtatgcgttgctgggccaatccatagtttcaactgatgcattcattcatgcgtgacaaagctcagcgtgatgtgctcgtgaaaagattttaggttgtttaaaatgcaaaaataacaaatatacctagttgaaagtaattaactagtgctccaaaatacaaaaataacgaatatatcagtagaaaccacatctcgccatcgtcttctcctgcttaaggcgcctgcgcgtgtcctgtcctcttaatcaagacgagaaagcgaaagcaaaaccaaattcgtaatcttagactacaaccagcctcaccagctgagctcaccatgaaatcacaccattgcttcctttcatctgtatctatccagcagccatgatgtcggatcgagtttggcctagacgatggcaagctaaagaacctcctctgggtagctcgagcgcacaccgccgctctcttccgctgccaagcccacaccaacaacatatctcgatcccattctccgttctcctgacttctcatcgcaacaactcgctggagcctatcatgaaagaagggaacgagaagatcgaattgatggctggnaagtggganccaatggatgagaagaataagaaaaacaatttggtagtagaacccaccacgggtcagtgattgaggaatgaaaaaagtattactccttcccaccgaaagtatgattctagatttaaattttatctcaaaataaatgtaattctaccatactatttgtaatatcaatcatatatactagccacccagtcacgcttcgcatgactctgagcgccggcataacttgtgtataggagttgacgacggatcttgataattacgggataatttttgtgagactattatctctattttttaaatataaggatttccatattgtttaacaaagattatgtttaatcatataaaatttttatatccctttacggaggaatgataggagttgagaaaatagttaagagtaagataaaataaattgaatgggaggtgagattgaagataaatccttatattttttaataaattttaaacatttgtgatgcttatatttgcagttagagagtctacctttatgtttttttgaagggattagggagagggcaataaaattaaatgggagggttgtgttttatttttgtttctgatagaaagtatatgaagaaattaaatagaaaatggttgtagttggttgagatgatggaatagaagtaggataagttttatatattaaaagtagctatatttttagatgaagggagtaatataattggcactatggtggatggatttctgtagttgtgggtcaatgaggcgagctgctgctgctctccatctatactaaactatctgtatatgcaccgatcgatgcacaggacctattcatctggaactctccctatgtgtgattggtatacacacaaatggatccaacggtccaattttgttcctactctcatcctaaggctattattattcacatgacgtggcttattagtttatgagaaagctggttgctttcacatatgtagatactagacaatcatactttaatggatctttgtaataatgtgccataggtcattgagcaaaagctgaaattttattttattatctaaaaaatcaatcacatattattcaaatttctcttaatcttatactctatcctccctctgctaaaatgagagagtacttgatcatattaaataaaagatattactactcataaaataattctttgttatcgcccaagagttctcccataaatttcctatattttcaaatcctgcaatcttattttaatcccaaaattttctactaatgtatctttttttttcaatcctataatccaaatatgtttttttccctcttctatctccatttattattaacatgtgtatgaatcgcaatataatcatttagtagtaatttatgattaaagtgagacgttgtaatcaacaataacagttattcgagaatggagtagtatttagctgctgtgaagagcccttgtgtgagagagttgtttttaaaagatcaaccttaaatatctcatagcattcaactacgattttttccctatccattttcgttttacgtgttttcttaattcaaaatacggccgcccctgttaattcgttcgatttttgagagatgacaaaatttattcacgcaagcattaatttggatgtaaatagattttacccgttgcaacaaacggatatttttctagtttagtccaaagtaaacagtttagataaaagatgatcaaaagtaaaactttaataataaaagatccaaagtacattcacactatatatttgcaacactaggcaacccacacgtcacggcctcagggcaagttttatgaaataggtggatcttgcatctaatcttgaccacatcatcaactaataaatgtagaggtaacatgtacaatactcacatctacactaattctaatatactagccccaatgtttgtttgtccaatctactcttcccctctttccttttgtcttgaattttgtgtagcggttatctcttgcatgagaggtggctgcttatctctctcatctcttctctcctccacttcactattttaacttatgtgacatctaggagattgtgcttggatgcccatagtacgtgccctcagggcagtcccaacccataacactagacatggtttctataaactccacgtcatcaagaaactagtactagacactattcttccaatgcaaacaccactattccatactccaatttaatgctacttatctcacatgatgtcttggatgttatgtaggaaccatgtctcatacaagacatggtttccttctctttcctcatttattcacttgccacatcattttttgtcttaagtggcaacttatttaatgctatggataccatcctagttattgggttgggaatgccctcacaaactcacagtaaataccggccttcattaatttttttcacaccggctagtctattcgaaccatcaagcgcaagcacattatctaacaaaaagctgcaaggagtagattggtatcttcatccgtgcaatttcattgttagtttgttggcttgtggcccatcacttttcaccatgaaacagccggtgcatggcatagttaactattattctctctaaaaaaataaaaaaaaaacttcttaaaacgaatctggagattatatacaattactcagctcgagaaaagctcaaagcttgaacgttctgagcccaaaataaagcttgagatctggtgaggctcgactcgagcttggctcattgacagctcaaatataggcaactatcaatctaattcgcaatactagtatcttcaaccctccattattaaaactagtgcaaaataaccccttggtggttttaaagatgttcttttgctgacgtggcttgttaacttaatctaacctttgagtcatcatgttggacccacatgtcatcctccctctccttcccttctcactactttcctctccctcctctctttccccttctccacagaagcaagaaagtgggaggacgaggagagcggggagcggtgacggcggtggcgggaggacgaggagagcgcacgctgcccgcgagtgctaggagcacgttggagaggtcctcaaccagccgccggatactgacaaactagagaggtccttgaccggccgctggcaaccaaatctggaggtcaccacctcccatcgcccttcacccgccgtcctcaccactgcagcagccgtaggcgccgtcgcacgtcgctgccgccagcgctagggcagaaggggccgagaaccatcacccttcacccattgtctgcaccgcctcagtagccgcaagtgacgcccccgccgtcgggccctcgccgttggacgccgccgctccacgtcatcatcgttagccactgtgtgccgagaagaaaggaggagagagagagggagagagggggagaggttagtagaggaaggggatgacaagtaggaccaacttatttttttaatttatttgatgactagggtgtcacgtggataccacattagcgaaaaccgcttttaaaacaaccaaggtagttgttttaaacggttttaatagttggggaagtcattatatctggtcttgtggtttaggatatgaattagattcgatctttatttaagggagtcaaattggcacttttttttacgtaggcgcatatgttatacttgtatgttaatggaccggtataagtccacctgccgtccctcaactttacatgagtttgattgacctttttaatttcaaataccataaatctttacctttagactgtataaaactgtgcaatatgtcccattttcactgtttttacttacgtgccaggtgtctgggccggtgggcccacttatcagcatcatcatgtgagttccgtgcttcggtgcttgtgcccgttggtgtgccagagcccgagtcggtggcacagggggtcacgggttgaacggcaacctgccgccgccgtcggtgaacgtggctcatctgagccagatgttcgatcggcgccaagcagggggtcacccaggcggagatggtggcgctgtcgggctcgcacaccatcggccggtgtgtcgccctccagctccttcagcaaccggctctagtagtcgtccggccccaacgccgggcaggaccccagctacgtggcagcgctggcgacgcagtggcgcagtgcccgcagcaggaggaggccgggagctggtgcccatggactggacgccgtcacgcccaataccttcgacaccaactaccatgccgccatcgtcgccaactggggattgccaatagtcccgactcgttccagaccgacttcgcggccgacaacgtcaagatgggctccatcggcgtgctcaccggcaacgccgccggcggcaccatcaggaccaactgcagggtggccagctgatcgatcgatctcattccataagcaatgtatagtataagcatgtgtgggttgggatcgtattgatatcaaattgagcttccggtccaaactattgggatccaagttgaggagaacgtgtagactatgcatattattggaccggaaaggtacgcagttaacgtgcggtccatgatagttagggcggcatggaaattgttcacgtgaggtccatttttttgggccgaggccggtagtaggagggcctggcgctcgattcctctgcttctgcttctgcgtggagagggaggaccaattcctcgcgccgccgccgccgccgtgacggacacatcttcgacggcccccgcgctccaccaggggggtagtttccgccaggtctgcttcactgtctcctctgcggcgtcgtttgttccatcgggcgattcgcgtcgtccgcgggctctgctctctcccggcctccccggaatcgctctctgcccccgtcatgcggtcgcagctcgagagtgatgggggggggggggggggggtctccctgctgctagcctgctagtgaagtgcctgctgtgatactactgatcatgcctaccggtaggtaccagaattggcagatttctcaatacttttttccttcaccagtttaaattgtgtggttaatactagatgacgaagtagtaccctatataataattcattgattcattccacacgacagaaaagtaaacgagacagatagaagagctcaatactgaattttaattatttgttacaaactggcatagttatcagacattattacacacataaatattcactagtaagactgaagaggagaaaatgacatatcacaagctcaaacaagaaaaatgtactagtagcatgtgcgacataaaagaaataatcctttggcttaaccatgcagtgctgaaaattcttctttgattgcagcgacttccttgtaaacgctttgcattgtcggccgatctttaggtgccactgcagagcacaagaggccagcttaaccagcttcgtgacacagttcagcattccatccatcaaacaattatcatggtctagatcattgtttgcatcattgtcttcgttctcataatctggcatgatgctcgg

SEQ ID NO: 49350 - DNA, 6447 bp, Oryza sativa
ggatccctcggacgattcttgtaggatgttggatgcagccaacattctaggttgccattaaccatgtattcaagaacaagagctttgaactcatgtcctgtcggatcaaatgttgagcatgcggtgatcacccttacgagattgcgatggcgggtgttcctcaaggcctcacactctgctatgaagctttttggtgctccaagttgatcaagtttgaaaactttgatagcaactgcatgtgcttcggcgtcaaatttaccaacatatactgatccatatttccccgaaccaattaagttggttggagaaaagttgttcgttactttgactaaatcagcatatgtgagtttctccaatttcttatatgatgggtctgttggatttttagctttttttctcttcagaaaaaacactgctaaacatgacaaaaataccaaacagaaaacgctgagccctactacctttgcaatataggaagtgtggttgtttttagaagcagatatctgacaaagtggcaatttcagtagtggtgagatggcacacaactccttgttcccttggagaaaaaccttgcttgcattttggaagatcccattggatggtatgggtccctctaggttgttgaatgacaaattaagaagcaccatagagctcagagtctcaaaaaactctggaatttgaccagataagttgttccgagaaagatccatctgaatgatgcctctcagtgcagaaaaagatttaggaatttgcccattaagaacattcccctccatgttgagatactcaagacggacacaatcacctagagctgagggaatttctcctgacaatttgttgtttgaaatattgagggggccaagattaatcaaactaccaacttccactggtataggtccagagagtctgttgtgtgagaggtccagaccttcagaaagtgtggaaatagtaaataattcctttggtattgttccttccaaggagttacaagaaagatttagtatatctagtttttggcattgtcctaaggccttggggatgagtccactgaaagagttatcttgcaggtaaagctcagttaactgatttagtttaccaattgaaagtgggattttcccataaaaactgttttgtgctaagcttagaatgagtaagtttgaaagatttccaagtgagtcaggaaggttgcctgtcagcaaattatggtcaatttgaagcagtacgaggtttctgagttgttctatctcctgtggtatggtgccagagatgaaattggatgtcaaaactaatattttcatgctttgtggaagatcaccagtggaacttggcaggcttccttgaaggttatttgcatctaaatataattcggccagctgtgtatgtgctaatgctgggaggaaagtccaatctccagcttcaagctggttcttacctagatcgagaatggtcaagttgggtaaggacccaaaataaggaataatacctttgaatgcattttctctgagattaatcaattgaagatttgttgctttggccaatgatttgggaatttgaccatggaatttgtttccttgcagaatgaacatttcgatgcttttaagagtatacccaatattttgtggtaattctcctatcagattattttctgccatgccaaggaatgtgagtgttgacatattgtagagagggagtggaactgttcctgtcaagttgttcccagtgaattccagttcttctaagtacggaattctacttaaactcgatggaatacttccttgcaattcattccatgcaagcagaagtgagtaaagtgaagtggagttgcctagagaagatggtatgctacctgagagattattgtaggacagataaagaaattgaattgatgagaggtctgacaaaggtggaatggacccaaaaaagttgttttctgccaaatttatggcctgtagtgaggagctattgaatagagcgggtggtatctctccaccgatgtgattcttccttaagtcaagccactgaagtgatgaacaatttgctagcacagggggtatacctccagtaagactattgtttgcgagaacgacataggtgagtgacgagacgcttccaagtgaatgaggaatgttacctgacaagttgttgctatgggcaaacaaaaccgaaagtttgtcgagcgcggtgaacccatcaggaatgccaccgtgaagcatgttttcatggaggacgattcttttgagatttgaacagttgctcagaccaaggggtatctcccttggaggaagttgttcccaagattaagtatttcaaggcaaggaaagagcaaggaaagatagagagtttggtatcacaccagtaagattgtttgaagaaaggtttatgtaaactagacggcgtaggtggcctacttcaattgggatctcaccattcaacctattattcgataggtgaattcgtgtgaggaaagtgagattgccaatacaggggggtaaatggccattgaggtctaaggactctaggtgcagtgctgtgacacgagattcatgtctctttccgcaggtgataccgggccaagtgcaaaattggagagactcgttccatgaggctagggatcttgcattgttagagagacgagacttgagacaaaggagggcctggagatccttgttggattcatcatcgagtgcggtgctacttagtgacggaattaatgggagggtcaagaaagcatacaggacagcaaaagtgagaagtgagggagtgagagttcctataggaatcatctatccgctactatggatgttgttgctgttatgtttgtggaagactagctgtagcttgggttgtgttttttttcagtagcagggttatgtgcatttataggttgccggaggatagcggctagccatttgttgaatttgttccaacctcacagatgcatatctacagtcaaagattcaaaagaaaaagaaagagttggttcgtagtccatctttgctgtcgtgcagactattcaaacaatggacagtcctctatatacggcaaagcattgtaccgagtacaaattttgtgcctgaactcagtttatccatttttctgagagtgctccccagttctacttgatagccattaatgcctttcatgttaaaacattctataacgttttatttggtttgaggaaagaggaacgactctcttttaaaaccgtttgaccctcatcctgtgcactcatacactccagcaatcaggtccttcgcatctcaatccgatggctaggatctggtagggtgggtaattttataaaaacccacccgcctcctatcttctacctttgcataaatcccctaaccagttcatcctcccattactctgtcagagcacaacgctgcgacaaatccaaagattccttctaaaccaccattccatatttccatatagcagagaggaattaaagatttctttttatttttttagagaaggataactttttctctgtctctacaatccaaccggatacccgtggattcgggtatccacggatacccggcccgatgggcacggcatggcgcgtgggcaccttttcttttttccgtgggcacgcccgagctgtaccgagtctctttaagttatttgtcctatgaagatttgaactcatatccatggagtgctactctggttactgcaaccactgaactacatgcccttttgcagagaggaattaaagatttaggttttggatagaacgaataggagaaagaagaattttaggaatctaagagtggatatctagcacttgattccttatatctatggcctaagtcatcgcttcgtatcagccttcttgtgggtgggtgctgccatcgccctcatcgagcagcttcacgtccccgtcattcgtgggagagacaaagtgatttgggggtagctacagccaaagaacaggaaacccatgccagggggatttttttttaacaaatatggcagattttattcatttaggatagttacatcgtttgctaacaaatcaagaataaagctagggggctcatcgtcccgagtacagttttgttttacctgcatcgctctctttgctaacttatacgccacttgattcgcttacaaaggtacaaggtgggaagtgggtggtttattttttctttttgtaaaattaccctaccaagatcctagctatccgattgagattggaaggaccttattttactactggatgagtacacgtgatgtgctgagtgcacctgatacattgccataatggaatagaagcatcagacatctggatctacttatctatcctacaaatagttggccttctatattagtgtacgccagaacttgtattgaagttcttaaaataaattgagtaaattttacaaacctacatatacttccatagatttaaggtgttctacaataaatttagtgatgccgtatctgtaattttgttatacgcatccttaaatttatagtcttgcaataagttggtcaaagtacatgtcgttttgtgaaatttatttaaataaataacatgtgataaagtttaaaaagacaataacgttatattatttgtttctgttttttttttcatttgtgtgcttatttcagttttggagacacgtgtaggcatttgattttaactaagtattttttaattgattgcataaagaacaaaaggtgtattagagaaaagtgtctaaaattgtcttccttgtttaatgcattgtctagagttcgaagaatctctctaggatgaaaacttaaaagtgtctaaaagtgacttatggtctagtctttgctgattggatcatggcaagttgataacaacggggtgtacatatgcattgttcaccttttggaggcgttattttacgagtctttatcatagttgaggcgtcgctcgctttggtggagcatgagaatgaagtttgtttgtggctgtagcttgttgtggcatgatatttgttttttcttaaataatgctaggctgtgtggttcttcttcttcttcttcttcttcttctttttttgtgagtggaggttgtgtgcatcttaggtaatggcaggagtcgtattagagtggttgtatccttaaaacagaacttaattatgtcacaccatatctattttttttcggggaaagggagatatattacgaagctatagagtcagcaccgacaaggtgtgagatgaaattacaagaatcatcaggccaaaaggccgttaaggactcacacctccctctattagctaagatatggctaatgcgattctgatcacgatagattttcgacaccaccacctccctatttccagccatgaggcatttaacctccttgactagaaatgtaagctcagacctgatctctattaacagttcatggtctctagtgatattctaaatatagctgctgggtcatattgaatcgccgtacggatatacgactatagttatagataggttatcttgttaattagattctcatgaacaacgtgcttccaagaacaatgttttgtttatgcaaactactgcaaatctaaataagtgaaaggtggaaactttcttgcaagattacatgtccatgtcatctttaaaatacggaccatttgatttttcctccagacattgctagccattagatccttagattggcgaaatatcttcgttccccttcaagaaacttcttttgtaaagaggtcctcccacgtccctaaccaaaaaaataaattgtttctcctcgttgtctccactcccaaatcgtgaaaacgtgcactcttcgctgccgtcagctcctcctccatgccaccaccacctcctcctcctcctcctcctacctaccccatctgccgttgctcctccactccatcctcatgcgcggtcgccaggcaacacctccaatccctccacctcccaggtgaccacgcagcggagcttggctgtgtgtcccctcaacatccacaaactcagaggcgatggattttgattggccggcgacgaagaaggggattcgacaacgagccgcttcttcgtccctacgagttcacatgcctccgcatactaatgatcccacaccgcttctgccatcggcgtcgtcctccccaattttcctccggggcaactggtgtgtaatactgaaacacaactgaatgcaaattcttgaagatctggaaatttgatatggaggaaagagttgaagccccggaagtaaaagatggatctttaatcccggttattttaaccgattcgtagggggttcccaattgggagtacaaagcctttctccagcagtgtttctgagccactacagaaattctatttgtattaactttagtgaaaattttgaaactgacattaagtaaataaataggcctatattgttgaattttcaaagcctgtttgcgcttgggcagtaaaataaaaataccaaagtta

SEQ ID NO: 49351 - DNA, 8934 bp, Oryza sativa
  unsure (1)..(8934): unsure at all n locations
ttgctgaagaaaccatctttagtcccggttggtaacccttttagtcttgggttttcaaccgggagatgaaattcgggaccccggttaaaataatcgggactaaagatggacctttagtcccggttgataacatgaaccgggactaaaaatgtggtcccggttgttattaccaaccggaactaaagatttgtttttctattcctttcatccggttggtctttttccttttttattgttcttttgctctatgcatatcacccaaatcgtcatggatcggatcgaaggaataaaatcaacaacaaagcccaaatcatagatcgaatgaataaaatcaacaacaaagcatccatattctttacacttattcacatatacaacatcttcagaacaacaagcattcatcacagagaatagagaaaagaaaaaaaagttcacatctacaacatcttcagcattcatcaaagagcacagataagagaagaaaaaaaaatgttcgtccgccagccgccgcctcccgaccggcgtcggccgcccccgacgtagccggccgccgccttcccgaccagcgccagccacccctgacgcagctggctgccgccctctcgcgtccgccgcctgcgctgcccgccgttgctcgcctgtgtcggaggggaggaggaggagagaggggaggagcagagaaatgtggagaagatgagaggtgaggatgagatggagaagataagatgtggagaaaaaactgagaggggaggaggagatgtggagatcgaggactttatcgcgcgggaggacgaggcggtagggcatgtgacgcgagggattttttttcccggttgttgtaatcaaccgggactaaaaatagatctttagtcccaccaacgggactaaaaataacattggtctgacaacgtctgccatttattgaaccgggactaataatgatctttagtcccggttggtgccaaaaacttttaaaccgggatttttagtcttagtttgttagactattgtaaaatttttaatcgggactattgtaaaatttgatcgaccgataaagatggtttctccataagcgaagtttggcttcatggcgcgtgcaaaccacctttagctatgccgtgtatccaaaaggtactaatttgtatagtttcatacgcagaaattgagttttttttttctaaaacagagtagtcgtagccaccggttttctcctttagttacctcgctcattgtctgagattaagcggaccaattaaaggtactggaagttgtactggaattgacaatgtgttgtgaattgacaagacagcctgagattaagcagaccatgccatgtgcaaaatatcaatgtcgggcaaatgataggccattaggaaggtctaaatgcaaaatagtactccctccattccaaaaaacaagggattttaacattttatttgtactatttgaccattcgtattatttaaaaaattttagaattattatttattttatttgtgacttactttattatccaaaatactttaagcataacttttcgttttttatatttgcataaattttttgaataacacgaatagttaaacagtgcaaacaaaatgttaaaatcccttatagtagagggcgaaggcagtattacctccatcataaaatataatatttttttgaatgaaatatatctaactactataaatttgaatgattctttgtctagatttatatagtataatatgttccacctatctaaaaattgttctactttaggataaaaaaagtatggatgttagaatttatggctatggtgagaaaggaaaatttccgaggtgtgtgtgtgcgcgtgttggggcttgggagagggaaatatatatattatatgcacacaaattttccgtgcatactccatatacatcaactagcaaatgttattaaaaattctagaaaaaaatggacacatagttccaataatattacacttacctgtgaaatcttatcttcaaaatcattatattttagcccgtaacaaaaaagacaaaattctgatacatttttatccttaaaactgtcagatttttcattttttgttatggctaaaatataatgattttgaatatgacactttgtaaatatgtgtaatactgttatgagtaaatgttcaatttttgtggaatttttgtgatattttgtagttagtgtgtacgccgtacggtagaccagaagcttgtttgtataggagagagataacatacatgacaattcggacataattattacaacgatggtcgtagattcccggaaagaaaagaacaaacaagtatgacttaatgtttgtcttttccaatcatacatgttttaccgcgtccggaattgtgccagattacaaaagatttatatttaatgaaatgcttggatgagcgacgcgccatggatatgctttggtatatcttgagttcttgggtcagtcgtccctcgctcttcgacgtgcttaggagggcaagttttcatttagagctcgtgtacaattcttctttttttttttttgaagaaaagggttgtggacaattctaggtatagcgataatatagtagtgtaattgcgcagataatattgtagagaaagtgcttttttttccagaatataataatttttaggattgaacatgaatgttaatttaataagtaggtagaatttaatgggagaaaactgttattggttgggaagtaaaggcaagtagaaaatttaatggtggatgattataattgattagcaagaatatattgatggattaaattttaggacaaatttgaagtctagaagttattatattttggaacggagagattacatcctatatgactaagtaggtgaaatagcaaaagaaatcttgccatggatttaagcattaacaaagttcttaacgtaagactccaagaacaaactaataatacttaaagtttgattttgaagaataatttaggtagatttcttttacttttctggctagaatttattaaaaaagatcaggcaacaaaggtgaaaagaaagcacttaagtcaaatttatagtgtgttaaaatctgctctagattaattnttttttaagaattacacagtacaacgcagacactcacccctataaacgcacacacgcaaaccctaccccaaaccctaaccctatgagcatatttaaagacttgggtggcaaatccttgagaaagtcaccacagacgcctcgctgtcgaggggtacgtcccctaccactgaaaagcacgaacccgtttaaatcctggaaaatttgctcccgtgaggagtcgaacccaagacctaaggttctactcaccactaggctagaggccctttcgcaaatctgctctagattatgactcaatgagaaacatagttggttcgtagttctactaatgaaattttgtcttactttttttaaaaaaaatacataaaacttcaaacaaatttaaatgcaaaacaaatagctagttaagtaacttattcgaatgaatatgttaccgtgctcagcctgtccagtcttgatgaacccatcccagccctcccaggccccagccgttgataccttatctatcacgggaggtttgtgaccgcacgagctgtttctctccgtatctatttttctttattttcttttaacctttttgattgttattttcgaagataaactctctcctaaaccgatttccaagtcattcttttagccttaacactactacacaaaagctaatatgtgctggttgggagccggcactaggtgctggttttcccaacggacaccaccgagaccgcactaatcactgaaagtcataaaccggcacatttaaggctgcaggaacgaaaaaaaagccggcttgatgcatcgagcaatttcacttcaagaacatcaagaacatgagatgaacacacaagatgaacacaataacacacatgaacactcctgagtccccctcccgccgggccatcgccttccctcccgccatcgcccaccgctgccatccccgcctcccctcctgccaggtcatcgctcccagccagatctggcagaggggaggcgccgccgctacctctgctgtcgggccgccgtcttccctccaaccatcgcccgccaccgccatccccgcctcccctcttgccaggtcatcgctcccagccagatctggcagaggggaggcgccgccgctacctatgctgtcgggccgccgccttccctccaaccatcgcccgccaccgccgccgcccctgcctcccctcctgttgggctgccgctcccggtcagatctcgtgaaggggaggcaccgcgccgcagccgccaccgcctcccctctcgtcaccgcccgcagccgccacccccacctcccctcctaccgggctgccgctgtcttccctccgacgacgcgagactgtgagagaggcgaggtgagagctgagggaaaagagataaggagagagagagagcgtggtggggatggatggataagaatgggtgggtggtgacttggtggataagaatgagaagcggtgactcggctcacagctcggtttttaaaggtgtcgattttaaaaaaaaaacgatatctttaatttattatactatcagttctttaaaaaaccgacacctataattaatttaaggtgtcggtttttatttaaaaactgacacctgtagtattagtatcgtttttttttttacagaaccgacacctataataaggtgtcggtttttcctgttttgggccatggaggtggggaaatgtattataggtgccggttttagctgttccggcacctatagtggtgatacctgttttgtctttttttagtggtgtaagcttgcatggttacaaataagatattaattatgacatgtataaatatagagtctgatatataagccccttgttccttgtataatgatcagagtcaatataggctagctttgttccttgtgtcgtggttgctaaccaacctttatcacgtactgccagctccttgctcatacttcctccaggtcaggctaaggaccacatcaaataaatactaaaaattacttaaactatctcatttaaaaatattacccggaatttatacatgggtcagtgactaatctagcttaatttgggaataaaaacaaaacaaaggtctatttaatttagattactgagcgaatcattggcatgattatcaattcaactatctaaatctgatttgtatttttctattcgtcacctcactttcggattattttcgttcgttttccgatcgagatttcgtccggattaatttttatccgtctacgtatcgagggttcgtctgatcgctttcatcattcaatcatatccgcttccccgcgctgatacaggcctgcacatgcgtgttactggcccgtgtccgtgtgataaggaaaacggaccgggcccatgtaagattttttctaactgtaaaaaatatcacgtgtcttccctactgttgtacgaagaaaagtgacattaccgtattaattagcataagtgaactaatccaatcgcaatatcgattgtggatcccctcaaatgatccaagtgtggttctaagtacagtatagcaaattacaaattcatccctagatagaatttagtaaaaaaaaacctgaaaatacacatgatattgctaaatgaatacagtgtttatgatattgctaaacagacgcatgatattttacctgtttgattaaaaatctatatctatatctatacctatataataaaaaaaaatatgtaaggtttccggcatattttttcgtccgtctctttttttttcctttttttttttgctattttcacctttttttctttcttttttctgttgtccactttttttttcaccgccttttttctgtccgccttttttttctccgttttccgttattttttttcttttttttgaccacctatacatttgtcgacaaattttcttataaaaatttgacacatgtaattatagtacaatcgtagtgtaattacactgtaacttgtatataattacactgtaacttgcatgtaactacagtgtaacttgtatataagtttcacgtaattttgaatcgttagatctattacaaaatttgttctggtgaggaagaaaaaattcacatcatacacatatgtgaaagaatttgttctcacaacctccattttaccgaaataaatgttatggagatatttttgaaagttacatacatgttatattataagttacagtgtaattacactacgattgtactataattacatctgtcaaatttttggtggaaaatttgtcgacaaatatatagcaaattcgtctttttttgtccgtctcttttttcgccccccccccccttttcttttcttttttccctttttttctttttgtccgttccttttttttttttttttgccaggccgaaccctagcgccgctgccataacgatcacctcccatgcgttctcttctacaattgattgtaaaagttgattacccactactctctcattattttcccatgatttttcctttcaattctgctctaatttaccggatctaatacacatttaaaaatcaccgtatctgagttttatgtattcgctcatattttggtaaaaacggaaagagtagatcgagtgtatcaaaagccctcaaccaactttgggagtatgggctaggtcaaagagaggcaagcaaaacagaggaagataacgggttgggctaagactgaaaaggaaggaataaatgaggttttggccgcaaaacagaggaagataacgggttgggctaagactgaaaaggaaggaataaatgaggttttgggcccaaaaccaaagagtatctctactattataaaaattganaatgtttttgtcggtactttcgtagatcatctgtatttgagtcggtttctaagttcgttcgcttttggaaatatagatccatgtttgagtcttattttaagtctgatcacttttagaaatacagaaagagtcatataataaatctctttaaaaaaaactcgcacgctaactagggatgcttttggaaatacagaaggagtcgtataagaaatactttaaaaaaactcgcatgctaatttaagatgagagttagactcctaatagtagcttataattttctaaaagaaatatccaagcaaatttctacagtaattttcaccctaactgacccgtataccacaccaataataataataataagtctaaaatagccttcacccattgcaacgcacgggtattttttctagttattgaaaagatacatagtgcttccatcgtccgtcgctaatcgatcaaaagtgatatgttgtccaaatatattcaactaataaaagtcgtaatggtttatttcattcatcatcccgatccaacgaccttgattattcggtggtcatgctcatagtttgtatttccgaattgtgacaaaaattacccatatgccacgaacaaaaccccaacacaccctaaagctcgatctaatcgttccctcacatcgcaattctcgttccctcacatcgcaattctctcctactcccttgctccctataattacaagtgtctagtcgagctagcacctgagctggccaggatttgggcggccacccaacctccatcattagaaccaccactgttgaatgactttggtgtaagtggcccatcaccggaaaaacctactctctccgtttcacaatgtaagactttctaacattgctcacatatatatagatattaatgaatataaacacatgcatatgtctagattcattaacatttaaatgaatgtgagcaatgctagaaagtcttacattttgaaacggagggagtattagatggtgactttggaaccgtcacttcctaccatcgcggttctcttcttccatgtctgctcctctcctctcctctcactctttctggttagggtttagcatgttgttttttttccctctactgtctttcaacgacctcaactgtccttccacttcatcttctcacccaactatttataaaccgtactttctctttcttttcttaacttctttaacatgatgagatctctgtgaatggagctaaggtgccaaaacagtcccaacaataaataggggtaaatatgtacaataaatattatcctactagacccttttcccgttgcaacgcacgggcaattcttctagtatataattagatataataaaaataaatttaacaaataacatacaatctaaacaatgatgtagaaacggaatagaataatcttttaaaaaatatatattttaaaaaaaacatggaggaaataatccgttccaatacttcggcgaataagaaaaaaaaaaaagaacagggcaggtcccgctaagaacgtttgataggtactccacgaccgtaggagtgcagagcgcagaagaattcaaacatgtccacatttgacatcttgtctggtgttattggaagatgaaaccatttttaagtggcgagtgttgcttcccggcacggacggtaaaacagacaggttgtatcgtttgttcgtgagctcacaaagcagctagctggcctgctgaacaaagcatgtcgcccactctgagcagcttccgtcttcttctgattcgacttgttttgctggctctcctgataggcagcggcgtccccatgccctcggctcagcaaggcagcgcacgagtccgtgagtatcatctgtatatatttgcaacagatttagctttggcaatcactagagtctagagctacggcgcgcagtactgtttttgttcccccgcccttggattgctgctaatattttctttttgacgcatcgttgcagataatccgcatggtccaccgcagacccatggtactggttttagctacgacattattcgtgctaatggtgca

SEQ ID NO: 49352 - DNA, 2620 bp, Oryza sativa
tatttactgcccggttcgctgactctatctttgatgaggaacatttcccggcattagggggagacttcaagtacccgaaagaatgccaggaaattgattgggatgcctagggtattccagcctcagacccacgtattactaaaattgaactacaagttcagaaaattatacatttgcaaagacttgcaaataacctgccagatgcatttactaattataaaggtgtgactaaatctttcattcctgctcagaatgcgccaaaaagagtggaggtaccaaataaaaccactcaacttctactcactaaaaagagaggaagtatggccactcagcgagaaacaattgctaataagcaaagaaagacggtaaatgcaaaccaacctttagttggtacacaccaaattgatactatatatcaagcagatcatgatagtctgcaacctagctcggtggtgcacaatgctaagactaggaattcggaagaccatagacacattgtttcgggagatcacgatgagtctataagggttgatgaaattgccatcaactactctgaaactggagaatcttttgatagaagagctacaattgtcgacattaatttttctgaacaaattgctgattgcctccaagttgatccagaacctaggtctataaaagagtgccaaaagtgctctgactggaacaaatggaaggacgcaattgacgcagtattagcctcactttacaaaagagatgtattctcggctgtaatgcctactcctcgtggtatctttcctgtgggatacaaatgggttttcgtccgaaaatggaatgaaaacaacgtggtggtgagacataaagcaaggcttgtagcacaaggttttacgcaaaaacctggcgttgatttcaacgaaacttactctccagttatgagtggtataactttccgatattgaatatcactggcagtacaaaatcgtctatttatgcagttgatggacgtagtgactgcatatctttatgggtcacttgattctgatatttacatgaaggttcctgacggcatcgacatcccgaatcagaaggtaaatcgtaacatgtattgtgttaagttgcagaagtgactttatggcttaaaacaatcggtcaggatgtggtacaaccgattaagtgaattcctttcactaaagggatacactaaaaatgatgattgcccgtgcgtcattatcaaaaagaccccacaggattttgtattatctcggtatatgtcgatgatctcaacattattggcaatacacaagatattaatgaagcacgtcatcatttaaagacggaatttgagatgaaggatttgggtcaaaccaaattttgcttaggtctacaacttgagcatttatcttctggaatccttgtgcaccaaggtgcatatacctagaaaatttgtagaaatttaatatggacaagtcatatccttccaaaacccctatggtgaggatgtgcttggaccagattttccatatcttagtgctattggtgcacttatgtaccttgcaaatagtacgaggccagatattgctttctcggtaaatctattggtaagatacagcgctgctcttaccaaacgccattggactggagttaagaatgtctttcgatatcttaatggcacaagagatcttggacttttctttaaaaagaaccaggattcaactttaattgggtatactgatgctggctatctatctgatccccacaacgccagatcacaaacagaattcgtatttttacaaggtggaactactatttcatggaagtcttctaaacagactctagtagccacttccacaaattattctgaaataattgcattatatgaggcatcacgtgaatgtgtatggcttcgcagaatggttaaccacatataacttcttgtggtattggttcattggaatcacctaccattatctatgaaaataatgccgcttgtgttgttcagatggaaactggttatattaagagcaacatcactaagcatattgctcccaaattattttatcctcatgagctttagcaacatggagagataaacatcttgcaaactaagtcatgtgataatcttgctgatttattcacaaaatctctaccatactccgcattctttaaatgtgtcgaaggaattggtatgagacgacttaaaaatttgcaggattcagggggagtatcttcctttggaaaataacctattttcgtcatattatactctttttcctttgtatgagttttaccctttaggttttctcatccaaagtttttaacgaggtaatatcaacataagcttatatgtcttatcatttggcttttcgccactgtgtttttactaaatgataactgtagacactatactattttggatcatactatgagctttactcatagagatctaaaaatagtcaataatatatcatgggtctctccttatttttcccactgggtttttgaggagttttacgtgatgtatttaactataattatttctaagattatctttacagatatctgaacactaaatgagcatgatcaaagctggattcgatcaagggggagtgttctgaaatatttgggtgatctcatccatata

SEQ ID NO: 49353 - DNA, 3072 bp, Oryza sativa
ggatttattgttaagggtatcggaggtgcaaatgggcctaagcctgaacagtacctcagcccagtactttaaacagcgtggcccattgtgctccttagggacttaggcattttttttgctttggcaatttatgcgcacaatagtgttgcccaatgctgataaaatcctttttacgcggtcatataattctttggaattattgcaatgcaaattaaaaggtgcccgacagaaaggtgttatgccgtttttgtaagcttttttaggctacgaaagctgtcagggttaacttagaatgacttgtttttatcatagtcatttccttggtatgttatatgcctgttttcattatggtaaatagtcatagcctaggctattagacttattcattaccataatttttataatatttggtgggtaatctttagagttttttattcggatgcctgtcaagtgagttcattcgtgaaccttttagagtgctaaccactcggattccttttattatggctaaaaagcactcggctagaatgcctctttaggcgccgcgtatgcttttgtcatgctatgcacgattgtgctattattttgttctcaactatatgtttagtttgttaactaatcacatagttgggggctacacctaattaggtgcatctattcgatgcaccgtattctttatcttttcgccctttacagtcttggcatgaaaggtttgaaagcactcggattattatctttgagaaggctacgatggttgactgcaaaggtctcgggggctactgtggagattatggttatcccatatctacacggcaatggtatttgggctgagtacaggataccaaatatagatagaatatcttatttgtgtctcgggtttgtttctcaacttgtacatcaaggaaataccttgagacttagtcggttacgactgtattttatctgtatctgcatattccggtagggatatggattatcttttgtaacacggactccttcccatatataaggggggttcgggtgcctctaggggcatatgttgattttctccaaatcatacaatcaataatacactcggcggattcatcaccggacaggagtagggtattacttcttgaatgggaaggcctgaacctgtataaatcttttgtctccaaacccatacacttttccagcttgaaagccacccccttttattagagccgaaatctagtttcgacacacaggattttgataagaatgcaagtataaaacagaggattacaaaatataggaaaaaacataggaacggttgtttgattggatcgtaggaaaaatgtaggaatgggatgagagagaccgactaaaattttttttcaagaggttagtgctcttgctaagattgtaaatttcagagaaggggattttctcacttcgattcgctgattcagctgcgaagctgcatttggtggtcgtggcttatatctctataatccttccccaccattgaagtttcccatgtaaaaaaaccggttccctagaaaacccaccccacccaaaaagaaaatcagtgttttcacacaaaaaatcaagacaacaaaccggatagaaaagattaaaccgtataattctaattctgttgcaacgtacggacatgacattagttttctgagagcgagaatatacagtatagttggtagcgactaggtagagcacaatagagtcgagggaggtaatggggagaggctttatttctgtgtattcctcttgtgggtaccatgtggcatgtgggtatattaattgatccacagtatggaagttcagaaaaggcagaccaaagtaaaatcgaagggatacgatgagataagtggcaaattaaatgtacatactgctcaattatctgctaaatttataattgcagttaactttgtggtaaaacagagttgagcccttgcaattatatagccaaggagtaattttccgaaataatcaacagaacaaaagtcaaactgttatgaaatatttgggtgatctcatccatatatatggatagagtaacaaccaactcagggacacaacggttggtcgtgccccacacatgttctcgcctcacggcgattctagcaacggtcgcgcctccagttgtcgcctctctccccctgtatattgtaacactgttatcaataaaggatccgctcattcattccctacattcttgtgttaaattctctctcaatctctctcgttcaatcaattctatccacattcaacacgttatcagcactttcgcgatacattcttgtgttaaattctctctctcaatctctctcgttcaatcaattctatccacattcaacacgttattagcactttcgctctcgcgaaggagatcacgaagtgaaagaaggaaacatcgcttttgatttcaagaaaagcgaaagaaacagaagaaactaaggaaatcgcgtaagtacgtctaccttgatttcatcctcgatgccgttctcggcctccatcgccgagaccgcattcatcgccttcgccacctcctccgtcgattcgatggagtcaccaccatcgccatgctgggcgccattctagggttggtggccaccgccaccatccccggcgccgcatttgccgtcgctgccacacctccgactccaccaccacaagcgcccgccacgagtgcaccggtgccccgttgcgtccaggtccaggctccatggatggacagcggtgacgccccccggcgagcagtgctccctcccactggagatagagtcgccgccggcaccgtttcccgttcgccgctcagcctccccgctactttccgcgccgttcatgtggctcctcgagctgcacgctcccgaacggagtgggggggggggggaacagcgtccgaacccgactggtctcttactccgatgaggagagggggccgtcggcttagtctcgccggcggacgacggggacttcggctgctgtggcggtgggggcggcagaaatggaggcaccggcggtggtgtaacagggggagatggtggcggcgaaaatggaatcggcggtagatgagacaggcggcggaggaaa

SEQ ID NO: 49354 - DNA, 3119 bp, Oryza sativa
tacatagaaagactaccaaaaagcctaaaagggcaaagagaaaaagtcacacgaggacgaagggcctcacacctcagggtggtcttggcctccgttgccttcaccctcgtgttcggtggctggctccgacgacccgcggtcctctccggtgttggcagcagcggcttcctcgtccttcgtgatcctttcaagattctcgcaaagctgagtcttcgcgcaatcctggccaccatcctctcataaacccattcggaaggccctcaaggccgccccggagcactgcgagttgtcgggccaatcctctttcacgaggtcagggaaatccccgatatggtcacagccgtgcgcgtgcaggaggctaagaacgaagcccgccgaaacatgtgcacagcagtctccgtaggcactggccacttcgacgaccaagccggccgcttcctgcgtcaactcggagaagtcgaatgccgtcccgtcgtcactcggagcgccttccccgtgcgcgccgaggttgttgagagctagcctgagggtgtagccggcttgtttggcggactccgtcaccggcgcctgagttgcagtagcagcttcggccgagacaagacgagcctcaagggacttgatcttctcttcggccatagaagttgacgatctcgttcagcgtcccgcttgttcgccgcctccaggtcggcatggagagacttgttttcgcccgtgagagacttattctctgcattcgacttttttaagttgtccgcacgacgtgtctttcgtcctccttgtggcgaagatcctcctcgattttcagcggtcgaagccggtacccatccagcctctccaaggcggactttttcgcacttaagtgcgccgcaaggccctagataagagaaaccaaatctgttatgatgtggcagaaatgaaaagaggagaaattttgcaggcgaaagataaagttcacacccgcacgaacaagctctccgcggccgcgcaactctcgccgaactcatttagttcggtgaaaagcccaagaccgtcggatggtgcaatgacttggcacaccccatccacgaatggggtgatctccggccgcgtagcgaaatccgcgggaacaaagtgcggggcggtgagcatcacgtccgacacagacatcacgaacgggggggccttcccatcccgctgatgagtcggcgaagggaccgcctcaacccgttcgcccctcgagatgttcgccccaatcgccggtgccgaagcacttcctcccgtcggcgcttcagcgtcactggcaggaggtggcgaaaagcgtcccccccccggggagcgtaccgctgggctggcaaagtgggtgtcccatcagacccctcgctaactgaaaagccgggagcgacctgcaccaccccacccttcttcttcttcttccgggcgatcgaccctggcttcgccgtagagctagaaatcgccaggagggtcttcgcgccaacaacgttttgtggatgaatggacgaaacatgggaacccgccccagacttcggttgtgctggactgggcgtatagccatgcgacccgtcgtcctcttcggactcggcctccctatcgtcgtcttcctcctcgtcggcatcaacttcagccgcgtcctatgcagcacggcgggttcgcacttggccgcccttcgcaacggctcaattgcgcttcttcgacgttccaacgtcgtcatcgcccccgtggaggggatagaccgatcgggcaattcgccggcatgaactcggttcacccggccgtcaagctggcgtgaaagcaggtgggcgaattcagccgtagttaggccccaaaccatcttcgacgcctccgcttcagcgtcctccaacatgcgaactaaaagcaccaaaaagagggcgaatcagaccaaaaggcaactcagaaaagggggagagaagtggaaacgaaactcacgttcggtcccggcggggagaacaaggcgaggaagcccaagcacttattcgccttcgttgatagaaaccccccagtcgcgagcaagggaggaaattcgaagaaggcagaattcctcacaaagatcgcgggtacttaactgccgcacaactttgcgaaggaggatgagccgggactcaagggtaccgtcgatctccacgttcggcttcgcgacgatggaaactgcaagacgccggaaacgaagccagttcgccttaatgtcctcggcggggtagggattgttgatgtagaaccatttctgcatccagtttcgttcccatttcgccatagacgcaagtaccggccaggcatccgagcgttccggccgaagcatgaagttgacgcagctgaaaaccgtttttcttggcccgaccggcgtattcacatctttagttgtagcgcacgccgtgaacaagatggcgaacagctcggcggtaggttcgaaactgcatgttcggcacatccatgcaaagacgaccaatttggggaaggcggacgggctaagctggggaagcctaaccttgtacatcgccagcatcgatgccaagaaatcgtcgcaaggaacgtgaagtccagcggcaaggaaggcgacgaaaacgaccgttcacctgttgccaggcgaggggacaacggcttcacccccacaatccgcctggccctcggctagaatgccagaggagatgaaatcggccaagtcggcctccttgacaagggacttgccaagaaagcacgaccaccctacgccaaggttaccggggtcttcgccggtcgatccggccttggtgggcttacgatgggccatcgggtctatgccaaaagcaaagtggaaaaggcgaagtgaaccaaggaagtcgaaagagcaagcacgaagtcgcactggtgtgttaacaaccaaatttggtaagtatttgtatcaggaaaagggacttaatcggagaagagttggagacgaagatcgagttctggaacagagcaaggatcggctagagtctggatcagctacggctaggatcggctaaggttgagctaggctaagtaggctggtatagccgattctgataatacgacttgtgcgcgacgtcgggctcagtctgatgtgcttcaagatgattgccatgtctggatagagtcctgagaag

SEQ ID NO: 49355 - DNA, 1615 bp, Oryza sativa
gaagtttcccatgttaaaaaaccggttccctaggaaacccactccacccaaaaggaaaatcagtgttttcacacaaaaaatcaagacaacaaaccggatagaaaagattaaaccgtataattctaattctgttgcaacgtacggacatgacattagttttctgagagcgagaatatacagtatagttggtagcgactaggtcgagcacaatagagtcgagggaggtaatggggagaggctttattcctgtgtattcctcttatgggtaccatgtggcatgtgggtatattaattgatccacaatatggaagttcagaaaaggcagaccaaagtaaaatcaaagggatacgatgagataagtggcaaattaaatgtacatactgctcaattatctgctaaatttataattgcagttaactttgtggtaaaacagagttgagcccttgcaattatatagccaaggagtaattttccgaaataatcaacagaacaaaagtcaaatcacgcattagaatttcaactgagggagtaggagtataatacagagcagaacaggtaacaacacgatctacgcgtttaattagttcccgatgacagtgcctgcctcaccgtgatagataaaacgggtatgatggatctgcggtggaccatgcggattatctgcaacgatggtgtcaaaaagaaaatattagcagcaatccaagggcggggaaacaaaaacactgcgggcagtagctctagactctattggctggcaaagctaaatctgttgaaaatcgttttgctaatatataaagatgatactcacggactcctgggctgccttgctgagccgagagcatggggaggccgctgcctatcagaagagccaccaaaacaagtcgaatcagaagaagacggaagctgctcagagtgggcgacatgcttgttcagcaggcagctggcctgctttgtgatcgagctcacgaacaaacgatacaacctgtctgttttaccgtgcgtgccgggaagccactgatgtcaaataacgccagacaagaagagtcaagatgtgcgaggatttttcaactggttgaactcttcagcgctttgctctcctatggaatagcagtacttatcaaacgtggaatggctcttttactcccgatttgcaaccttttagccccgggtgcaaaccgggacacccaatccgggactaaagattatcgtcaccctcaaatccccacaaatcatccacaattgcccatccaaaaaatcatccgcaatccacaagtaattcacaaaattatccccaaatctaaaataatctacaacaaaatttacaaatcattccaaaaataaaaaaaattcacaaaacacgccgctgccgtccgcccggccgtgcgccgcctcccggacgcctccgccgccctgcctcccctcccgccatttccagcggaggagaggccgccagccgtccgctgcctcccatctcgccatctctgccgcttcggtggccgcggccctgccaccgctggaggggaggccgccgcccgcctgccgccaggccgccgctcgctgtcgccgtcgccgttagtgaaggggggagggggagttgaggtgaaggggaagggga

SEQ ID NO: 49356 - DNA, 6508 bp, Oryza sativa
ctgcagctagctggtgactgatcacgacagccaaatgcaaattgagaataaagcgaaaattaacgcattatcactttaatgatttcagggtggcacgcattagagggtactcaataaaaacatatttttctaaaacaaatgaataacatatgtgcgatattttatcacatatagcaagaaaaaaaaattatggcattataaccatgaaaagctatggaaaaagaaaacaccaccactacaatccgactagctgtcactaagcattatcgaccaccgctagactaacaaaagagctatagctataccgctcaacaacttcctacaaaccgtttaacgcctagctagcacctataaaatgtgaactcaaactgtgtagcaaaactagaaagttcgcgtctataggtcattaattattctgcatctcaaacttgcacaatcaaacctttcatatattcacattccgtttcctctaaagcatgattctaccaaattaactttttgcctctccggtcatatatatcccaacagctgatggaactgaacacccagataaagaaagaactgacgcgtaaaaaatgcgacgagatcgaagaaatgaattaactaaaacgaagtcgtcgcgtctcttaagatcccggaggatacaatcgatcgccactaagctagtagcaaagaggatccctccagaataacctcgtcgatttccacggtcccctttgcattatttatcctcttccaattcgcagcctgatggaaactaccatggccacacaaaacagcccccatggatatgcagaattagctgggttgatgatgattcagctagctaggagggccatgaatgacatgcaaagtgtacatgtcgctcagaggagatgaggtttccatccaaaggccgggtgcacgcatcgaccaaccaaatgagtcccaagcatgcgtgccggccagggtagtccatgtcaacatgaagcactgaaatgtgcagaccaaatagtaaagccactaagttactatataaaaaaataattcaacccctcttatcacggtcaattctttacctatcactactattttatgaaaaccatttttgcacacggcaaaactaaaataatttttccgcagacggctggacacatggcttcatgtgaaaatgaagctttattttcacatacgggcacttagtcttatatcgccagatatgacgggtagatacggtgtgacggtaggcaacaagcgtggaaggaagacactcaggataagcgctccctacccctgccctcccaccaatccatggctggcccctttcgtctccctctctattcacaactagagtcaccactcaccccctcacctagcagctcggatcacagctacagagttataccgacccaacggctgtcagatttataccacccagggttttcaatatcgaaattgctttttctgcgcggggggggggggcgaaatttcccagaaattttgaattggcctaaattgtttgaaattttgtatgaatttaaataaaatttgaccaaattcacaaaaaaaaatataaaagagatatgagcttgccggtgggggaggggtgcaaatatcggaaatttcaaaacaaaatttgaaacgttgataccaccctaccactgcttcaccggatccaccatggcttcactctgttcttgacctagagggaggagagggagggagatgaagagggagtgggaagtttggatgagggagaaaggagagaggaaggaggataggcgatgttgttagggccctagggtgcatacatttgacgtcaaattattcatatcaagatcacctgatgttttcataggtgatctgcttagacaccagtcctaggagtacccatttttagaggtggtcatctaagtgggctacctacgaaaattgacccaagcggccgcctctgggcatcaatttttagaagtggtccataaccttacacctccttcactatttgtaccaacatgttcctatttaactgcttttatagggaaatggggtgttgtggaaaattattgtacagagggtagcgatagaggagtttagggataaaaaggaaatcgtgatgcgacagtgatcaagtattgttcgttacactgttcatgctatcactgttgtttcttattataaactgcatgataatagtagaatatctaatattttgatattcataattttatacaatgggttgtatatatggagctaaacttctatgaaagttaaaagttaatgtctcaacaacatatatctattactacttggtgttgtcacatatatttgttaaataacacttgatatagttgatacttcttcttttgagaccatatattataagtattcatcaaaagattaaaaaaatggaccaaaggaagaaacatttatactccaatggtattactaataaatagatgagaaggtacttgggtgtttgtggtgtaattcgtcttctatttagtttatcttgctattgttaggtgatattgtgttggtaacaaaaagcgttaacaatgagcttcacgtacatggaggacaaatcctgatgtttgaatcatgtctactgcacacatccctattttgcatgatgttagttaatcataaccaataaatatagagtactctatggtagcgatacgtacgtacgtacggtgcagatagcaaacaaagtcgtcgtgttcaatcaattgtgcatcaacattaacaagctagtcgtcgtacacgtactcgtactggctagactagtgcaggttacaaccctgatacgtacgtaaaattaaccgcttaattatatactgccctaccctcatcggcacaccgcacaaataatggagaaacggtaatactgcaaattgtgcgtcacactcttgatcgtgctatcagttcgtcagttacgcccgatatatgagtgcagggcccaatcacttatcttcaagcgcaaaggaaatggaagagagaaaaacacgtgatcatttggaaaagtgtaagacaaccccccatgcattaagtcaacaaggatatatatatactttatttttcgcaactaattaacaaggatatgcatgcatgcgtgatcatgtcaacagcgggaaattactcctcacttaagtataactagctgggttgcccgcgcaattgcgcggctagcataaaaaaatcatatatttttttaagtataattttacttaaaatttattaaatagctatctcattgttaagactttgaaagatcaaaccttatcatccttgtgtttctaattatatagttttaaaaatcacaccaattgctaccccttatgtcatcttctttatttgcttactcgatctatcactgtttctattcattcatcttggaacctttaaaaattggattttatagtttttagagttaattgtcacgttgggtttcgtttttataatttctagatgtcccgtcaaacgttgccattatactcctctacagcccgtccactatctcttctcttttattgtcattgagattttaaaaatcgaacataattatagtttgggtttatttttactttccagaagtcccgccaaaccatcagcggttttgccattgtattcctctacggctcgctcgctgcctcccttttttattgtcattgagatttaaaatagaacatgattatcattggttttttttttacttttagaagttctgaatctttaaaaattggacttgtagttttattttttataatttttagaagtctcatcaaacgatgccactatgcccctctgcagcccgtccgctgcctactctttattgtcattgtgattctaaaaatcgaacataactatcgttgcaattcattttttattttctagaagtcccgtcaaccgtcggaggctctgcaactatactcttatacaccccgctcgctgcttctccttttattgtcattgagattttaaaaatcgaaaatgattatcaatgtggttttttttctttatactttctagaagtcccggcaaccgctttacttgtttactttacggcctgcctgatatccctccttttaatcgtcattaggattctatttgttgttttattaacaatttttatatgctgtattaactgccaccaactctactactttataggtatgttacttaatttatctcgtcatgtgttttagatggtcttttctttcaatagtctttatttttatcataaattttagttatttataaattttattcctaattgaaatccttttttctaatttcagaatttatttttttctaaaaaaattagttaataccatattgtgttcttttaatgtttttattttttattctgaatttcagttgtttcaaaattgtattcctacttgaactctgttttagtttttctaattttggatattattatatttttattctaaattttaattaatctcgtattggattcttatatggattcttctttcaatattgctatttctaattccgaatttaagctaattttaaatcgatttcctacttgaacacttctttattttctttcgctaatctcagatttatttttatttttattccgaattttaattaatctcgtaataggttcttatatgggatcttctttcaatattgcttatttttaattccgaatttcagctatttttagattgtatttctacttggactctcgtttccttttctaatttggattttattttatttttatttcaatttttgattaatctcgcattgggttcttatatggaaacttcttccaatatttcttatttttaattccgaatttcagctatttttaaattgtatttcaacttggactctcctttccttttctaattttggattttattttatttttatttctaattttgattaatctcgtattaggttcttatatgggaacttctttcaatattgcttatttttaattccgaatttcagctatttttagattgtatttctacttggactctccttttcttttttttttctttttctccgattaatgtgggaatttctagcccccacagcgaacgtggtgactcatttcaaagctgttttaataatataatagattagctcatatgcatgttaatattattctgatcttaaaccaaagggaaagaagaggagagagatagatgagctcatttggttgttccattttaccattaatatagattctccatgatgatccacaggatctaacatttcaggcatttgtaaaaatgatttagacagtaatgatcagataacactctccaatgattcatcttaatctagtcttttttccgcacaaaggggggaaagattaatagcattcgagttttacattaaaaatgattgaattaatttccatcaaacattttttacgcttccatcgtagtgacaatttttaatccgttttattagacagtaacaatataacttcaaaagtgtgagtggccttataaggttgcgttctatgttgttgtttggcttacctactccaagcacgagaaacgttacagattattaattaagtattaaccgttacaaacttaaaaaataaatttatttagtttttctaaataactttaatatagaattttttttttaaaaaaagaaaaacgtaccatttagctgttcgataaatatactcatgataaataaggcagtggccccttttagccacgtaaaagagcgcaacttaagatagatccttcacgcataacctcatctaattaaatggtaattgtggaaagataaaacaatataagcccttaggacaagtagaatagtttagccttctacacagagatagtatcctcttctatagttgagacaataaatgctctttccactaatgctatatccttatctagcaaagttttctcttttcttgctttaagattaacaccgatttctctctcttatccacattagtagatagatataggttgcaatttggcgagccagctgtcaattgttgctatacactcagcaaattagtttagttggcagtttcataagctatctaatagttgttgttgtacaacccataggagatagggtcttattgtttaccatataaagaataagccattgttagaatataaaatttgaaacttaattatctttttttcagattgacttttaagtcacaaaagaaacacctataaaagttttactcccaaattttttccgctaataagcccttacagcttataatcaactcttggtcaaccgatcgatgggaggtaacaaataacaacagaacttctaatgaatttctctcaaatccaaaacgaaaaacaaacaagaaacactaaacctctcttttctcatcctaatttcccctctctgtttttttctcttcttttcattcacaagaggaggaaggggaagggcatcttgagatcgacgtgcctgcttgcatctcccttgtggatgcggtcacgttcatgtcgatcaccccctgtgtgctggggtttgagtgtga

SEQ ID NO: 49357 - DNA, 2543 bp, Oryza sativa
gggagtaggtgcaggagagaaaatgggagggtaggaggaggagaagaggaggggataaggacaaggcagcgcccgtgactcggggtagggattttcacgattttttttattttgatcccggttggtataaataaccaggattaaagatgcatcgttagtcccggttggtaaaatagggtctaacatgtttttaactggaactacaaatgatatttagttccggttggtaacgataaaaaaagtacccgtgggttttcaaaccgggactaaagatatttttagtcacggttcttactcaaaccaggactaatgtgatttttgcgtgacccagcaaatttcatttatccagtagtatacttagcggggcatgccctatttttttaccttatttaccggattattgaatcaattacttacaccactaaaaataagttctttgttattttttttacgaattagaaagaaagcccgcgcagatgcgcgggcaacttatttataaaagattgttaaaaaatcatgcttcaccttataattagaaccacttatttattatttacaaaaatgatgctaaagaaatcctatctcaccatattaattaattataaggacagtatatcagcttataattaataaaaaaataaatatctagaccataaatttttatataccaaatgacaatagtatctttcatattcaaacagaaataacgttgttccggatatatgtaaacttgcttgtcaccattatttattatcgttgtattatcagttatgatggaattacatccatacaagaaaacaaacttaatatgtcagtaatacaagaaaagatcatctctacttaatactaaattgttcatgtctcacttgtttttaaatatatgtataaatattttgaagtattgctcctaccaattcatgggataaaaccattaaaattatatataaatgcccctctaatagttgaagccgagtgtagccacctaggctttcttctcttatgccttgaaatatgtgtccttaatctacatagttgtgctcctcaaaatcagcgtgcagcacaattttaacgcctaattcattatcagctaaagaatagcatcagaaagaaggttagttgaactttatttgcaaatagtagcctctcactacggtcacctttacttagtcatatgcatgccccctcccccccccccaaattcgtacagtagcagagcatactatgttatccatgcttggcgcccttcgtggaatgataattagataagatggaagtgataatttttttaaagttttgaatccatttatggaatagagttgacacttgtctatggcgttaattggtccattaaattttagcagtacaaatataattttctccctgaaaataagtagagttgatctcgagaagtaattattcacgaacatatgaggtaactaggtgaaaccccacacattgctgtgggagttcagtatgataacaataaataaaaataatatgtaagatagctgaacaatataaacttacataagcactaaaatcaattgacgtgatatggctcaaatagagaagagagagataacattaactaagtgaggatgaacttatgtatgtacataagatattataaaacataatgaagatatatattgaaatattatgtgaattatgtgggataataatttaacatgctttcattttaaaagctctaaaatgtaagaaattttaaattatagataatataacaagtttgcataatattaaatgtattgattgctagtggatgatgatgtgtcaacttgttagtggataatgatgtggcatctttgcatgctaagctttaaaagttagtgggttataactttatagtaactagatgataccccgtgtgttgccgcgggatattatataccgatatgtgtttgaaagaaagatccatgcaaaaattccagataacataacaacagcatgcagcatagatgtacccactttcgaagcgatgggttcaggtccttacagagataggagcttattcaagcatgatgattatatcaaccaaaagctcaggatacaacttatataaaccaaaagttaggttctaaatatataaatggagcaatgggaagaacaaagctggaaaatacttcgatacagttaataggcctatgatgaaacgaagctagcttattgcccagtcaccaatccgtaatttatagatgtatccagataatcggcacatctaaaagcaacaaacatgagtaacctaagatacatacaaattagggggaaaaagttccgcctattgactggcctaatgctaattcccatatgaaaaaatgggattcatgaattattgactgatttgtccataaaataaaattaggggactgattatgaagtttcctcagtacataagaaggaaaataaacatgataaatgaattcatcatattaactttgggttaacaaataataacttaattgtgacggttatcagaggaagatgtatagacagaaaatgggaacctgctgggctggctttct

SEQ ID NO: 49358 - DNA, 3943 bp, Oryza sativa
  unsure (1)..(3943): unsure at all n locations
atcaattatatagtattataggatataggattggataggatatgagttttgatatttttgtttttttattattgatctaattcatctatgcatgttcgggggggtaatatatgatggaacaatatatgttatcaagtttattttatttgtgccgattgttaagactatttattaacaagggttaattggatccatgccattacaaatttgcctattcagaaaaatgtcattacaattcgtctatttgtagccatgccactaaaattttataaaattagaaccgggccgttgccgtcacgtttccatccttctttttccatctacttccttctctcttccatcttctctctgcatcttatatcttctctctccatctctctgtcgtcatgcctccagcgcacctcgccgtggaggacgagaaccacgtagccatcggtggaacggtggcagcagcaagaggtacggcgacgacggaggcgtcaagcgggccatctcccgtagtgaggcaagctcggaggaggagagagagcttactagcgacccaaccatgctggcggcgtcgcaatgcagcttcgcactctcctctccctcctcttcccgatccccaaatcccctgtctcctcctcctccccctcctccaccgccgcatggatccaaccgctggcctcaggggcgacctcctccacagcggcgaccatcctcctccgccaccgcgctcctccctttggcctgcctcccgcacccttggcctacccggcggtgatggctatgttctttttccatggacggngccatcgtcgccaccgtccttcgccaccttgacaccgataccaagctctgggctgcctcctgcgtcggtgaggatcgaaggcgacggcaccatgtgcggcggtgaggagggaatgaaggaagaagactgaaaatgcaggggatggatggaaaacgtgatggcagtggcacggttttaattttggaaaatttcaatggcacgattaagaatagacgaattgtaatgacatttttcggaataggcaaatttgcaatggtatggatccaattaacccttgaaatattttggattttattgatcttaagttatcagtttaattctaaattaaattaccatttaactcgccatgcttagttaaatttctagctataaaatagggtgtagagagaaaaggaggacacatatatgggctgcacgtacatatataaccttctttgtacatggtacgtgactacgtacaaagggaagagatgttacgtgtgggaggagggaggtggaggtggaaagattttttagataaatctgttggcttgaaataatgggaccaactattttaatgaaaacggatggacagatgttttggtttttttttagaatttcttaggaatttttgttatttattagaatgcgatgtagcgagttaggaacgttggtaggatgccacctggcggtttgagaacgttcgtagaaagtttaattgacttttagtatataatagatatttaatttatcactagaaaatctataactataatccactcaacaatttaaatcagactgggccttggtttgttttgtttttattcccagactaatctaccctagtcactgacccgtatataaattttgggtacatttttaaatgagatagcttaagtaattttagtattttttgatgtggttcccatctctcacggcctggcctggagaaagcacgagcaaggtgctcgatataaggttggccggtcactgcgacgacaaggaacaaagctaacccaaattaaaacaaaacgcaactttacttgattcaaaatgataacatacagtatggtagaaactaggtagaactcaagagagtcgagttaagaaatggaatggggagaggcttattcctgtgtactcctcttgtgggtaagttaattcacaactagataattaatttagttaatggttaaatatataatggtgtaaactttatttttaaatattaagtattacatagctaatttagttacgtatatttggaatgagctatatgacgatataatctacatgaatgtatacataattacctatcacatgatcacagtgtatttatattttgcattaactttcctcacctttacaaagtagttagccagaaataagacacactactatatacttatttgtatttgagtattcctgagaggagggaagcagaagaaacggatgtcttgttcggtcttgtacgtacgctcatgtacgtacctacgcggaaggaggagaggtgagaccgtagttgttttgtgcggtccgtttgaagattaatctaaattaacggtttataatattagacctatcaatttaaataaaaatcattggacggatgttttacttttcttctcataatttctattattcccttaatttatcagagcaccacgtgacggtctgagagcgtttaatttgaaaaagtttaattgacttttagtatacaactagaaaaatgcattgcaacgggtaaagtcttaggatttcaatcacatgagaaaatcatcatgagctgcgattaggagttgattaggagtttgatcatctcactttaatatgtaagtgtttttttaagagatttctcacatgactccttatgtatttctaaaagctaatgaaattacaaaccaactcgatgacgtacaaaagtatcggcaaaaacatatttaatttttataatactagagaagacatttttcatccgattgagaatacggatcgccagtagatgattttttccagtccgatccaggttttatatgtgtttaactcgattgatggacgaaaattaaggtgagtataaaatcatctttaatttttataataggtataaagataataatatatctacaactaatataaatattagtatttttccggtcgtcacaccggtttttcgtccctctcctctctaacctcacgcgctcctcctctccaaatcccgcatccaatccaacctaaaaacaaaatctcaatctcaattcaaatacagatcggaatcatcacaaattccaagagaaaacactactacaagaagaacatcacaagatcatatttcatcaacaacaacgacaacacaggaacatcacaagcacaaaaacgccgacgccggaaggggagggtgccgccgtcgccgccgtcgacgcagggacgccgggccgccgccgtccccacgccgtgcgggcagctggctctcccgcctccgncagattcgggccgcctgccccttctgcnccccgcgncgttagatccngcagcggcgaggtccggccggccgtccccacgccatccgggctgcgggtgcaaacaaaaacaaaatctcaatccaaattcaaatacaaatacaaatcggaatcaatagataatgagaggagatggagaggaggagcggcgcccccggtggggaggggcgtggagaggcaacgccggtgagggaggggcgcggaggcggcgctggttgggaaggggcgcggagacgacgccggtgggggatgggcgcgggaaggcggcggcggcggggatgggcgcagagaggtagcggtgggggaggagcgcgggaaggcagcggaggtgaagaggggcgcgggaaggcggcggtgggggaggggcgcggagaggcggcggtgggggaggggcgcggggaagacggcggaggtggggaaggtgcgcggttgccggtggggagagagtggcctgcggtaggaggaggaaggggaaaaaggaagggttagggattagggttcggtccggagttttaatggattaggagccgatctgagcagtccatctaaacgaagaattttttttatttataattttttttattaaaagttttacaaaaataattttccattttgaaaattgacggaaatagtcgcctaccgccctctgggagggcga

SEQ ID NO: 49359 - DNA, 1876 bp, Oryza sativa
ggagggcgatttttgccccccctataaaacccagtccctcctctgtgaaatttcattatattcactaaaaatccaaaaaaaacaaaagagagagaggggagggcagcaaaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtacttttagaaatttagaggacaatattgtagagaatgtaacttagggcgtagtacagaaatgcgaggttaacgcagttaatgttttcatcaggcacaatgtcaagtaaggtcacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatataatttacctctcttcacaggttgactcgacggggacagctagcaggcgcactttgggctctacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatttcatttatcttgcataatataggacaactactgaattttttatttccatcttgcataggctgatgccgcacgggatatcagtgccgatatcaccgcagtccaggtgaggttgaacagaggtttgcacttgactgacgttgagcagagggcgaccttcgaccggatgcaggagaagatgcgtgcggtcatgcgcgtcttctcctgtcgcagcgccgtggacgtcgtacctccagctggtccggtacacccacggcctcgcgcgcctaccgtcggagcaggacctcgtttgccttcgagcgcccctagcttcggagcagtgcgacctacagcaccggtttcgcacggtacaattcagcccagatattagttcatttttgtttcagcttttgcacgaatgtgtcaccatgttttaactgcacgtttcctcatcgcaggacctcgtctgccttcgagcgcgttcgcaggcacgaccggcacttccgcgagctccgcaggggcgttcgccacctcttcgggcgcgttcgccagctcttcctctcacggagcgtcgatccctcgcccacacggtactttactttttattactactgttaaatacttgtacaaaactgatggtccttgtccagcaggatatgcagccgggatcttcggtactggggcctcttcgtctcacgccggtaggactggtcctactagccagttctatgacgacgacttgcacggtgcagaccaccaggacgtactaggctcctctcagcttggaggagctccagaggcgcacactcaggagcagccagaggtcacaccagtacaggcaggtcgggttggccgtgccgtacccccggaccgactcacgtactcccaggggcacattagggcgcagggtaggagggacaggggtaagaggcctcgtcagtagtgtt

SEQ ID NO: 49360 - DNA, 894 bp, Oryza sativa
aataatggtcgagcaataagcttaattcttttgatcaacgattcagccaaaccattttgtgtgtggacatatggaacagagtgctggacctgaattcccaatgccatacaataatcatcgaaagcatgagatgtaaattcggcagcgttgtccatacggattgattgaatcctatgttcagggtaatttgccttcaaccttataatttgagacattagtttggcaaagacatggtttcgtgtcgatagaagacacacatgagaccatctagtagatgcatcaatcaaaaccataaagtacctgaacggtccagatcttggcacaataaggccacagatatctccttgaacgcgttcaagaaatttaagtggttcggctctaattttgagataagatggtctcaaaatcagtttctcagtagcacatgcagtgcatacgtaatcagaggatttgggaaatttatcagtgatcaaatgatgaccaatagagttgccaataatttttctcatcatcccgatactggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttggttggttaagagaagaaattcttctcgattatccatatgggtttcaatgtgaaacccattttgacggatatctctataacttagtagggtacgggttgaatcaggatacaataaagcatcctcgattgtattttgtgtacccattgggagtgtaataattgctcgtcctgagccaactatcacagtatcgcacccagcgatagtcaaaactttgcct

SEQ ID NO: 49361 - DNA, 2938 bp, Oryza sativa
cgtgcgtgcgtgcgtgcgcgcgccccgcgtcaattcgcgttgccctactcctgcctcctcggcgtaacgaaacctgcggctgctagctagcgcgccgctggggcggtgcaagtggatcaagtggggagtttatttggtttcgggatttgcctgcagggtttctttcattctttggctgtgcctgtgcttagcttgcttttgctattccctcccggagaatattaatcatcgttttggtggtactcgtatttttttttcttcttacccacttgtttgacttgtgagcacctgagttattcgcgcgtaaaattttataggccggggaagcaagctattcagtccagccataattctggaaagattatcgtgtttccaaataaaatagtcattattcatagtctcaatttatctaagacttaaacgaatagataacttagatgattgtctgaaacacaaacgatcattttaatattcattagttacacttacatgcacatatatacagtggcgaagccaccgtaggggccagggagggccaacacccccctaacccctatgtgacctcccctcccatctcttctcccaaggataattagcccttataatctagccattaattacatcattagttgcagatgagactaactatataggataactgcctagctatatatgacttatgaaatgacttagttaactgatttatcattttaaaaatgattacaagactccaattaaaatcatggaacaaactgtttaaattggcaaattatgatctatgggttctcattctctcttctagctaatcgctataacatgtatgatgtcgagttagtgatcatacatttcaaaaaaaaacacggtacaatatcactgttcaccgaaccttaagtaagttaccacgtctcgtaaatggcaccccccatctctaaattctgggttcgccactgcatatatatatatatatatatatatatatatatatatatatatatatatatatatatatatatatatatatatatatatatatatatatctcttttggtattcgttacatacagaatgagttatttttttctgatactgatgataaaagtaataagtttaacacttttttgatagagagtatagtataggtacgccaccaaacaagttgcaatatggtgtggaaatcggaaacgaatggataggatagaccgtaggagcatttgttgttttccttcgtttccctttcggagtgttgcacattgcgccacgtggatcctgatagaatagccactgaatacacaaatacacaatggtactcaataatgttactcctatgtacgcaccgatcgtaccaagtacaggagcaccaccaccacttgtaaacatcttttctgcacacccgatttgatgggctaattaagatatgacaagtacagtagtactgctagttggctgtccgttctactaagttaggccatgtttagttcacaccaaactttttccaaactctcaactttctatcacatcacatcacatccaaaactttcctactcacgtaaactcccaactttttttttcaaactaccagtttttcctaaacttctctccaatttaagaaactaaacacagtctccagactgatctctagactgatagtacttatcaatttgtggataatggtgagatcaaatattaaaatctttaactatgaataattttttaaatatttatcttagaaaattggagactagatatatagattagtcttaccactactttaataaaatcatatatttgttgatgctttttatatattataatagaaaataatgatcaaagttactttttatgatcatgtttttatctaaaacgataagtattactccctctaattttttttgtttgacgttggttagcttaaaattgaactaaccaacgtcgtacatttgtgcaaggaggtagtattaatctgcagggagtacttccaagtcgcttgctgaccttggtgatctcacctgagcgccacaaaaacgatcgccgtacgtttgacttaccagcttcaaaaagctgcctcgagtttttttagcccaactgtatttacgtttgccggtcagcgctgacaaaagttactacgaacccatcgacgggcccctgtcggtctcgtcctcctcctccgctttaaccggctcacggaccacggcgaaggccaaagcgacgtcgcgcacgggcgcgcggccgcggcggcacatgcagcacgccgaccacttgcctccccccacgaaacttttctcgctgtcacctgatatctctttccccccaaccaaaccactagacattggcgtcacagttctgatcgggttggtatgctctgttgcaacatggcagtgcaaatttgcaacggaaaattgcagcagaaaattgatgctagtagtgtacgtagttgcatgtatttgggcctggacagtacatgggcctggaagcttttctcgtctgcagattttaagattttatatgggcctgcatatgattctctctcttttttttttttttgaacttttgttgatgtcaagcatggcgcgaatgtgttgtaggggctggtggtcctgactatccaggctaggaccccgtcgctgatgccgccggtgtgcgccaaggtttccggcgcggcgtgctatccagtgaccgcgccgaagaaggcaatgctgttcgcggggctgtacgttacggcgctgtacatcagcggcatgaatggctacctcccgtcgcacggcgccgagcagttcgacaagcacgcgccgcgtgggcggaaggggcgctccaccttctataactacttcgcttctgcctctccgtcggcgcgctcatcgccgtcacgttcgccgtctgggtggaggacaacaaggggtggcagtgggggttcggcatctccaccatcgccatcctgctc

SEQ ID NO: 49362 - DNA, 2334 bp, Oryza sativa
atgctcgacgcggcggcgccgctgcccatcaccttcttctggatcgcgttccagtacctgttcctggggtccgccgacctgttcacgctggcggggctgctcgagttcttcttcagcgaggcgccggcgaggatgcggtcgctggcgacgtcgctgtcgtgggcgtcgctggcgctggggtactacctgagctcggtgctggtgacggtggtgaacagcgcgacggggcgcggcgggcggcgggcgtggctgcagggggagaacctgaaccactaccacctggagaggttctactgggtgatgtgtgtgctcagcacgctcaactacctcttcttcttgttctgggccatccggtacaagtacagaaacgccggggtcatcaagggatgatgatcaatctgtaatgcagggttaactgtttaattatctggcaaggtaaaaaaaggagggaggttaatttggtggtcttgaggatgctcattgctgtgtggaattggttggctggctgtggccgatgaatgaaaagaagcagcgattaagcaagttgttcataaatagatcggtgttcaatgaaggaaaagaaaaatagtgaagataatgcatactaagttcagtttatctttcactgttttatattgttacgacccattaatagttgctaacattaaactgaccttggtctatacacgatcacctagtgatcgagctgatgtgaactagcatggtggcctacgcatattacgcggctagcatgattatatttttctctcatataatagcatatatattttctcaattttatcattaaaatatattaaaatgataacataattttaattttataccaacttaaccaaactaccaatgtgtaatatttatattgtatggtatatatgtgatagttattaattatttatcaaattttagatatttctaaattgtattattatatggactttagatctgtctttcaatattccttatttttttaggaaaaatttgctacagaaaacgcaaaaatcgtgtaattaattagctaagggacaccgcggaaatgtgatattgccccaggacactgtacaaaaattgtgaaatttgccataggacatcggacccattattttatcatttcccagttgaaaattgtgataattttttcgtaatgcccagattgtccctgtgtcaccatctataccgactaggtgcggtcgaaacggagtcgatcactttcgtcgccacacaccaccgaggagaaaatccctaacccctaaccctaaccttaggttgcggtggcggcggcggagcaggaggatgtttgggtgacagcggtgacaaagacctactcggcttcggtggcgcgggagtgggaggcgtccgctgtgggcttgcggtgcactgtgaggactgaggggttgaacactcgcgcggtaaggggaggggacaaaatgaaaacataacgtaatcctttcatgtaaggggaaggaccagaaattaatagaagattcgtgaaggatcacgaagatattttgcaaatcgacagacccaacggtctgtaatgtccggagtgacaatctaatggtgtatattcagttgatgacgtggcaaagtaattttgcgagaagggttttacctttcagttatttagattgggccgacttacggcctagcagcaaaggaacagtttgggccaaacccaaactaattattcggagtacataatatatatgcaataagtttgattttagatcgctcatcaaaacgtcgagattaaaagacgttctcaaatcgcagtacagaatatagtgtattcctcaacattttaaaccagtgtaagtgagatcactaggtggtttggactatggttttagctgacgtgacgctacgtggctggtttgatttagtcatcgttccacgtgatgttaacgtggcactaaaagcaaagattaaaaataaaaaagttgaaacaaaatatgtaggaccttattgtcagggttacggataaggtacaccctctatccttggatatacgatgagtactgatatggtatacctacgcgtatacgggtatacggatagttcctatatgcgttaaggaaatctatcacgtgatagaaacagaatccacggatggaaggagtcctactcggacgagactgggtctttacaatatcgtgaggggtccgatatctccgagtcctacttagagatcaactgacccgcagtataaaagggagcccctgggcaggacctaaggcatagaatctcaccgccaacacatccaccacagcctacgaaatcggagcctacaggagccaagtcgccgggtgatctagt

SEQ ID NO: 49363 - DNA, 4732 bp, Oryza sativa
acctaaagtggactaattcaaactagggtctctgctcatctgctggcaacgaaccatgataatgggccgaatcaagggtccttttgcaagctcgcaactcgagtcagttgctcaggcccaactaattgctggcattacagaaatgaataagtctattttgcctctcacaactcttgttatagattgaaccacatcccttaaccataactagaaagccagcgtgcctgctggcacgccaataaattgatagccccgtgtgtattacctgtgttttactgttaacttgtttatttctacctagcaattggtttcaattttctataaatataagatatgaacatggcaatggtatttctcttatttgtatttatctagatatttttcaacatggtaggaaaattcttggtgttacttgtttatgtaccgtcttgattttcaattaaatttgtcctctctgttccgaaataagtgcagttttgtactgtgcatgtccaacatttaaccgtttgtcttatttaatttttttatgattagtatttttattgttattagatgataaaacataaataatactttatgtatgactaattttttaaataagacggacggtcaaatattttacatggatacccatgattttgcgtggagaccaattccgtgagtaaggacgtgtgccaaggattaagttgcacaaaattcatgttataagattaggctatgttcttttctccaacaaatactggataaacttttagataaaagtggcacgcttttcaaactgctaagtggtgcgttttgtgcaaaaactttatatatgaaagttgttgtaaaacataagactaatccattttttaagtttgtaataattaaaactcaattaatcacacgttattactacctcattttgcgtgaaacacttaatctttatcttcgtattcatcttcagaatatttaaacaccacctaaatatggaatcttttcgatttgtctagaatcgtccagggctgttaattttgcagggcccatatatagggtttttttttttaacgagcgtcacaccatcacaccatctcaattcgcaagcgccaggcaggagagctttccggcgaaacctgttgagccacgtggcatgagcccctgcaagagttgtgcacggatttcgatattagagataccaatataatgcctcctacatcttaaaaaccagagcagatcgagtctctaagctgtgatagcggtttcgtcctacgagacgcttatggggccacatgtcagtcagaaaaataataaaaaaataacagcccacatgtcaatcattcaaatctcatctttttcttttttctcgcccatttctcccatctctctctttcctgttctctctcgctggccggcggcggcgggagttccgattcctgtgcaagcccacggccggagagctcctcccagtaaccaccttctgccgcaagagttggacaccctccaccacacgctcgatcgcgtcgagtcgcgacgcaggtacgtgtgcatatccgccattgccgaccaatcagttacctgctgcatactcccttcgtctcaaaaaaagaccaaccctggtttccgtgtccaacgtttgatcgtccgttttatttaaaaaaattatgaaaaaaattaaaaagacaagtcacgcataaaatattaatcatgttttatcatctaacaacaatgaaaatacaaattataaaaaaatttcatataagacggatagttaaagttggacacggaaacccagggtttatcttttttcaggacggagggagtatatacgtgcacgcgcatgctgacaatgtgcggtttgccagcttttgcacgtggatgtctggatgagttgagggggaagctgaacgaccggcaaacgctagagcgcggcagctgcgacggcgccatcgatgattcgagggggacgacaagagcaatgtcatgatcgggataccatgcagtatagttttgataaaagtaatatcatatcgtatgctatgagatttttttttaagtttaattaatatttatattaattatatatagacattctatataaaaatatagtaatgatatatgtcatgcaaatagagacatttatcaagagaaaccacgttggttttgatatatttaactgtttttatataaatttgagtgtatttatttacattattttcaaaccatgatattttaaataatattttatagtataatagggattgtagaatcgggataccatctaagatttcgtaggatcgtgtagtaatgaatagtaggatcgagatactatgagaattaagatactagatgggatcggtatcgtttcggcttaataggatcgtaatatcgtatcatagtaggatacgaatcgggatactgacaactactacttaaaaaaaggggcataggtgccggttgggaaccgcctacaagtgccgatttcccaaccgacacctattggtcggcactgataatagaaaccagaacctatgacaattattaaaccggcaccttttgctttgctcgagaaaaaaaaaagagagagccggctcgaatggagccgacctcactgagcaccaccgtcgccatgtgcccaaatcaaattgaaatccccaaatcatccacagatcgtcaccaaaatcgattgacatcacaaataatcattcacaaatcgtcaccaaaacatgaggggagcattttagttagtacgcaccccaggtgcggtttagcgctaccatatatatatctggatctcccggtccagatcgatccctcgattgcgccgctcttctccaccccttctcaatcactctcacgcgccgcctcccctccccaaccctaatcgctccctttcatgcgacgccactgccgccgccgccgccctcgactgccgccgctccgccgtcgtcgcatcagtcgtctcgccgccaccgatccccgtcgccggcttgccctcaacccgatccccatcgccgtcgtcgcatccgacgtcgtccaggatccctcgactgccgccgctctgtcgtcgtcgcatcagtcgtctcgcctcacgatcgtctccgcctcacgttctccttcccccaattgctccccctctcgacctcgcacaatcgacgcctagatcgctccgccattcccctgccgccgccaccttctcctctcctctgccgccacaagcgccgcccctactaccctggtcaaaacctagtcgccggcgccacctcctcctctcttccggctgcggtcgatgccccaccgccaactcgtcgtcgcgccgaatcgccaatctccctccccggccaaaccctaatcgccgccgccactccctcctctctcccctatcttccctatcgtcgccgtcaccctcgcggcaccaccgattcaccgccgctatgttgctgtcgcgctgttcgagccgaccatcgtgcctcctcgcagtgccctccacccgttgcgctgccatcgccatcgctcgatcctcccttgggactagagcatgcacgacggtggaggcctccgtggacgcggagaggcttgcagggcctcggcgagagcaggcggtagcggaacccaccggcgacctcatccacgacgccctcacctccctaggtcctttctccaagcaggtacaatacggccacctatctctctcttccctgtggtctctcatagcctccaacgtctcacaatggatggtgctgagtggatgatccatgaacaagagatcatttgttttgcaactccaatttctctgtataaggataccagtgcattttgtgttccctaattccatcgccgtaagggaagattcttctgaaaccagtaaaattaatgcagtaaacaactatatagtactagctttagcgttttgtgctcgcggcatacagaatttatggctttagtgtaaaataatgaaaacgaatttttagttggagcaatgtaccatgatcatgtttgtcccccgtaaggcatgtatgcttgccctgtttgggtcataagagaaagtgaattgaaaaatctaagtagtttgccatgttggtcaaatatacctatgtaactgaattgttatggttttctttcaggtgaaaaattaagttcttagcataatatttttttttttgaaacctaaggcggaactttgttccacttttatatttagaagaagagaattgacccagtttataaggaaaaccgggcccgaaaaccatacaattgcatggtttattacaggaaaaccggctgaaaaccaccgctacacaactaacaactacggtggatcccaaccaggaaccatgcaagtattagatcataaatcgttaccactcgacacgctgcgcagcggaagaagacgctgagaagtcgaaggaactctcgcgaagtagcgtgcgtcgatgtagaggaagtagtcgatcgcaccggctcgaccttctcctcctcgtgcattctcctcgccgtactctcacgccgatcagcaccacaaaccagcgacgcctctaccggtatccacacgtacagggacggaatgccacgcgcagatgtgctagcacccgcgcgcggctagggttttgctcggggagggaagtgacggctagggtttctcacgtgatgcgatgcctccgccggtcacacccctcacgaatatataggatccatcactcgggcctccaaggcccgtaggactcctattcggatccctatccgaatcaagctcata

SEQ ID NO: 49364 - DNA, 3496 bp, Oryza sativa
  unsure (1)..(3496): unsure at all n locations
tcgacgatcactaatccatcgtaaatttgcagccgtctctcttaatcatcatagcccgtttttcgctttttctggtgatggaccaactcataataaattaaccaatcgacgacttatcgatcgatccatcaaccgatcgttcatgaaggggcgacccagaaaggtcaccgtgtaccagatcaaaaaagatcgatcccgaccggtcaggatatatccaggggtgcgcgcgtcgtaaacacgtacatttcgtgcgagcgactgcgcgagaggagtggtggtgacccgggcgagcgcgtgacggggcggccagggcgccgggctccgcgacggttttggccgcgcgcgccgatggaattggcggtggatatatgaatggattattattgccccatcccgaagggtactcacactcacacactgacactactcaggcggcggcgacggcgaccgtaatacggccctgtcccactcgtggtgtgaccgtatgagatgtagcatttggtatagctaaggtcgtgtctagtccatcctcaactaccccaaattttcaactttccattatatcatatcatattcaaaacttttctacacacataaactttcaactttttttttaactcccaacttttctcaaatttttaacttttttcatgaactaaacacagcctaagatgtaggctacctatgataggatgggcgctataccataccagaacgtacgctgcccatgcgcctgtcgacgacggtggcgacgtagtcatgtcaagtaactagctgattgatctgaatttgggttatcgtccgttccttccatatatgtctctgagcccgacgatatgagccctacagtacacgactgttgatgtgcacagtaactgtatttttttggtcaagaacaatcatgttcacctcgccggtatggcactcgacagatatatacggttactgcgcccacgtgatccaccgcaaccgcaccgcacacgtatctatacccttatacgccgtatacatccacttccatcgtacgtacgtactcatcctacgactagctctagtgctctacgtacccacacattcataaaaatacacgacatttttgggctaaaaatacagcgcacacataaaaaaacntcatactacccactctaattttgaatggataatgttgctgatttctaagtgatgtttaaccatttgttntatgtaaaaatttagtgcaaatatgaaaataaatataagttacgctaaaatacttttaacaagtgaaaaaaataatatttacataattattttttctaaaaaatgagctaccaaacgttatgttcagaaatcaataatatttatatatctaaaaaatgaaggcagtatgaacaaagcagaacacttcaacgcgcaattggttgcaaacacatatttatccaaatatctcgtagaaatagaaagataaagtatttcaaagaaagtctaaaagctaaaagcttgttgttgttttctccccatcgctaaaagcgagcagtagccatctatgatccatcagtggaccatcacagttgcaatccaaccaagctagcctagccaggccaaacttgaggaccatgaatcgatcgatcgattgtcccaagcccatgcataaaagcatgcctttgtgatagatactcctacttagatagatatcctagcacctagctagtgcagtcacgatacataggggccgtgatcagtagttcagtacagggttccctttgacccaggctatctctgcttgcttctagcgaataaagtgatggttacaatttaatcattggcctaattaatctctagatgtgaatatgtatgtgatctcatgtaacccaaatcacagggaattgcgagctccgtttagccaattaattccaggcaattgtcagatggaacccgtgaagaaaaagaggtttcagtgtaggcccgggatcacaaaatctttggtcaaatagtggtggtcatctagcgggaactagagccgttcgatcctgcctcgagattagcatcctgtttggctaatctttgacaggtgtcattttttgaccttgtccacgaatcttgtggggtctgttctaattggacggtcaggatgccatcatgggagcggctctgattactgacaggtcactttacgacatgcagctaaattctagagaccggtcaacaaaacatgttatgatggtaatagccaacgggtccagaagatagaaaggaagtcaacgatgacgtggcagcctagctggacatgatcatcccggtatattccttccacgtcagcatggagatacgatgagcaccatgcatgcatatatatctcactaaaatatacactcctacatatgtgatatgtgtctatccggaaacatcttatcatcttattattatcggtatatctacgattgcgtaagctggcatatggtttccttttttcctaggcttatgacggcaaacaattataaaggaaattaagtgagtaactaacttgcagactaacttaagttggatcaattactctcaactaaaaacacacaaaaatggtagtagtactacaactacgaacaaatttagatgtgctgttacttaccaggaattccacaaaggcgctgatgaggtagatggcgtaggtggtgaagaaggcgtcggagaggaagccgccaaggagggcgaggaggaaggcggtgcccatgaagttggtcaccgtcgtcgccgactgcgacggcgagtagtgcatgaaattcatcaggtaggtcaccaggttgctcgcgttcgccaggaacgccaggttctcgagcacctccaccactgcacacacaacaaagccaatattctcaatccaaattcgatcttgaaaaaaaaacaaaatctctatcctaatcagtatatattaaattaagttatactgttctccattggtaggattttccattgaaattaagctatgaaattgagctaccgtgtgccactgaaaaacttcagatggagatgtaaagttgtattttaatcggaggcgtttgaaaaattggaagtactagcatgcatgtgcggtggtaactgatataaccgccccagcataatgtgtgcggttcccagtgcatgccggccaattttctttgttctccctgaccgtttcggccttgcgattcgtgcccgaattcaatgctcgcgtagcgacaattttggacagggtcaaattataatggcaaatttttctccccaaaatccatggctggttctttctctcacactcacaaccgtcagggcaaaaaaaaaaaggaaaaaaaaaagtccttcacacatgcaaggaagcaaaaggcagtcattttccaactgaacattcgggatcggatcaacgggagagatatcgaaaccgaagccggcatggtgcccaccagtcaaccaccaccaccatcagcagcagcagcgcaagattgcaagaagaggtcgccgtcgatcgagagcagggacaccgtctttt

SEQ ID NO: 49365 - DNA, 2405 bp, Oryza sativa
ctgaaggcaacctcttatatcttctttcccactagcacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcactaacaaaatatttgtacgggtaacaatccaaatatgccctaaaaaataataaaattgtattttaccagtcttggagattttaatcttggatagttttcaatataaaaagatttgataactattgatatttatataaaaaaaatatagagcacagtacaaaatcgccctcccccagggcggcaaggggcccgcctgccaaattccatgccccctcgccgcccatttgcaggcggccccccacagtagaaaatcgccctagcggagggcggcaaggggtccgcctgcaaaattccatgccccccctcgccgcccatttgcaggcggccccccgcacagtataaaatcgccctagcggagggcggcaagggggccacctgcaaatttcgttgacggccgtcgcccgagagcgaacggccggctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattctctaaacgaatggctcagatcgatcccgcgttaggccgaatcactattgggtcgcgtgcgcttcatgggccgcagcaggtcgaccggtcgaacaaaaaaatttaacttagactttcggttagggcccacgcggcagtgagagatgaagtagggggagttcattagacttatttttgggccggacaagtgtgcggttgaggcggaggagaggagaagggaggaaagcgggccagcttggctgcgggctgtataaaaatgggctgaaaatgccccaacgagagagtggaagatttctattcaaataaatattgcaaggatgttagtattatgaaaattagcaattaagctacgcaaattccaataaaattccaactagcataattaatcacggagaatttaataaaattaattttaactataccattttatttctcgcacttactttacttgtaaactaatttaattatacacctacctacttaaaaaatatcgaaatttgtatttcaatgaattacataatgtaaatatttctcaacttttcctcaattttttagtctttacaattcccgttgcaacgcacgggcacttttgctagtaatctataaaacatatagtagtcggacagtttttttcccttttgggggctttcatgggatggcgttttttccctttttgcgttttagctgtcttttctttctcacggtgttttggctttttttctttgtgtttctcgccgctatttgtgtggctttttaatagatcgcgtttttttaaccattttctttgaacggagttttgcctcttttttttttccggcgtcttttctggatatttttggcccgtttctcagggactataaatggccatgtggactgcccagcaccgtacggcctatgccccgacctgcctgggccctagcatgttgggccggcacgggccgacctacccaccgggtccggttgtacttacgggccatgcacgggccaacacgtttcgggcccgtgccggggccccccgcggttttcccccccccaaagcacgattggccatttggcaattccttaaaataaggtaatttccctccctcctattgggctgtgacatatatatagctaaaaagtctattttacgtcccttatctttgggctgtggtatatgaatagctgaaataagtctatttaaggtccctattatttggacagcaacattatatgtctatttttagatctctatactttgtgtgccgggcctggcctaccggaccatcgagccgggccaacccagcgtgccggtggagaggcccaggcacagcccagcggtcaggccgggccggaacgggcccgacccaagatcggccgagccgtgcttgggccgggccaaaaagccgtgccgtgggccgggccttaagtcctcaggccttatggctctatatcaaggacggcgttttctttttttttctccattttctttttgcaagagatgtttagaatcaaacggtttttttcatccctcttttttatcaaggagctttttttatgagttttttttggcgcgccctttttttcgtggacctacccatttaaataaaaattaatggatggatgttttactttttggtctcataatt

SEQ ID NO: 49366 - DNA, 4310 bp, Oryza sativa
  unsure (1)..(4310): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccggcagggtttcttttggcctactgcagtgtccgatgccgacaaaattgtgcgcacgtgcgaaggttgccaatttttcgccagacaaattcatctaccagcccaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataaagctcgagacttcttcatcaacattgtgcatagatttggagtgcccaatcggatcatcactgataatggcagacaattcactggcggagtttttaaagacttttgtgaagactttggaattaagatttgctatgcctcagtggcgcatcccatgagcaatggacaggtggagcgagccaatggcatgatacttcaagggattaaagcgcgtgtttttgaccggctaaaaccttatgccggcaaatgggtggaacagctgccatcagtactttggtctttgcgtactacacccagtcgggccacaggccagtcaccttttttccttgtctatgaggcagaagcaatgttgccgagtgaagtcgaattcgagtctttgcgctttcgtaatttccgcgaagaacgctatgaagaggaccgagtggatgacttgcaccgattggaagaagtccgcgaagcagctttgattcagtcggctcgatacttacaagggttgcggcgttatcataatcgcaatgttcgatcccgtgcctttctagtcggcgacctggttttgaggaaaattcaaactacacgagatcggcacaagttatctcctctatgggaagggccatttatcatctctgaagtcacccgaccaggttcctatcgactcaagcgcgaagacggcacactcgtcgacaactcttggaacattgaacatcttcgtcgtttctacgcttaagcttatcattgtacttccctatcttgactgtcaacatcaagtgttcttcttgaagttgtcagtcgggggctattatcataatatggagtgtgattttttatcaattcaatttgcttacttggtctatcattgccttgttgatttttctacttagtctgcgaggactgaaagtttttaatagcttctttgggttttaggctcaacaaagcttgataaaagcttttaagaaatcaaagacttggctagaattatcaaacacagcataaatacactagtattgtacaagttgagcctccatttgttacattcatacttagtcagattcagttttttcatcatcagagttgttactactcggctgcaggtcggtattgcggaatctatctacaacgtcacttgcaattttgtcagccgcgttttgagcattgctgataagatcaagagcagcttcttcgcttgtcccgtcagcaaagccatcaatggcgtcaatttcaatccttgggtacaaggatttggtcatcgccaatgccatgctagctcccatgcttccagctttcttgatattcttgaaatatacatccggagcaactctcagcttgtcgaagatttcggttgcgtcgagtgcactcggaccactgttattgaggaacatagcttggacgagtggcgtagcgacactagcgacttcatctcttgctccttcaagcctcttgatcttgccaaccaggacgtcaaattgagcttgagatttgattttgcggtctacaaaacatatttatgataagaatttgctgcatttaaaagagagaagttcagattgttagctggcagtaccttcaatctccttcaaggccgagtccctttgtgcagccagttctaccttgtctcttttcaaggcttcaatttgtttctccatttgggccatcctggtggcttgcgctgtttgaaatccaaatggttgaggatacagttatgacagcgtaaattaatgggacagatctagaagattaccttttgatgaacctctcagctcgaagtttgaatcctggagctgagcaatttggtccctcaattccttctctgtcttcttggcaagctccttggcctcgtgtagctggtccctaactgcttcaagagttcccaaatgaggaaccagcttttctaaagttgcggtcttggcctcattacgaagatggattctctgcatgatggttcatggtttagttctgctaaagagaaaacaaagtcatcaaaggcagtcgcccggaagatttacattcacaatgcgagtggcttctccaagtgctttcttcagctggcacacttcctcatcttctttttgacgatttatgacgatgccggcagcttgtgagttctcgtcccaccatttgagtaagataggaggacgagagtcatcagccgcctttatgcggagaatttcttcttcatcgcctggtggttctgatgtatttccaagacattagacgaataagctggagttattcaaatcggcatcacttgagaagatgagttacctgaggatgttcctagctgaacgtaaggtgatccttgttctttattcggagacccaatcatcgagtcgttaccagcctctggtcctcgagaagttgtcgtctgcgcttcaacttcgggagtttcttgatctggacctacatccgactggtttccagtcgggggctcttgagttgttgtagtttcagttgctgccgactagtttccagtcggaggttggtcactcggatcggccttatcacctgaagtatgggcgccagtcggctggctttcggcagttggctcagaatccttggatgaatttggctctgtcacagccggatcaggatcttttccagttggatctatgtcggatggtttcctgcaaaatattctttcaatattcagtattattttcatgagagaagcatgccgaagtgaaatgataccgagaggtttatacctggaagatgttctaatctttggcattggacggctagccagtttttcctgggagtggtatgctttgggagtttattggtcaagcctttgttcccagatttgttgccgtcgtcgccttcgtcgtcgttaagcaccagttttctcttgcgagaacctgtctgcccagtcggattggaggtttgaggttgtgggtctgatctgattgtcggccctccacctccctgaacggtgtgctggcgaggagaccggcgctgagtgattggggggtcagacttcatcaatacatattcctgaatgagatgcctccacggttagataactcaacatgaagacaagattatgttttggtaacgggttgaggatttcagatacatacctgcggaggcggattgaatgcgttatatggcacaactggcagctgatgtgagtagctgacgacaatagcatttgagaagattttatacattctctccttcatgattttaaaatccagagagtctggttcttcacgattaggatcatgcttgccgtcaaactcaaaagctgtacgggatctttctttaattggtgccaatcggcatttgatgaagtgccgagtaatctgctctccttgtaagccttgttctttgagttttagcatgcgatccatcaattccaaggcttgggctgcttcatccccaatcggaagagagttccaggtatcttggtacaccggaggaagacaagaatactcaggaagagcaggctcaggattctgaatataaaaccagtttgcgtgccaccctttgtttgaagtcttgaagggcatagagaagtacttttggctcagagtccccctcagctgaaatccggcccctccgactacacatggcttactcttgttcggttggggcttgagaaagaagattcggggaaacagagcgaagtggggcttaatccccaagaaggcttcacaaacatggacgaaat

SEQ ID NO: 49367 - DNA, 13403 bp, Oryza sativa
  unsure (1)..(13403): unsure at all n locations
gactgtaggataagccaagtggataaaacctaaggacatattttataaataaaattatttgcgaaagttcctctttttctccttcccctaatgctatttgcaaaaggtttactcttttctttcttcggatttcaactaagtactagatggtcagctttgcgaagaagaagatgtcgtcagttgtttgccgaagctccggaagactgcaggatccgctagcgaagtggaggaagcagtgaagccagctgagaagaagcaggagtgaagatcttggagaacccgtcgcagaacctaagccaccctctagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacagcacatcagcaagaagaattagttcctttaaggtcttgtccctagttctggtctattctttccttgtatgcttcccctctcaacctctaccttgtgacagatggataatactggtaacaaaggctatgggaatgatggatccgatgactcaagaacccaagccaatgggaatgatttttgagatttgaataaagcaacaccgaaggacgaatatccaatgccagcagccgatcagccggtcgatgctgcatcagggaacaagattttgagttttatggatgggaatgcaggttataatcagatctttatggctgaggaagatatatataaaacggcctttcgatgtcctggtgcaatcggcttatttgaatgggttgttatgactttgggcctaaagagtgctggggcaacatatcaaagggccatgaactatatatatcacgatttgatcggctcgttggttgaagtttatattgacgatgtggtagttaaatctaaggaaattgctgatcatatagccgatttaatataagtcttcgagagaaccaggaaatatggtttgaagatgaatccgacaaaatgtgcttttggtgtatcggctggccagtttttgggatttcttgttcacgaaagagggatcgaggtaactcagcggagcattaacgcaatccagaggattaaacccccggaaaataaaaccgagttaaaggagatgattggcaacataaattttgttagaaggtttatttccaatttatccggaaagttggaacctttcatgcctttattgaggttgagagccgatcagcaatttacttggggggtagagcagcaaaaagctttggataatatcaaggattatcttagctctcctcctgttttgattcctccacagaggggaataccgttccgattgtatttatcggctggtgagaagtcaatcggctcggttctggttcaagagcttgaagggaaggagcgagttgtgttttatcttagtcgacggctcttggatgctgagactcggtattctcctgtagagagttatgcttgtgcctttatttttcgtgtacaaggttgaggcattatctattatctaatgagtgcactgttatatgcaaagccgatgtaatcaaatacatgctatcggctccgatattaaaggggcgagttggaaaatggatattttctttaaccgagtttgatcttcggtacgaatcaccgaaggcaattaagggacaagctatagccgatttcattgttgaacatcgtgataattcgatcggctcggttgaaatagtgccatagactttattctttgatggatcggtctgcacccatggttgtggcatcggcttggttataatttcccctagggggcatgttttgagtttgcttatactattaaaccatatgcaactaataatcaagctgaatatgaggcagtgctcaagaggttgcagttactcaaggaagttgaagccgatactattgaaatcatgggggattctttgctagtaatcagccagttggtgggcgaatatgaatgcaagaatgatacattgctggtttataatgagaagtgcttagagttaatgaaagagtttcggctggttactttgaagcatgtatctcgagatcaaaatcttgacgctaacgatttgactcaaggggcatcggggtataagccgatgatcaaggatgtgaaggttgagattgcagcaatatcagccaatgattggaggtatgatgtgcatcagtatttgagcaatccttcccaatcggcttctagaaaattacgatataaggcattgaagtatacattgctggatgatgagctctattatcggacaattgatggggtattacttaagtgtttgagtgccgatcaggctaaggttgcaatcggtgaagttcatgaggggatctgtggtactcatcaatcggctcacaagatgaagtggttgattcgacgtgcaggatatttttggccgacgatgttggaggattgtttccggtattataagggttgtcaggattgtcagaagtttggagcaattcaacgagcaccagcgtcggctatgaatcctataattaaaccatggccgttcagaggttggggaattgacatgatcggcatgataaacccaccatcaagcaagggacataaatttatattgatggcaaccgattatttcaccaatgggtagaagcaattcccttgaagaaagttgattcgggagatgccattcagtttgttcaagagcatataatctatcgatttggtcttcctcaaactattactacagatcagggttccatattcgtgtccgatgagtttgttcagtttgctgatagcgtgggtatcaagttgttgaatttttcaccttattatgcacaagctaatgggcaagccgaggcgtctaataagagcttgatcaaattgatcaagcggaagatttctgattatcctcggcagtggcatactcgtttggccgaagcattatggtcttataggatggcttgtcatggattgatccaagttcctccttacaaactcgtctatggacatgaggctattctgccttgggaagttagaatcggttctcgtcgaacggagttgcaaaatgatttgacagccaatgagtattacaatcttatggccgatgagagggaggatttggttcagtcatgtttgcgagcccttgcgaaggttactaaggacaagcaacgcgtcgctcggcattataataagaaagttgtgcctaaggatttttcagagggcgagcttgtatggaagttgatattgccgattgatactcgtgatagtaaattcgacaagtggtcataaagttgtttctaagggggcatatatgttgcaagggcttgatggtgaagtttatggacgagcgcttaatggtaaatacttgaagaagtattatccgagtgtatggattaattcatgatcggttcctagtgtcgatacatgatagccgatgtatgtgcatcgccttgagatggccgatattattatatcgcccttagttgttttctaatgtaatcggccgacggtttgccgatttgcaatggccgatattgttatatcgcccttagttgttttataatgtaatcggccgacggtttgccgatttgcaatggccgatattgttatatcgcccttagttgttttatagttttatcaatgccattgacattgtaaaactaggggggcatatatgtctgttaaaatgcagcaaatacagagggcaaaattttttgcgcgaattttaaatttatattaatcggcatagaaggatgttaagtgatgaagtatcaagctgttttgccgattacaaaagatttctaagtcctattacattgggattactgtgataagtattgctggatagccgacatagctttttgcctaatttgctctacttcttctatggcttgagcatcttgagcgtcggttccaggaataacttttaaggacttggttagttcagcgacatgcttaatagccgatttcagtctggctttctgctcttcgattgacttggggagatcggctagtttcttgcgctccatatccagctcagcgttgcattcctcaagttgtgctaggaggtcgatcttgcgtgcttcaagccgatcaatattggacttgattggaccttcagataattgatcgagcttggatttttcttcatgcacaagttgtcggttggcctggatagtggactcaatgtctttgcgttcccgccgctcggctagtcttaacttggctttctccagcttgaattgatgttgttcaaggtaaacagctggagtaaggacatcggctaactcatccgggattaaagcttggatttcatgcaaccgagctctgattgggccacagtcaactaccaagctgtctagcgatgatgcttctagccgatctaagatactttttagagtcttcttgacatcattcggataaaggggccaatgctttgcttgtggtatcttcttctccttcatcaagataatctctgatatcaaaagagaaaagatcggctaggacctgtggtgataatatgaaaatggttagaaaccaaacaattgtagtcgatttggatgctcgctaggggaaacttactgggatagcaggagcggctggttgttcttcttcctcaatgtggtgacttcccacggccgaaggggtctgatcactcgatgattgttgggccgaggaagaaggaggaggtgaaagctgaaaagaaagcaagcgttaagtagagccagctaaaattgaaagtttaagttatcttactggtgaaactggtttagatgttgttgcagccggtctctttttcactgcggtcttctttttcgcaattataagactcgggggtgatcggctataaggtaaaagggttcaaaaaggaattagtgaagatggagtggactggagcagatggagttggaagggtttgcttgggtgatgccgatggtgttctttcagtatcgcttacttcggctgcggcttgatcgacttcatctccgatggcttcttcgtctaaggcttgttcgatggatggatctaagtcaggcagatcatcggctggcttgtcatctggtttggctctcttgactctggtctttttctttggagccaggattgagatgcttgtggttgaagctctggtcttccttttttggcctgcatcggccggttctctagtgaggccatggaggagagttgatgtcttaggggcatggtagccgatgacagggggagctaatccacctccgtttggaatcaagcctgcagcgtattcgatgtctttaccgctgttactttgatgaggaggggaagattctgtcgtctgtaaagtggggaaaaaagattggttaagtaataaattgatcaattgactatacaaacttaatgatgacaatatttacctggggtatgacgtcagggaaaagatctgtcatatacattgtggccaattggtgaaacagatgtagcttccattcaccccaccatctgtcgaagtttttgcttctgaaaccggctaactcaatgttctcaatactgcccagaggaggtcctggtagattgagtagccgatccatcattagagtggatgtgatttggcctcgacattgaatcttgtcggcaaagaataagccgattgggagttggcctaatccaagttgcctggctgagctcattggatgataaaattcataagacacctggatgtttcttccttgatggatgccgacggggtggatgcaagggctgattgcagctataaggatttctctggatttctggaatttctcgtgatttatgtcttcgaacctgaaatctgatgggagttcaaggtctgttgagtcttcatatgggaaccagatccgagcatctttcttgaaaccttcgtagaagctacagaaccagtccttgagcagctcagccgatagctttgctccagcgtcggtaggtgtggatgcatattccccgtatgatgtgcacctgcgatgtgtgcgttcttctccatcatcacctgtaattggctctggcagtggaattcagcttctgtcacaggaggccgattgacaaccttcataaccattaggtttaaccaggtctgcagtaaccaccagggtccacctgctccaactgttgagccgacagcaattctagctgatgcattgtttagcatctggtacaggtagccgagaagaatttttcctagggggaattctttctttgattccagggcttcggctacaaattgccagttggttgtggggccacaactggatccacagaaaagaaatttttccagccacatgagcaaaaaggctacatgctctcggggggtgacagatccttgacccatgtatgctgctacatagccagaccaaccacctatgtttttggtcttgaaatcaaatttattccgggtgttcttgctcatggggttggccgatgaagtcacatctaatccggtgatcatggtgatatcgattagggttggagtcattggcccttggttgaataggaaagcattgatggtgtttgaccaaaagtaagtggcggcagctattaatagttcatctttggcagagttggctatagttaaggcaagtgcttggccgattccgatctcgtcctagtgaactttcttgctagccgatacacgctgataccaagtggaccagctcctgtcaggcgaaagtttctccaaagatggccaggacttaaaggtgttcttccaatgacctaggttgggattggctagcctgaagggaatccggttggtttcaccagtaatgaaatcggtggggtcgaggctgccgattgggccgaggaaatagtggtttcgatgcgaaagacttgggattgcgacttgatgagaaaggtgctataaatccagaagcaatggaaaagggagaagcggtatgagacgaaagaaaatcaatgtattgctgaagaaggagggatttagccgattggaacttacctcagcgtactcagttgttggcgcaccagaagggctggcggaagaagacatagctgagggcagagatctcgtcgagaggggaatcgccggggagtcgcctttgcgtcggagaagtcgccggagaagaaaggggattggatttgcttaagcggtggaaacggaagttacggtgtgaggtttctcgggggtgacggttaaatatttaaagcacggcggtaacggtcggaaacggtaaaatgcgaaacttactcggagtcggcttatagcaaatccggaacattatcgaatatcccggacttggggggcatgtgttaacaaccaaatttggtcagtattcgtatcaggaaaagggacttaatcggagaagagttggagacgaagatcaagttctagaacagagcaaggatcggctagagtctggatcggctacggctaggatcggctaaggttgagctaggctaagtaggctggtatagccgattctgataatacgacttatgcgcgacgtcgggctcagtttgatgtgcttcaagatgattgccatgtctggatagagtcctgagaaggcaattgtatctattaattagattatttatgtaaattccttatagataagtgtgggcaagagtctgccgcaaagactcgtgatattttagagtttgttagagataatggtcgtggccggtacgggcatatcttgtaatcctcgggtataaatagaccccgaaccctatgtaacgaaatacacacattcaatacaattccggcgcatcgccacctttcgtttttgttttatttcgacgagttcttgcttccgggttgagctgcatcggtttcgatcttcaacaagaggtaaagctcgttatgacgaattatgttcttagggattagtgcttacatcttcatgatactctaatctcatttatataattcgccgagttatcacatatcttacataatcttcaacaatatctctatctaatctattatcggctaacatttgcatgcaaaagacagccgattaggttagatctcgatgttgatttggattatataagatatctaccattctatgaatcttccagtggcttgattgtctagatattgttcttcttttcatacttaatgctgcatcagttgagtttgatccattaagtcatgcttagaatagcaatctctagcctgctttctggttgttaattaggatagtatcggggtttcagccgatcttatttgatttaactatattcgctttatatgtcgcactgatatgttaaatctgcctttcatgtcaagatattattgcatttacatacattaagcttttgtttggcatattctgcttgttataatatcttaacatagaattgcatcggagtattagccgatgcatgctagatttatttgatcggctatgctgtagacgtatatagttctgttataaacatatcttttagtccaagtgatttgtactgtctcggcatgatggccgatctatcccaatcacttaacttaagtatatgtcgatataagaattatgtattgttaatatctacagccgatcgaatagatttagttctttattatctattttccattgccgatcgatctatatatgacatcggctcaaacgtaaatgatatgtcatcggcacctggccgatcggctatcatttatagatttaaccacggttcttttgtctctgtttcttgttgattgtaggatcaaatcaactggcacgctcacgtatccgaaggcgagttttggacctgcactggagttaagcagatctcccaggcctcgtgttttctatcaacacgcttttggcacgcccggtgggacctgattagaagtcagacgtcatatccccctcatggccaagaaaacagcaccgncaagcccaggcttccgcaaaggcaaaccgncaaagccagggctgaccgacatcgtttgaccgggaaaaccaaaaaaatttgggggttttcttgcggtgaccccgagaagttcaagcagagcagaagcaggacttcgaagcaatgatgcaacaagcacgggatcagtatctgagctcatacatgcaaacccgcaagggatcactcgttcagaagtacaagttgaagctagtcgccgacatccctggaaccggttcatctaaagatggggaaattaagcgagatccagatggctcggctcagccgagcgccaaaggagctaccggtggttttgcagggaatcaaggcgataaccttccagaggtgcatggaactccaagccgtattccccaagaactaccaggaggagatttcagtcaagatcttcaagtgtctttccacaactttcaagatcgggttgactacgcggtacatcatgctttgattaaccagtccggggtgttagtcgacacgctatcaaacatgatgaaggcaatagccgatggctcgatagctgagtttcaggctacaggcccggtttacttgccatgaggagtttttccaagttactggaccttaatcactgatgctcagccagttgtgcaggcggctccatctgtcgcgccaacagcccaaccaacggcgtcagcatcaacatctgtacctgctgcatcggctactgtggcggctcagccgatgaatccaagattactggtgagggagtatccacagcctgccgaacagattacaaatcagccaactcaggatcaggttgctgctatgttcctgccaccacccgttgttaatttggtgcaacagcagccgatccagcaagcaccaccaattcaaccggcggtacaatcaacccaacaacaagtggtgcaaccagcacaacaggcactgctagttcagccagtggtgcaaccgatccagcaacaagctgtacagccgattcagcaggcaccgccagtccagccgatagtgcagtcggttcagcaacaagttgtgccaccagttcagccgatggtacaaccagttcaacaacaagttctgcagccggttcagcaagcgtcattgccgcagcagcattttcaaccaaatcaacaaacaccgccgaggcaacgactttagccgattcagcagactccggtacggcagcagtcgattcaacacctggggtcggctaatgcatcggctgggttcgcagcacctggggggcaacctgcgcagcagtttgggaatcaagccaccccagaacatttggttcatcacgtacaaccagatggcactgtgatacctcagatggtccctgagcacttggtacgcaatattcagccggatctgcacgactaccaagggggcaacttaagctataggtaccagccttcatccatacaagcccaatatcagccaggaggatcggctcagcagcagttcgctccccagtttggtcagttcgaatccatgcagcagcaaccgcaaggatcagctcagcaacgaccgtgggccgatgtgattgccgatgtaatgagggaacaattcgggctcaagcctaaagagaccggaagcttgtatcggcagccttatctagagtggtttgagagggttcctcttcctaatcggtttaaaatcccggatttctctaagttttcgggacaagagggcgtatcaacctacgagcatatcagccgatatctggctcagtgtggagaagcgtcagctgtggacgccttgagagttaggatgttccgattgtctttgtctggatcagcttttacatggttctcatctttgccatatgggtcagtcaatagttgggctgatttagagaaacaatttcatagctacttctacagcggggttcacgagatgaagctgtctgacttaacagcgatcaagcagcggtatgatgagcctgtacatgagtatattcagaggttcagagagatgaggaataagtgcttcagcttaagtttgaccgatgcccagttagccgatttggctttccagggtatgatccctccgatcagggagaaattttcatccgaagatttcgatagcttgtcgcatttaatacaaaaggtaaccttgcatgagcataggtcggctgacgtcaggagaagctctaaaaaggttaaccaggtctgccagtatatgtatgaatcagatgatgaagatgatgatcctgagatcgctgcagccgagtgggtgaggagcaagaaggttataccgtgtcaatgggtaaaaaaccctggaaaggagcaaaaatatgattttgatataactaaggctgacaagatctttgatttgctaatccgagaaaagcagattcagcttcctgccggtcatacgatcccgtcggctgaggaattaggcaagaagaggtattgcaagtggcataattctggatcccattctaccaatgattgtaaggtcttcaggcagcaaatccaggtggccatcgaagggggaaagattaaatttgatgactccaagaagccgatgaaggtcgatgggaatccttttcctgtcaatatggtgtatacggcaagtcaagcagccgatggacctcgtttgaagagcttccaagtacattcggccagaatcattgataaatatcaaaggaggtataacaagcagcaggagagatgctacgaggagaatgacaacggttttgatcctcattgggattgtgaattcttcagattctgctggaatgaagggatgaggttgccatctatcgaaaattgtcctggatgtagcgacgtcattaagagcttaagccgaccacatgataggggtgatcggctgagacagacaagactccctgttcatcaaagattgggtccaatgagtcacgatcgtaatcaagaggacgagttgaccaggaagaatcaatggtgtccttctggtatttttacgaagaaccagaaaaggagggtccagagattgaggagtagggagcgtttccaggaggttgaagaggaaatcaaccattgactgaggaaaccaagaccaaggcaggtgtggcgcgttaagacccaagttcctgcagccgatgatactacagccgatgaggcaaagagattggcaaaaggaaagagtgtcgttacagcaccagtcaatatggtttttacgctgccagccgagtttggaatcagccaggccgatgtcgatgaagtagaggatgaatcggctaagttggtcatatcatcggagcaggcggtgttcgagaagcctgagggaacggagaatcggcatctcaagccattgtatgtaaatggttacgtcaatgggaagccgatgtctaaaatgatggtcgatggtggggtagcggtgaatttgatgccttatgctacgttcaggaagctgggtaggaatgccgtagatctcatcaagacgaatatggtgctcaaagattttggcggtaacccatcagaaaccaaaggtgcgttaaatatggagttgacagtcggcaacaagactattcctaccacgttttttgtcattgatgggaagggttcatatagtttattgctcgggagggattggattcatgccaattgttgtattccttcgactatgcatcagtgcttgattcagtggcaatgtgacaagatagaggttgtgccagccgaccggtcagtcaatgttgccaatgccgatttagctctctaggaaatggatggccttgattgtttatctggaaaagtctgggatggagattttctaaaagtgtccgattctgacatacagccaattgaagatggagaacccaagctattactttgagggcgttgtggagggttcagatacctgtgctaaggacacagtagatgatctcgatgataagcagggtcaaagttttatgtcggccgatgatttgaaagaaattgatataggtccgggcgatcgaccaaggccgacattcattagcaaaggcttgtcttcggagttcagaaccaagttgatagagctcttaaaagagtttagagattgcttcgcttgggaatactatgagatgcccggactcagccgatcgatcgtcgaacatcggctacctattaaaccaggagttaggccacatcagcaacctccgaggagatgtaaagctgatatgcttgaacctgttaaatgtcacgtcctgataaattcatcccgaattaaaattcattttctaaaaggaataatagaattaattaaaaattcgaaaagaatttggcaaacactaaaatacgtacaagaaaaattcaaatgtggcccggagaatttttgttaaattctccttggtctaaaaggagccctcaaattttacttgaattttcagagcgccggaaatatttattaagcaacaaaaacaattaacaaagtttattaaaaagaaaaacctaaaaataattctcctcttcctcctttgggccaagcccagcccgaagtctctctctcctccctctctttctctccctctccttctctccctcctcttgggccttctaccctctcggcccagctcccttt

SEQ ID NO: 49368 - DNA, 3359 bp, Oryza sativa
cccctaccgccattactccctcaaatccgcgcgaatcaagcatgggattcccaaattgattagggggaattaatcccctttccctcctctctctttcccccttaattccccggtgagtggcgcccccaatcatcgggaacggccgcacttttcccggccaccaaccatgggcgccggccatccttcccgtcgccgttccgccctctcccgtgctcggctcgcttccctccgctataaaatgcaaccccctcgctccgttctatcgctttagccccctcccgcggtctcccgtagtctctagccacctccccaccggcaacctctctcttccacgttgccggccggacttcaaccggctatcccagctcgacggagcgtcgttcggccgcgcccgtcactactccagcgtgggccgcaccttctccaccccgggttgccctccgtttcgcgaggtgacccccggagctgccttcccgccgtcgccctcctcttttctccgagccggccacctccagccgtaccttccgcctcacccgtgcaccctccggctgcgccgtcacctctccggcgtcgcggctgccccctctccctcggtcagccctccgtttcgcggggaaagcaccggagacgcgtcctcgccggcgtccagtggcgtcgccaccacttccccgtctccggccggctgctgttcgtcgccggtacgccgaccgacgtcggcgtctcctccgttgacgtcgcagtgccgtcctctctcccggccaggccacggcgtcgcccgaatttcgccggaacgccgtcgtctccgcgccggcctctccttcctcctcgtcggctcgccaacccgctgcaccaccaccttcaccaacatcgcagcggcgtgttccacgctgtccctcctccgcgcagccgctgctggctgccatcgtcgtttccttgtcaccgttcgtcctcgccgatcgacgtcccatcggtcgcccggctcgtcgtctcgcggcgccgcctccgtcgtcggcatcgtagcggcgtgtccacgtcgtccccatctccgtgcagctgactgccggctgtcctcgtcgcctcctcgccggtcccggtcgtcgtcgtcgtcgtcgtcctctcgtcgttcccggtcgtcgtggcgttcgtccctccgtcgagccgttctcgtccgtcgtccgcgttcgtcaagcgcgccgctgcagccccgtcctcgtcttcgtcctcggctccgcgtcgtcaagccccgtgccggccgcgtctcgccttcgtccaaggatcgccgccgaagccgtcccctcgccgttcgtctccgttgtgcccgtctgtctccgccgcgcccgttcgtcgttgtcgttcccacgcctcgtcgcgtggtggtaaggatccgtcctctcgcttccccgccctcgtcctttcggtgtcgccccgtacccgttgtgcggtcgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggactccgtttgttggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcttggtcatacgagctctgaatcgacccgttcaagtctcctaatgtttgtataacctaaagaaccgtgtgctttctttttatgtattgttattgcttctttttaggcttgtagctttgcttgtgtgcttcgcgtagtcttcgtcgttccggaggttccagaagcgtggttcgtggtcgtcgccgaaggttcggaaggccgttctctctgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcgtggtatccctagtttaaatttaggtagatgcttcgcaatttaattaggtaacattaggcggttttacaactctagactttgggatattctcatatcatttggacactttggaatggttggcttatgttggaattggacacacacctccccctcttttcaaaacccccaaaatggtttaggctgggctcgaggtgcgtggttgggttttgttagtcgtacctcgggtactataaggattaagcttgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatatggcagagggttggtgccctgctgctaggggctcagtcctgcctgcctgtcccgggggttccggccgtaggtgggattgggtcggtactcttgtctatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttataattcttaaaatttgctcaacaactaaactgtggaatggttggcctgggttggcttgggacgagctgggacccagggtcgggttgccagttcggtctgaatcatcgtaggccttgggttaaggcaggttcgtgagggttcacggccttggttaataatattgtatagctaggatcgtctttacaaaatagctttgggcaactaagtgacttttaaatgccgtttactgcaaaacttaacccctatattattatctccttgtaccccccttgcattaattatgcatcttcggtgtggcttgctgagtactgtggttgtactcattcttgctcaatctttcccctcttcagtaagagaagctttggagaagatgtcttaggtggagtcctggcttataccc

SEQ ID NO: 49369 - DNA, 1418 bp, Oryza sativa
gtattacttagtgaaattttttttggatcccttattacatggccctagggggccttttatagctctattacatgttcccctattagggtttaggttttacaggggaatttacataggtacccttataatagtgacattattgagggcacaccgtgtcctttacatgtaagggcctctattgggcttaaatgactaggcccatctatttgctgaagtccccccgagggcatggcggcctgttgggccttctggcggcgtaattcggcacttttggtgaaacccgtgccttgacgccgagggcttaacttaacatcttcgttcttggcggcctttaacgaagtcgaccttgctcgacaaactggcgtactctaaatcttcggttttcgctttgtgcctttggccatggtgtttctcttcaatcttcgccgctactgggcgtcgagcctgtacccagttctggttttcgcaggtccggcaaaggccttccgtggtatacctccaacaagcccctcacgggcaagggtgagtagggagcctcggccgagactgtgcaaattgaaaggtgtaccacgaggcgcccccttttggccgatgttcctgtcgaaacctatgctgcacacctgtagaatatatatataattcgcttccatgttcatacaaaaaattcttgggggggatttccttgctatgttcgccagcaagtggtgaaaaggttggcttattctttaaactactatgaatagtaatgggccccgtgggccttcccatccttgcattctgccttttactgttctgccccggtccggtccgatgggaatttaccatttcgtctagccccgaacacgtgtcatgatatggttggatggaagctgaaccgtcgcgatgaggttatataaccccaccccgggttaccgcttctctcccccccttccatttttaccacaggcctgcttatggctttatgctctcactttgcgcttcacctcttcgacaccatgttgacagaaaacacgaggcctgggagatctgcttaactccagtgcaggtccaaaactcgccttcggatacgtgagcgtgccagttgatttgatcctacaatcaacaagaaatagagacaaaagaaccgtggttaaatctataaatgatatccgatcggccaggtgccgatgacatatcatttacgtttgagccgatgtcatatatagatcgatcggcaatggaaaatagataataaagaactaaatctattcgatcggctgtagatattaacaatacataattcttatatcgacatatacttaagttaagtgattgggatagatcggccatcatgccgagacagtataaatcacttgtactgaaagatatgttaataacagaactatatacgtttacagcatagccgatcaaataaatct

SEQ ID NO: 49370 - DNA, 707 bp, Oryza sativa
gtctgcttgggctggtcgagtgggccacagtgacaaattgtcgtagacttgggttaagcttaagcctgatccggtaactttccgatcttcttgggccgctgaagaaatctcatgcaaatttgggccatggaagtccaacgagctaggcctattgattcttgcctacaagcccaagcccgtgtacaacgcatcccacaccgttcgttccgttgctgcaactgagctgccattgctggatgcgtctgtgacggaatccaaattacctgagctgacattacacaaaactggaagacaataaatacagaatagcaaagcaaggatcggatttccgattaatcacagttcatacatagataaggtgaagctggacggataacaatatttgagcaagaaacactaagcaaagaaggaacgtgcagcttgcacactgagggcaggcaggcagacagacaaacacaagagtggcactcatgtggaaaagattccgaattgcaggcgtgatttctcaatcatttctgcgcaaagcgataaggtaattaacaacaccattgcagcctcgcagcgtcattaaacgacagcaatgcacagaggaatgttgccgcttaataatgcagagagcaggacagcgcaactaatctctgaaaaattagtggctaggagccttggatcatagcaaaaaagtgctaacaactgcactataaaatgcg

SEQ ID NO: 49371 - DNA, 888 bp, Oryza sativa
actaaatttggctaccacgacctcgtaaaggccaaacagcggggatcccgtgattagccgacttccaaagcatggcctcctccgccattgctttcgccacttcggtccaagacctttgttgttgattgaagatttggttgttccgttctttccaaattgtccaagccatcagtgtcacgacggtgtcgaagcctcgacgatgccgctccccaatcttcattcggctctcacaaagccaattgtggaaggatggctcattgacaagtaagcagttcggactccttattgcctgaagcgtccaccaccataattgtctcgattcagggcatgctaccaagatgtgatcaatgctttcctcgtactgatcgcaaagaacacagcgatccgggtgtggcaaccctcgactgcgcagacggtcagcggtccagcatctgttaattgcgaccaaccacaagaagaagcagcatcgaggcggagcgagcgacttccaaattggggtggaaaggaaggtgacacgaccagaaaacaaggccttataggcggattttgagctgtattggcccgaactctcccatttccagatgattgaatcaggagtagtaggatcaagatccaccatttggacaagcgaccaaagctttagatattctagaataggctagatcccaagtgctcctcggatgtctttgatccattggcgacctgttagtgcctcaaccaccgttcgacgccagcgcacgcgtggtggaattttatcatagatgttcggagcaatggaccgaatgcaaccctcttgcaaccagctatcttcccagaagagaatagtttgtccgtctcttaattaacagacggtagaggctgcaacgaaattcgtttccttttgcgacc

SEQ ID NO: 49372 - DNA, 1159 bp, Oryza sativa
tcaaatgaatttctttagcaacagaatttgatttgtctggcacgggcaacttggttgataagcttggatgcatttgtataactcatgtcacgggcttaaatcagcgtattatggttatggctgatcacttgccagcagaattagcgatgattcgttgttccgggtggaccctgttctgtaatttctgactttgttacaattaaggtccatttcctgacgagagctcattgatggctttcttgtgcctttgtggagacaggttggtagaggttgctgagggcatcaaaacctttctccctgtttcctttttctcgtactggtacgcttggtgttatcgagtttatgtccatgatgccctacattgattgctggactgaaggagccctgatacgctctactgccacgcctcgccaagataagatggcacttttgtttgtaagcttcctctgttgtttctcccgtggtgcgtgtcgtggttgggtttcgacggccagtcggccagagaagggtcgtgtcacgaaaagccttgcccgcactttgaactgtcgcggtagcatcattcctgctttgacccctgatgaagtcatgcaatccatgcatcgcagctagaggcgttcactgtgttccgccttattcgagctcgtgctcttacttggtccttgaaaaagattcgtgattctttttttcagttgtacctgagatgctcccattttcagagcttccggaattttcagccccccccccccctaaaaaaaaactaactttgcacttggattgtgtttggttcctgaaaaaagttaaaagtttgataaaagttggtagtttggaaaaaaattaaaagtttatgtgtgtagaaaagttttagatgttatgtgatggaaaattgaaagttgagggtgatctaaacccggccttgatgggaaacagccaggagtagaatggtgcaaggtaggtaggtgtgcaggtaggtaggcgtgcccggcgtaatctgaccgcgaaattaccctcgcgcaggaaccgaaccaagctagttgtgctccgtattcgctgcaactgtgaaacacctggagcatttgactccatacgcacgaggagtaagtacgcaaggccggccggccggcctgccgcctgccgacgctgtcgcggcggcacagattga

SEQ ID NO: 49373 - DNA, 1817 bp, Oryza sativa
  unsure (1)..(1817): unsure at all n locations
aattttatttctatatcgactctagtctcctcttctaatattccttattttttaattccgaatttcagctatttctatattgtatgtatatatggactctagtcttctcttctaatattccttattttttaatttccaatttctgctatttctaaattgtatttctatatggactctgctttttttttctctgattaatgtgagaatttttaggccatgagagcgaacgtgggagctcctttttctattcttttaataatataactagctgggtgaccgcgcaattgcgcggctagcttccatacaaaattatttttttaaaaaaaagttaaatagctatattattatcttaggaatttgatcaacctaaccttattatctccatgtttctagttttatatttttgaaaatcacacctatcgctacctcttacttatttgtcacccttttattttcttgctcgatctattagggtttctatttatcctccttggaacttttaaaattagacagtttattgtctcgttgggttttgttttttataatttttataagtctccgtcaaaagcggccactctactcgtctatagtccatccgccgcctccttttctttgttgccattgagattttaaaattgaacataattatcatcggtgtttatttttaacttttttttttttccggcaaaccgtgaacagcttcgccattgtactcctctatgacccacccgttgcattccctcttaattatcattgagattttaaaaaatcgaacgtgattatgattttggtttaccttttactgttgtaaaactcttgccaaccactgtgattgtgctgcttaacagcttgcccatcattccttctcttaatcattactgggattctatttgatttttgtgttaaatttaaccactataattttaacatgatatcatctaacaaatattttttagtaatattaaaattcaataatatgataaatagatactacttgaactctttcgaattcatattaaaaaccaatttggagttgtattttattttaaattttaatttttaaaaaatattttgttgtgttctagatggacactgcttctaatattctttatttttaattctaaatttcagtaatttctaaattgtattcctacctgaactttgtcgaattctacgaattcgtattgagatcaaattttgggattcatcatgacgtgtctatcactccgctcttttttttttctaatttcttctatactttttacgttatttgctaattaggattaccaattaatcttcgaaaaccctatatcttagtcgccaataatttataattttgagacttacatcacttgcatatataagtttgggatttacatatgtaataattttgagacttatagtctaaatacgttaaaattacatatataattttagggacttataacgtaaatacatgcttactattatttgatgaaaaatatgacgacaggtactcccttccaatttgccgtgctagtcatcaatctattgaaaaaaatgcatgacatttggtgtgctttctctccgggacgccatccatattttctccaggagtgctaggctagctatttaggcatgcatatatatatatggcagtgcatgtcctttttttttcttcgatggttaatcggatacgaattagtacaacaacacggatacgaaaaatcaatttgctgtatgattctttccatatattcattgatcaatnnnnnnnnnnnnnnnnnnnnnnnnnnnnnnnnnnnnnnnnnnnnnnnnnnnnnnnnnnnnnnnnnnnn

SEQ ID NO: 49374 - DNA, 706 bp, Oryza sativa
agtagtacttttgtccacagctactagtataataacacattttttttagataatggaatataacatcccagccagtataataacacatgaatagtactttataagtggcttatgttttttaatttttctaaaaaaattaaataagacggataattaaagttgaacacggaaactccagattacatttaaatagtacttctgtccacagctactagtataataacacatgaatagtactttataagtgacccatgtttttcaatttttttaaaaaattaaataagacaaatgattaaagttgaatacggagactcaagattacatttaaaatggcgcggagggaataactttgccgttaaaaatctaaaaagatagaccatgttatctgcatgtggagaggagtgacacggggtcacgggccaaccgcaactgtcgggttcaaaagatgcgttcgcaagaaagcaaacagattagagtggtggccccgcatgcagaggtaacaactgatcgaaaccacggcatcccgatcaagttgctggtttagctccacggacgcatgcctattctagtgctccactgccactatctttagtagcgccgtgtcgggctcccatatataacgtccctcgccgtctccatttggatttcagcgatcgatctctaccgcaccggccccgcatgcctgcccactgcccaaataaagcgt

SEQ ID NO: 49375 - DNA, 2681 bp, Oryza sativa
tgaaaggatgtttcgccgcgaagctcgagagcagccgcagcgagactagtcagactcagactcagcagcaacacgtttccgccgctcctcatgacaataccagggccacctcctctcatgtcatcaccagcgatatcagcatggatgcaaacacgatcggtgccagtgctgatgctgacggcaaggcagcggcaagcggcgttggcgcaggtgaaattgtcctcgccggagcttcgtcgacggatatggccatgatgatgtcggtcgaggacttcgcgccgacaccgttggcgccatccgccgtctcaccgttcaagaagaaggggaaggtgcacgagtgctccatctgccaccgggtgttcacgtcggggcaagcgctcggcggccacaagcgatgccactggctgacgtcgggcgcaacggacccgctcacgaagctccagcccgtcgcccaagaccacgccatgatggccgccatgtgccaccagctcacgctcgggcgcccaatattcgaccctaccgaccagcggatactagaccttaacgtgccgacgaacccactggcagaagcggtcgcggccaggcagcagcagcagcagcaggtcgccgctctcaacgacggcgcactctgcctcaacgcggcggcgtcggtgtacctgcagtcctggacagggcacagcaacgggagccacgtgaacaagaccaccgcgacgagcagccgcatcaacgacgcggccggcggcgtgaccacggaggacgatgaagcggacagcacgagcgccaagagagccaagatcggcgacctcaaggacatgaaagggcaggggagtcgttgccctggctgcaggttggcatcggaatttcatcagagagcaaagaaaagaacactcaagagaaacctagtcatgacaaggaggtcatgccgactaatgaactaagaaattaattaattaattaattagtgctaatctaatccatatatatatatacatattgtaggtgtacgtactatatcaatgctttatgtgatcgggatatatgtatgtgtatatacatccaatgtaagtatttacaagtagggtcaattcatgtgttcctaaaggtttgaggcaacatctagggacgtattgcttgggggactgtaaattaataggctagcaagcttgattctaaaaggtttccttactgtacgattctttgaggagccttgctttttatttttatttttttccttttattttttctattttgtaactaaccgattatttaatttgctgcttccaaaatgtatatatgcaagttgattttgtccttgtgttcactgcaattagacaagctatatgtgtgcctatatatgtttttttcttgcatttctacactatatattactctaaatatacgacgttcttaacttttaaacataatatttagctatacgttttatttaaatttattgtaaacataaaaaaatcacgccagatataaaggatctttaataatgcaaattagtaaagataaaaaaataatgtttaaagtaaactgaatgataaaataagttaaagcaaaataaatgaaacttacttcatagctaattttactgcagatatgcaaatgtataagccattcttaacaaatcaaatcacaataaaataaataatacttaacaaatttcatgtcaaaaagatatattcaaaaatggaggtggtactattctgcgggaggtgaggaacgtcaatttttttattcatatcgccacggtggagaagcttgctgatgttcgttaccagtccagttcgatggtgcatgtaaataggtcgggcaggcgcccgatacttataatatgtatataaagtgtatatatacgtatagacaacgtatatgtataatataaattttatgtatatgtattttttatgtataaaaatatatattcgtataaaaactttgtatatgtatatgtatacttgtattggtataatacaaagtttatatacatatgtattatatcaatataaagtttatgtatgtatatataaataattatatgtataaaaaatattggcgtataaaaatatacacgtatacaaagtttatatacgtacgaattaaaaaaaccgaaaaagactgccacccctctctccgtgcaacacatggctgcgacgcgcgggggaggagcatgcctaattagaattggaactagctaataatctgtcgacagtttttaaggctcaaaactttcaaatttttaaccataggatttgtcatcaacagttgaaatgggtactgttaacagtaaaatttggtaatcccaaagttaccatcggtttagagtcagtatcggcttcaaagttcgagaatcagccgatgggagtcaagtcgccacgatgtcgtgttcttggtggagttggatcaatcaaaggaagcttatctagaagagttcgagttcaagaaagatgcgacatgacagttatctattaattaggcatagtttattagtttccttttatctttaggaaagtgtgtttagtgtccgataaggactttatcttttcctttttagtttctttcttgtccgacaaggactagtatctccctatgggtataaatatgtacaaccggggtcattgtaatctatcaatctatcgatcaataatactctcggcgcatcgccaccctcttcc

SEQ ID NO: 49376 - DNA, 1176 bp, Oryza sativa
  unsure (1)..(1176): unsure at all n locations
nnnnnnnnnnnnnnnnnnnnnnnnnnnnnnnnnnnnnnnnnnnnnnnntgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaatgcaaaccacatccgatgctaacaaccaatcacggcctaacaaactagtagtgcggagtacgtgccaacattttgatatggcatagtctcagccagcaagcaaaaaatctgcgcttgtctcctttttctcgttttaatgcatcacatggcagaaagtgaccgtgcgtaaatcattcataactaggagtaggctatttcaagaccttcaattgctcacagtacaacgatctagcggcggtgatacgaaagagaccaccatctatggcacatagctctctttcccaagaagaagaacatgctgcagacctgacctgcaacctgcattcaggtgcggctcgcgcgagtggtcgatgtcaaaagacgctacctagtcactgtcaggatccatcgcgatcctccatggctgcgctccatgtgcccgccaagcgcacacgacaacgatctggatgaaaataataatcgctctcgaaacggcacagtgtacgagcggaaaaccgatcgagagctcccccatgctctgaccgctcgcatgttccgctcccccgttctgtctccctttccctcccccctgctaataatctcggcgtcgatggatcgatcgggtggtctgtgcgtttcacagtccgtgtagcccgcttcggccaccaccaccattaccaaccaaccaaccaaacaaccgagcgagcgatcgt

SEQ ID NO: 49377 - DNA, 1095 bp, Oryza sativa
aggaacgaaactccagagtttttgactctgcggtctcttcggtctcaggggttctagagtcatcctctcagaaggccatctatggtcgttagctggcgacctggcattgctacttttggggttttcttgggagggtagtgtgactctgccttcttcccgctatttggagttgtgtttagctgttgtagtagtctcttcctttttctcggtttttgtttttattttttctctcttttcttgacataagtcggtctgactgattatggtgtgtatcaaacactcttttcttttaaatatattgacgtgcaatctcttggtgtgttcggagaaaaaaaaactccatgcaaaatgcagccttgcatgcggttgctggctgtcttgctaaacccaaagtgccgagtgcccacttcacttgcacggtttgacctcattttgccccgtttttaggactaaccgtgaaggcaaagctgaatagcctgccaccattacgccaccacatactctcaccagttgctgataaaatgtctttaggactaatcgtgcatgtagtacactttccggctttccgctccctgccgcctatctcggattctcggtgtgcatgccactggtgagtatacggattactataaggaatgaacacccattagctgcggaattctgtgtcaagggaccgattgccactagctatattttgactgacaaaattctaggagtactgacaatgtcggttggaaagcaaagaggcaatggctagagatccgaccgacaagtccgcaactagtggagagggtcagatatagatagaggaggaacgtggctaagagtagcactgcatactattaggaccctgtcaccattgccatcaccgcgaccaggagatgtcatcgaccaagtcactgccttttgccgccgaacttgttgggtagagctgccctcaacatggctggatttgaggtgaagaaggatggcggcagccaggactagacaggggagtagcccgttgatctaaaccaccttcgatccaccttgcataggtcttggtgacgtcagttggaaaggggaaagtcgtggggcttgcttcgatccacaata

SEQ ID NO: 49378 - DNA, 1076 bp, Oryza sativa
tgcctgcaggtcgactctagaggatcccccgctcccccgttctgtctcccttcccctcccccctgctaataatctcggcgtcgatggatcgatcggttggtctgtgcgtttcacagtccgtgtagccgcctccggccaccaccaccatcaccaaccaaccaaccaaacaaccgagcgagcgatcgtgcaggcggcgtagcgtgaggtgaggtgagcagcgcgcgcgcgcgcgcgcgcgttccccaccgtgtcagtcgcgggcgcatgtggagagattctccggtgacgggagggtgaaagactgaaagcaacgggcgcacatggcggtggtgctgtgcatgcatgcgacgcgcgcgcgaccccgcccgcggccacggttcggctgattttgttgggtattcgcccctattcgaccgaggggtggtcaaaactcaaaaccccgcgaacatgttaattggcagcatcgaaatttctaatctgtcctgtccttccatacatctaccctggattcggatcaggccactttggcagtacccaatcatccagccatccagcacacgagagatggcccagatttaaccgtgtcatacatcattttagctatttgaacaagcatagaacagtttcagttcagattttgcctgcaatttctctccctttgatctgaattttcttgaactttaagacaacccaaatattgttaaagaaaagtagacacatacttcatttcattatattgaacttcataatatcttgcacgcataattgacaaaatgagctagagtttaagcccttgtttagtttccaaaatattttttccaaaaacgtcacatcgaatctttggaaacatgtatgacgtattaaatatagataaataaaaaaaagtaattgcacagtttacatagaaattgcgagacgaatcttttgagcttatctttgatcttatttttctattataatatataaaataaataaatgtatatttacttttattatggtgttttgaaagacaaatttatatatgttgtcctttaaactaaatatttttaaaattattgggggatcctctagagtcg

SEQ ID NO: 49379 - DNA, 941 bp, Oryza sativa
  unsure (1)..(941): unsure at all n locations
ccctgagtatttttgagtcggtgaactgcagagatggatggtcatggtctggcatgcatataatactctctcttaatccctgaatacgatacgatctcatcagagacagtggagctcatgtgttgatttaccaaaattagttttctgtggtgcttgcagctgaaacaggtctcaagtgtcatggaagacatgcatcggaaacaattctcaaatgccatggaagagcaaaatttgctctttgcagcagtagttgttgtgttttcagaggctcagagatgcatcggtgcttaatttgtcaggccctgcttggtggaacggtggcgggaatgctctaggaactttttagcatttagctcaaattcaattagctcttactcctatttcagaacttgaactggtgctctttttcagaattttttttatagctttcatgcttgaaataatcaaatcaggtgatcaacagcagtctgactaagtgttgcaacatccattgcacgacttctgccgcttcatcctattcccagcaattttttgcaagacctgaatcctgaatttcagtatgagatctgcacctaccaagctagcaggatatatactctcctacaacaatagaaagtcaaacaagttctgaaaaacaccgtgtttattttggcttttgtcaaaacttcactccagtttactgatcacgctaaggttatagaagaaaatacattttggcaatagaaactagccttacattcgctggtattacatgtcgaacagatggatgcgcaataccagtaaataccgtttgagtcaaaattagttccttcaagagattggaaaactgtgcaatcaacacattttttaaccgaagaaggctgagaacaacatccgtccccaatcnnnnnnnnnnnnnnnnnnnnnnnnnnnnnnnnnnnnnnnnnnnnnnnnnnnnnnng

SEQ ID NO: 49380 - DNA, 1111 bp, Oryza sativa
agcgaatcgacgacgactgagctgctggatttttttttcgccccactaatccggccctgataccgtgtagcacgacggccaccggggaggtcgccgccgatgagccccaccatgagccttctctcgtcgtcctcatcctcgttcttccgccgcaactgccgctcatctgctcgccagttccgtcagctggtacggactctcctgatctcgcgattagtttatctgtagcttttgttcgtcgttagctgtttttttatgtttgttactggacggttcgtggtgtcttcaggggcggtgctaaagcgtaaaggaggatgttgccacttgcttaatttattctattttagatcgagtttaagctcatatgggtgtctaagtttatattaagacgagtgcatacatgatgaaaatagatgatatatagcttaaaaaaattttttgaccggttcctgaacacctccctatatatactagctccgccctcccccgctttggtcgttggggttgggtgtaagagacagtagcgtcggtccctgtggccctgtgggcgcgtagattgagttagctgcgtggaatggtgtatggtaaacactactcctacctgtttggattttaggatttgcttaggaatttttgtttggattttctgaggttatcagtccttggactccttaccagcgtgcactacatcagtttcttcgaattgcgtccagctagctaggggtaggatgagcaatggtacgtactatgtacctgaaaaccaaggtgatacttgagtgaaatctatagtttttgtgtgaacattgtagcttgagatcgagcaacccattgtttcacttaattgtttgttagcaaataaagattatttataagtaaaacttttatatatgtgtttttaggcgacgagtaggtgtggatggttgcgaaagtgctgaggcgttgcctccaaggtagcccaacaagattgacacggaagactaagtgtgtcattctattcttttaatatattgacgtgtaatacttttacgtgttcgagaaaaaaaataagtatgtcacttcatttcgtcctcgtgacccgtaaaagaaaagcaaatgaagtaaaataaactat

SEQ ID NO: 49381 - DNA, 1430 bp, Oryza sativa
  unsure (1)..(1430): unsure at all n locations
ttttcttttttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttaacttgattaagggttcgtgcccaggtcccagtcctcaaaaggcgcgggtcggggctagtgcctggggagatccacatgtcgagactggccaggccgggaacgtggtgaccgaaggttatgggtaacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagacacagcctttatgaaattgaaactgtctttattgaaatatttgaataagagaaataagaaagtgcatgtgtggcagnccccggccaaccctgcacgcccgagggggtgcggggttggcccgagcccgaaccctgacacccgaccccccctcaggggtagaagcgccgaaagtgttcgatgttccacgggttagccagctcagtgccgtcgcccgtggcaagccgtattgagccccgccgggggacgccgaccactcgatacggaccttcccacattggtgagagcttgctcaatccagcacgcgtttggacgcggcgtagnacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttttggggtgggcaggtgaggcgaagcagagcttgatgcccatgtcttcgcagtagtcgccgaagagttcactagtgaattgggtgccattatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatattgag

SEQ ID NO: 49382 - DNA, 981 bp, Oryza sativa
  unsure (1)..(981): unsure at all n locations
ttttgagcctattaaaccgtcgttagcacaggtgggttactgttacacttatggctaatcatggactaattaggctcaaaagattcgtctcgcgatttccatacaaactgtgcaattaatttgtttttatctatatttaatactttatatatatgtccaaatatttgatatgatgtttttgggaaaaaaaatttgagaactaaactgggcctaatgggctttccccgacgccctgacggaaagggcaaaaacgtcttcggaatacagatgagatattactgcacgtttgcatgtttcagtgattcacctacatctctactgatccttttacagattattcatgttacaagtatgcacattttattccttcagccccaacaccacgcccttgcgatagaacggacgggcagcgagagggattagtaaagaataacacagtcaagaaacaggagtcatcgaataacagccatgcaggttcggaactggattgatcgaccagaaaaggttcggaaacggattaatcgaccaaaaggttcggaaacggaaatggactaatcgaccaggaaaaatgcccccgtccatccggtgattatactgatatactaatttgatatactaattttcagcccaggcagcaattcagcattgcgctgcggtaggcaagttgaaaaaaatatttataacaaatgaaaatctataaaactaaatgagcagatcaaaatctttgaaacgtggattggttggggtgcgccgggcccaagcagtagtgcaacgctagggcgacacgcgagagccccgatagcaagctaccgtggtgggccttcccccacaaaaaataaatttaatatcaaagtgaacacatagcccacatatcagatattaaactgataagaacagatactacacttgatcttagccaaaaggccgagaaaggtatgagttgnnnnnnnnnnnnnnnnnnnnnnnnnnnnnnnnnnnnnn

SEQ ID NO: 49383 - DNA, 1013 bp, Oryza sativa
  unsure (1)..(1013): unsure at all n locations
cagaggaatcaaatcaacaactcgtacaaggtacggagtatgctgaaaaatataaaagaactccaaagtggccgacaaacaccatgttatattccccccacttgtgggttagcatcggatggcacgcagatctttgtgggcgcgtgaatccatctatccactcgatatccgtctcgccgtggccgtcagatggatatgtaagatcgagctttggcagacggacagcgatgccgtggtnnnnnnnnnnnnnnnnnnnnnnnnnnnnnnnnnnnnnnnnnnnnnnnnnnnnnnnnnnnnnnnnnnaacccgttctacttcgaggtgctcatcgagttcgaggacggcgacggcgacctcaacgccgtcgacctgatggaggccggctgcggctggacgccgatggtgcagaactggggcgcgctctggcggtacaactccaacaccggcaaggccctgaaggcgccattctcgctccgcctcacctccgactccggcaaggtgctcgtcgcaaacaacgtcatcccggcgagctggaagcccggcgtgacgtaccgctccctggtgaactactcctaaattaattacagctctctccacatctcctgcaagaagctgcagtgcagagttgcggtaaattggtaattacagatttataattagcctcgggttaattatatggcgggaaatgtgcgtccgggtgttgcgagaggcggtgtcagaagaggaggaaaggaggtttaagaatcgtgttcttccctccacggtctctgcattcccctagtgatgtgactgtgtcgtcgtcgatttgtctgtaaaattttatttttcttagttatatcttcctctgttattgtcatgttgagggagaagcttgagctgcaactaatgttgcatgccgatgtatcaagtttgtgtgtgtgtgttttttttgtaccacgcaaatctttcagataaatggattagtactgtcagaagatttctgtacttcactggaactcatgcattgttggggt

SEQ ID NO: 49384 - DNA, 998 bp, Oryza sativa
  unsure (1)..(998): unsure at all n locations
nnnnnnnnnnnnnnnnnnnnnnnnnnnnnnnnnnnnnnnnnttttattgaacattcatttgcttcagtacatgacgaattgagcgttttacagctacgcatggaagctgttctctgcttcgtgccgaaagtaaactgatcaataaaagacaggctactagtatacaataaagttcctgtgaaattaatcgtcccactctctttcagcacgtataaacgagactgagagtagtactacaaataattgtgtgatttgtgaccaaacggggagaagtgccttccccagaacggcattagggcgacgagagcctacggctacgtacatgcgcaaagttattagcaaatgcacacggaccacacgtgcaatattcttgagagtgattggagctaatatctgctccattgctaatatgatctacgtgtccgtctacatgtccgtgtcagctacatggatgaaggggagaaaggggtaagtgaagcgagtttgtcacgatttgcacagtgtacctaccgcgtgtgacgttggccagcgaaagctcagtcgatcgatcgacggacgacgacccatgcgccaatgatagtacttgccgtagtaccaattcaccagggagacgagagtacgagacgcagtctgcatgcatacataatttcgacgacctgcagatcgattaaaggcggccaatgcaagcttggcgtttgtccgcgccggcactgtttgcgttagctgctatagctaggctccgcgtgcggccgtgcagagtatggggtggcatactgctacagtacatgctacgcgctgtgccgcggatcgcgacggcggcatgacgacgcgcgctgtatcaacctcgataaatcgtcgcgattggtaggagagggatcggagggagccaatgcaagcttgccggctgtgcgcgatgatggggtgaaaacagatacggaaattcccgatcgaccgaacgacgttttcgtaatatgggtaccgagctcgaattcgcccta

SEQ ID NO: 49385 - DNA, 769 bp, Oryza sativa
gggcaggcaattggttgctagttgaattttgagatttatttttaatccatgcaaccagcggcacgtttcaaataagaaattgaatgctagtggaattaagtagatcaaatgacataaactaagtggtaaaataaaaatctgtatccatatgacggcgggtactgtacaatattaatctgcacactcgtgcagaaataggcagagttttttttagaaaaaaaaactttctgaatcgaaatccatggtcgtcgctcctggtatatataatcttcatttgtcagacccacatgacaaactagacgacttttctcagtttccagttcataatgccgaggacaagcgaagctccggtatgtagaggagcacaagtgtactccatgcattaataattccattgaaaaccagttcgtgtcttaaactactaataattgagtacaatcagtgtgtgtaacattcaagactctgcacttttgtctactttcgatgagaactgcatgtgtcttcgtcggcaggaacccagcataacaggagagcaaaatttatagcacaacttatactacagtagtactttgcaatgtgcgggcggataatgcagcattggagtttatgctgtttgggagtattaggtttcagcgaaaagaaaaaaaggaggacacagaaacagcgcgctgatgatttacaccaaaatgcacgtccagtattttctttgtacagcatctatcttgtgctactccagttcaaattactggttgattgttcagggattcga

SEQ ID NO: 49386 - DNA, 1348 bp, Oryza sativa
tgcttgtcacgacgcacgcaaaccacggggcccgtgcatgcatggcagccgtcgtgaaccggtcgaccaactgtgtgatctcttcctctcgatcgtccgtgatcgatctacatgcatgctaccgtgtgtgcagggtgccgtgcaaatggcagggggtggacatcgcgttccgggtggacgccggctccaaccagtactacctcgccgtgctggtcgaggacgaggacggcgacggcgacctgtcggcggtggacctcatgcagagcggcggcagcggcggcggcggatcttgggcggcgatgcaacagtcgtggggcgcggtgtggaagtacaactccgggccggcgccgctgcaggcgccgatgtccatccgcctcacgtccggttccggccggacgctcgtcgccagcaacgtcatccccgccgggtggcagcccggcggcacgtaccggtccaccgtgaacttcaggagggaggattgatgagatgatatgtaggggatatgtagggtggtggtcgcacgcgcgcgcatgcacggtccaacggccgccggcgtacgtggcgctagcttagtttaattatgcttggagctatgtatatcagggcccaagtggtttgtgtgcgccattgttgcgcgtggagtgatggagctctctgtcagctcgatcgactgtggtagaagaataaacagatccttcagctaagctatttgccacagttgggcacttgggcgttggctccggtccatgtaccgatcagccagcgtggtccggggctccgggccgtcgcgggggataacgcgacttgtgctggcttccgcggttccacctacgcacttcgttcggtggaaaaagtcctttttatttttctcaactaaagttttagtttgattcgcatccatggacagcaaaatcagatagagaggctaccttaacaatcaaaattgactcattttatcttttcgagtgatttaggtaacggttttttcctacatgacacattgaactagagaaatttaaaatgatctatgaaggaaatcatgacggccatggtggcagcgccacggcaatcgagctcgagataggagaaatgatgccacgggtggattgagtgtccaatggctgcgagtatgatacacgtcgaattattgtctttgttggagacctctagagagcgagctccgccccctcctagccgttggtcatctcgacgcttgagctcatccccctcgccatcagccagcctccccaactctttccttcccttcatgccgtagtagacttcgaggagcgctgctgtaggattgagcttgacaagaaggcagcggggttatgggacatgcggatct

SEQ ID NO: 49387 - DNA, 2291 bp, Oryza sativa
  unsure (1)..(2291): unsure at all n locations
cccatttctctaagcccacagatcagtagcagtaccttttactccatcctggtttagtatctgcttaagggaccgagttggccgggtacatacctaacaagcagcagctagcgcgcggtgtggtacctagcttggacagcgaccaatggtactgtttggcgacccatgatgatcactggccgggccggcgcgcatgcatgatggtgcgccctgaacgcattcggtgtctcggactgcgatcgccgcggacgtatgcgcctggcgcgcgtaccgtgtaccgtaccgccgctggagagaccactcgtacgcttgcacgctgtgggcgtagtattgcaaccgggcggccgcgccagcgtacgttttgtccttccctaagaccatttccaacccataacactagatataatttccataagcttcacatcatcgagaaactagtactagacactactcttccaatgcaaacaccactatttcatgcttcaatttaatgttacttatctcacatgatgtcttggatgttgtgtagaaatcatgtctcgcatggtttccttctctttcctcatttattcacttgccacatcattttttatcctatgtagcagcttatttaatgttatggacaccatcctagtcattgggttgggaatggcctaatcatgtacccctcccatgattaccccaattaatatggagtatatacgcagtgagcgagcgtaccaccaaattgaatgaaggtccccggtccaggacgacgaacagcttaattaattcactgcgttaattaatttttgatgatctcgatcgatccgtttcgttggacacagcacagcggcgtgcctggtagaagaatgtactagtaattctttgattggtgttctaaaaaaaaaattctttgattggtctgatccgacgatggatgtgtgagattgtgagctgtgtgtggtgtgtgcgcgaatgcgaatcagcgtcagaaaaaaagaccgaagaaccttgaggggagaaagggaacatcatatcgacgtcgatctctccatcatcttctccatttccttatacgtactactagctttgatcacgtcgagacttttgcgccccgaaaacgaatcgacggcgccacggcggttgtattggtcgcgtggctagctaccctttgtttgtcgctgcccctgtggctttgcgctttggccgtacgacggcgacgacgtcccggccggacgacatgctgcgtgagtgattatttcattatttgtattttgggagtggtttggagatgaccatcaaagggtggcgaggtctatcgtactacatggaaaagctagcacggcgtacgtacgtggaattgtgggcgacaacggatttgttcaggtgatagcgagccccctgacgcggacataacaacaacagcaaggcaaattaatcaaggcttctattggaaatctacgttacggtaggaaacgtatccggcggggacatacgtatattaagaaggaaacgtgctgctccttctagtagtacatgttttctgttcaacttttcgatggcaaagcttagaaacaaaagttaaatccctttaactagtcctaggtagatacagacatactttgtacagtagtatatgtgctatgctccgtactgtcacagtagatggcagtcaatcgttgtagtactacacaggagggagtttatcacgccagattctcgcgccttggaggaggcgacaaaccaacagctggcacgcccagcagccggccggcgccaccgctacttgttgtggctccccgcagcgcgcggcagctctctcgatccatttccgatcgagccgagcgtgactacgccacgacagacggggatcaatcaggagaaaaatcaatcgattacccgtacatacgcgcaggcgcacgcaggcatcagcgcgcgggtcagcgtagcgaccccccgttttctctcccactactcgtgccgcgccgcgccgctcgccgctcccgcaacgcttggggccgcggggaggcaaggccgcgcccgcgcgctggcgcggcagcgttgcagctggccacccgcgcggccgcctgcgaaacactgtggacctctttcgtacggggcgcgcactgccacgcccccgtcgcgcgctgcccgcacgcggcatcacgttgcctttttctttcgcctcggcttcgggttcagtacggagttttctctgtattcaccgcaccgcaagcggacggctcggtggaccgtaccagtaccacaccggaccgcannnnnnnnnnnnnnnnnnnnnnnnnnnnnnn

SEQ ID NO: 49388 - DNA, 1162 bp, Oryza sativa
ccacgcgcgatgccgtcgacaccgctcgcggtgcctctccccgcgacggcgatggcacagcgcacacaatgcaacctcgcgaggatgccgcggccgcagcagccaaactgcggcggccgtcccggctcgagcagaggcggcgccgtcggcttgtcagcagccggtcgaatgctggagacgccggggcagccgcacgtggcgcccaacggctggcctgcggggcacggtcacccggcgtctgggactctcgccgccgccatggcatgctcttctcgtccggtggcgcggcagcagggcaaccggagagagcaagggtgggacgcacatcaggctcaggttggtgctcaacaccaaaatctcccgcgatttccaccgcagcaaggcggtggcaacatcggcgagaggcaggggcagggtcagttcaggccgggtacgccgtcctatgtgcaggagcagcgaccgccgccgcagtcgtcgtcgtcgcacgaggcgctgcatgcgggagagcggcaacaagccaacaacaacagcagcggcagcagccggcagcaaaggcaaacagacacagcaacggtggcaagcaggcgcgaacccatgagtaagtgagcatggcttgctcgaagaggttactgcctttactggcgtgagaccgtgagtgaccaagcagggtttctctgctcctcatgcctaggagaataggagggttactgggaaaactgaaggattgctatttcttgtgttagaattaacgaactgagtttgattaatctgttctcataggttgacttgaaagcaaagcattttcacatttcgtttcttttcttctatttctagtgtataggacttttacaatctttagctgacactagcacttcacgtcgcaccaccttcgaactacaatgcggcaagacagaccacacaaaattcatcaggaatacaatgctacaaactgtcaaaagtgccacgactgatggctcccgtcacctcccataattttacagttcaattttccaagcataatgccgcattgagaattcaaatgctgaattgagacaacatccaagacactgtgagtcaaggataattcaaacatcaaacagatgacatattcggccaaactatggttcagtcaccactggagtgtccttgactcctgaacctc

SEQ ID NO: 49389 - DNA, 1730 bp, Oryza sativa
ctcaagcttggaccacatcaaaggcagtcaaagggtgacacaaaggatcaaaatgagaatatttagaaaacttatccaccacatccaatatagagttatacctgccagacttaggcaatccttcaataaagtccattgttagaacttgccaagcaccatccggaacagggagtggttgcaaaaggccaggataccgagagcgatcaggtttggactgcaaacagacagaacaaccagcaatagcgtccttaatcccttgtttcatcttaggccaagcaaacaaagccttgatccttctgtaagttactggaaaacccgaatgacctcccataggactactgtgcaaggcatcaatgatcttgtgctgcaaggacagatgattgccaagccaaacacggcccttatacttgataatgccagtacacagagaaaacaatggtctggcagtagggcagagggccagatcagacaataactgagcagagtaagggtctgaaaggtagccatcacttacttttgggagccaaacaggggtacaactgtagacagcattcagtttagaggagtcctcagaatacttcctagaaagagcatcagcagtcgcattagtactgcccttgcggtaacaaattttaaattgaagccccaacaacttggtaaacgctttgtgctaccaaggtgtgtgtatcctctgctcattcaagtgcataaggctgtgatggtctgtcaaaataatgaatttagcctgctggagataagagcgccaatggtcaactgccaataaaatggcgaggtattccttttcataggtagagaggcctctatttttcaaactcaatgctttgctaatgtaagcaatagggtggccttgctgggaaagaacagctccaatgccaacatcacaagcatttgtctccactataaaaggttgagaaaagtcaggaagggccaatactggtgctgatactaatgccatttttaaggattgaaaggcctgatctgcttcagatgaccaaacaaagggaacatcctttttgagcaagagagtgagaggtcggctgataataccaaaattcctgacaaatttttgataatagccagcaagacccaaaaaacctctcaacttcttaagagttgtaggtactttccaattaacaacttcttccactttagactgatcagtggtaacccctttatcagaaatgatgtgaccaaaataagaaagttgtgtctgtgcaaaagaacatttggacatcttaactttccactgctgttcagagagaagtgtcaaaacttgtctaagatgatcaagatgggaagtcagatcaggactataaataaggatatcaaaaaaagacaagtgcaaacttaaaacagaagctaaagtggcattcatagccccctgaaatgtggcaggtgcacccgtgaggccaaaagacatgaccctgtattagtaatgaccagtatgcgtttgaaaggctgttttatactcctcaccctccaccaaacgaatctgatgatacccagctcgaaggtccaacttagaaaagaaacgggctcctgagagttcatcaagcaattcatcaatgacaggcataggaaacttccatttaactgtgatagcatttaattacctgtaatcgatgcacaaacgccatgtaccatcttttttcttaaccaatagtgcaggtgaagagaaaacactggaactaggctgaatcaccccagca

SEQ ID NO: 49390 - DNA, 963 bp, Oryza sativa
  unsure (1)..(963): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctaagcgatatattctgtgcaaaaattatctaaatataagttaatttaaaatatcgaatatatctatttatcaagtttataataattgaagtaaattaatcatgtgttaataactttctcattttacgtgcaaccacttaatcttcatcttcactcaatgtctcgctgaagtagaactgtagagaactagaaattcgtcatatttgtcccagttccaattgaactcagtagctcatttgctcccaggccacagggccatttcggagtagctggtctccctgagtatttttgagtcggtgaactgcagagatggatggtcatggtctggcatgcatataatactctctcttaatccctgaatacgatacgatctcatcagagacagtggagctcatgtgttgatttaccaaaattagttttctgtggtgcttgcagctgaaacaggtctcaagtgtcatggaagacatgcatcggaaacaattctcaaatgccatggaagagcaaaatttgctctttgcagcagtagttgttgtgttttcagaggctcagagatgcatcggtgcttaatttgtcaggccctgcttggtggaacggtggcgggaatgctctaggaactttttagcatttagctcaaattcaattagctcttactcctatttcagaacttgaactggtgctctttttcagaattttttttatagctttcatgcttgaaataatcaaatcagttgatcaacagcagtctgactaagtgttgc

SEQ ID NO: 49391 - DNA, 2036 bp, Oryza sativa
ggatttgatgcaacagtaaaaggtctgtaaatgaaaaagcaaatccaggacctaattaatcttttctggccatccagtactccactgcacacagtcaatcaccaactctctccaaggcgtaaaatgcggcgagcctagacaatccgaggccgagcagccatccacacgccaagagtttgtttggatcctttcattcaagtactagtaattcaataattgtcacccactcttcatatagagtgaccgagaatgggatctaaacctttagtctataaataactttataaattctaaagatttaggaataaataaaagggttgggttaaaatttatatacatgtttgagttagaatattagaaaagggttgagttgaaccgtgaaagaaccgtcagctgtatgcatggttgggagaactagatatttgaccctaaaagagataaaaggtcaacattacacatacacttaggccatacatagtgtgagtacctaacgagtgattcaggctcactacatcagagttatgatggcatatcagccatagatgtgtcctcgtgaggcttctcgtgcgtcgtcagggcacggttgcctcatcagggtgagtgcttgggctcaccatgtcagagccgtggtgatatatctaatgagatagttccttcacaaggcttcttgtgcctttgcagagggcacaattgtctcattaggatgggacacttgcaagtgtagctaaagcatgcaagccacgtcggtaaggccatcgccccacaatatgccccctccttccgcgtggttgcacagacctcaatgttgcgagtactgacaatgtcggttggaaagcaaagaggcaatggctagagatacgaccgacaagtccgcaactagtggagagggtcagatatagatagaggaggaacgtggctaagagtagcactgcatactattaggaccctgtcaccattgccatcaccgcgaccaggagatgtcatcgaccaagtcactgccttttgccgccgaacttgttgggtagagctgccctcaacatggctggatttgaggtgaagaaggatggcggcagccaggactagacagtggagtagcccgttgatctaaaccaccttcgatccaccttgcataggtcttggtgacgtcagttggagagggggaaagtcgtggggctgccttcgatccacaatagtgaagttgtggtggctggagtgggaggagctgtggtgcctagagtgggaagatgtgttgataggcaaaacgaatataattagtggttgacaagtaggccaatggttatgatgtaacttttgttgatgattctaaaggttgttctgcatatttatttaatgtaaaacatatattagctaagtttatgaactgaattatttcaggccctagtcaaagccaccatacattgtgagaagggtattataagatataacttcaatctacattccacattctttctccctaaggccattcttagaagtagcttccatcgtgaatgcccttatgcagttttcccgtccaatttctacactgaggtagtatatatagtaggggcaatttgcagggaaaatgatggaagacattgactagaaataaaacagattgttcttttttttttccatcaatagatgaatcacaaaagttggcatggtatgaaaaagtagagaaaaattaagcctctcattgtatgcttctcttatttgccgaatccaaaatttaaattttaaaacttaattttagagttatttataagtttctttgttcatactggcttttaaattgtgaattatttttgttagtttgttaattttttaaggacttatcaacccgtaactcagaccaatcaaaacttaataagtaatccgaaatctcttcaagtttactccttcgggagtccaataagaccggcatgcatcaacatgctactcatcggtcgcacctcgcagtagcgcaactgaaacggctgcctcctgtacgtgcatgcagatgcagccgcatgtcgtctttggccgtttttgcaggt

SEQ ID NO: 49392 - DNA, 1783 bp, Oryza sativa
aattcggaattaaaaataaacgttcgctgtgggggttagaaattcccacattaatcggagaaaaagaaaaaaaaagagtcaagtagaagtacaatttaaaaatagctgaaattcggaattataaaaataaacaatattgaaagaagtttccatataagaacccaatacgagattaatcaaaattcgaaataaaaataaaataaaaatccaaaattagaaaaggaaaggagagtccaagtagaaatacaatttaaaaataggtgaaattcggaattaaaaataaggaatattgaaataaatttccatataagaacccaatacaagattaataaaaaattgaaataaaaataaaataaaatccaaaattagaaaaggaaatgagagtgcaagtaggaatacaatttaaaaatagctgaaatttgaaattaaaaataaggaatattaaaagaagagtccatataagaacccaatacgagattaattaaaattcggaataaaaataaataaatccgaaattggcaaaagaaaataaaaaataagagttcaagtaggaatacaattctaaattagctgaaattcagaagtaaaaataagcaatattgaaagaagaatccatataagaacccaatacgagattaattaaaatttagaataaaaataaaataatatcaaaaactagaaaaaaaaaataaaagagagttcaggtagaaatacaattttgaaacaactgaaattgaaaataaaaaataaaaacattaaaagaacacaatacggtattaactatttttttaaaaaaataaattctgaaattagaaaaagaaaaataagatttcaattaggaatacaatttataaataactaaaatttgtgataaaaataaagactattgaaagaaaaaaccatctaaaacacatgacgagataaattaagtaacatgcctataaaggagtagagtggtggcggttgatacgacatataaaaattgttaataaaacatgaaatagaatcctaatgacgattaaaaggagggatgtcaggcaagccgtgaagcaaacaagtaagacggttgccgggacttttataagtaaaaaaattaaaccccattgataatcatttcaatttttaaaatctcaatgacaataaaaaggagaagcagcgtgtggggtgtataagagtatagttgcagagccatcgacggttgacgagacttctagaaaataaaaaatgaattccaatgatagttatgtttaatttttagaatcacaatgacaataaagagtaggtggcggatgggatgttgaggtgcgtagtggcatcgtttgataggacttataaaaattataaaaaataatgaaactacaagtccaatttttaaaggtttgtaacttctaaaaggtaaaaaaaatgataatcatgttcaatttaaaaatctcaatgacaataaagaagggaggcagcgggcgagccgtagaggagtacaatggcaaagccgttgacggtttggcgggacttctagaaagtaaaaaatgaacccaaacgataattatgttcaatttttaaaatctcaatgacaacaaagagaagagacagtggacgggccgtagaggagtataatggcaacgtttgacgggacatctagaaattataaaaatgaaatccaacgtgataataaactctaaaaactataaaatacaatttttaaaggttccaagaagaatgaatagaaatagtgatagattgagcaagcaaataaagaagaagatgacataaggggtagcaactg

SEQ ID NO: 49393 - DNA, 1042 bp, Oryza sativa
agcggggagagggcctgctccggtcgtcgggggccttgggccaccgtccggctcgggggcctctcctccctgctctctcccgggccaagccagcacagggtgggggtgcacggaatgaagattgtcctcatcgcgctccacgatcaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagtgtttgaggagcttaaataagggtagcgccttctctcccagccttgatatgaagcgacttagggcggccatgcaactggtgacgcattgcacatccctaagcttgctgggggggcgcatccgctctatagctcgtatcttctcggggttggcctcgatgcctcgggcagagaccaagaacccgagaagcttgcccgcaggtacaccgaacacgcatttatcggggttcagttttatgcgggcggagcggaggctctcaaaagtttccgctagatctgaaagtaacgtttcctggttgcgcgtctttacaaccaagtcatcgacataagcctcaacattacgtctaattggctacccaaagaaattcgagtagtacgttgaaaagtaggacctgcattctttaacccgaagggcattgttgtataacaataagtttctatgggggtaatgaacgcagttttttcctcatcctccctagccatgcgaatctgatggtaaccagagtatgcatctagaaaacacaaaaggtcgcaccccgctatggagtcgacaatctgatctatgcgaggcagggggtaaggatccttaggacatgccttgttaaggtcggtgtagtcgatgcacatccgaagcttgccgttcgccttggggacgaccaccgggttcgccagccactccggatggatgacctcgcggatgaatccggcctccagaagtcgcgccacctcctcgcggataaaggctt

SEQ ID NO: 49394 - DNA, 2548 bp, Oryza sativa
  unsure (1)..(2548): unsure at all n locations
nnnnnnnnnnnnnnnnnnnnnnnnnnnnnnnnnnnnnnnnnnnnnnnnnnnnnnnnnccatgcaaacaggaaaagtctaggaaaaaattgcaaatgccataggaaaattacgtagattgtattaaatatctcacagacaaatagacttgggcaaacagccaactattacgcaaaacatgtaaaatgatgttactttattccatcatgttgcccctcaacataggcagctaagattctagcttaaaaaacataacgctagtcttgattacaatttgacatgttaaggcactcattctcgatgattgtgaaccaaaacagcaagctcctggtaaaatctttcaagaactagcaagtcatgtgcctgcagaaaccagatgtcttactcaattgacctcaattcatcaaaaaaaaaaagaaaacttaacaagcgaatctactcctgtgttttggaggattcgtgtgtgaaagagctacaaagtatgaaccagcctcttccttgttctgggctgctaatctggaaaggttcagtccaagaaaaagaaaaaccccctctctcggtgggcaaggtcctccttttatatcttaagaggataccacatgcaccatttccctcttttttgtggggacctcccccaccttttcataaatggacggagatttgtatagttgccatccgagtcaccttctgatgggacggcccacaactacccccactttcgccgggagcagatgcgacgtggaatcgtggccgcctgctgacgacatgaccggagtcagaccagtcacgtcggtcattcttgtccaccacgtgtcagcttagcaatctacatgtccgcccttcttcacacaacatcttgcttgtaatggttaggatgaagcctggcatatatctgatcagggctaacgtgccatctctgggaggtaacacgctagctccagctggggacgagcgcctagaagccctcgtcctgacgggatggggtgaggcgtgtgtcagatcgcctgtggccacctaacccgcgatctgaccggtctgtgaaaacccggcagtccgcgaggtcataaagggaagtgttgtggccggtgcaccacttgccggttgggcgctccctgctgggagcgccggcctctttctttttgtcacccgcaggcctcccctttcgggtggcccgcggagcgccctcgacggcgaggacatgaccctcgtcgtcggtatgggctgacctcttcttcctcctcctatcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtattacggacttgacagaaccgctgaatgtacgagcgaagtgactcatcatcccttcgctcgtactgagtgcaagtccgcttcctcaccggggcgcggatatgcgccttggaagttcatggtgaactgttggcacaaatcctcccaagagtggacagacgcgggtggcaagttcattagccaaccccgcgcctgttctttcagggccatgggaaagaaattcgccatgaccctgtcgtcacccccggcggcatcgatcccggttgtgtagacctggagaaactcggcggggttgacgctcccgtcatatttttccgcgatggtgggccggagccttgggggccagcgaacattccgaagactcgccacaaaggctctacagccgacaccaccaaccgggggcacggagggctgattcccgcgtccgtgttgaggtgacactctggacgagaaagcgccctccgttgcgtgggcagcacgtcggtcaatacaccggcgctcgatgctggtgcgggcgtccggccccccacgcagatcttcccgggtcgaaggagtcgacgaaggagtggcggccgaatgcagaacaacggctcccgctcgtcgtgccaaccgtcttgacgacgcgaagccggtggtagcagcaccaaaggcattggtggtggaggaccgcccaccagcatttaggcgctgccgtgcagtcatgaccaatttggccacatcgtccagccaacgttgggatggagactccgggtcatggacgacggccgggtaacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctctacggcgtgggtttggctccccgtagtcaccgctcatactcggggagaggtcgtgnnnnnnnnnnnnnnnnnnnnnnnnnnnnnnnnnnnnnnnnnnnnnnnnnnnnnnnnnn

SEQ ID NO: 49395 - DNA, 3492 bp, Oryza sativa
  unsure (1)..(3492): unsure at all n locations
nnnnnnnnnnnnnnnnnnnnnnnnnnnnnnnnnnnnnnnnnnatgctagtagaccataacttcctgagtttgatcccagtttagcattgacaagggttgacttgaagtcttgaagtacacgcccactaactaatgctctcttcgtttcatatataagtcgtgttttgatatttttttactaaacaaacttatttaagtttgatcaaatttataaaaaaataataacatctataacatcaaattagttttattaaaactaataatgaatacattataataatatatttgttttgtgttgaaaaattaatgttactatattttttccaaagcgacttgtaaaatgaaacgaactagctggatggcctgcacaattgcgcggctagcacctaaaaaaatcacatattttttatatgattttacttaaaatttattagatagctatcttattgtcttaagactttgaaagaccaacccttatcatcctcgtatttctagtttttaaaagtcacaccagttgctaccccttatgtcatctcgttctttatttgcttgctcgatataccactatttctttttattcttcttggaacctttaaaaattagattttatagtttctagagtttattgtcatgttgggttttatttttataatttttagatgtcccgtcaaacgttgccattatactcatctacggcccgtctaatgtctcttctctttattgtcattgagattttaaaaatcgaacataattattgtctaggttcaattttactttctaaaagtcccgccaaaccgtctatggctttaccattgtactcctctatagctcgcccgctgctttccttctttattgtcattgagattttaaaatcgaacatgattattagtggttttttttactttttagaagtttcgaacatttaaaaattggacttgtagttccattttttatattttttagaagtcccatcaaacgatgccactatgcccctctacagcccgtccgccgtctactgtttattatcattgtgattctaaaaatcgaacataaataccgttggaattcattttttattttctataagtcccgtcagccgtcgacggctctgcaactatactcttgtgcaccccgcccgctgcttctcctttttattgtcattgagatttaaaaatcgaatatgattatcaatggggtttatttttttttttttactttctagaagtcccggtaaccgccttactcgtttgcttcacggcctgcctgatgtccctccttttaatcgtcattaggattctatttggtgttttattaacaatttttatatgtcgtatcaaccgccaccactctacttttttataggcatgttacttaatttatctcatcatgtgttttagatggtctcttatttcaataatctttatttttatcaaaaattttagttatttataaattgtattcctaattgaaatcttatttttctttttctaatttcagaattttttttaaaaaaatagttattaccgtattgtgttcttttaatgtttttattttttattttcaatttcagttgtttcaaaattgtattcctacttgaactctcttttaaattttctaattttggatattattttattttttatcctaaattttaattaatctcgtattgggttcttatatggattcttctttaaatattgcttatttttaattccgaatttcagctaattttaaattatattcctacttgaactcttcttttattttcttttgctaatttcggatttatttatttttattccaaatttttattaatctcatattgagttcttatatgcactcttcttttaatattccttattaatctcatattttttttattaatctcatactatgtctatatgaattattcttctaatatttcttattttttattcctaatttcagttgttcgtaaaatgtatttttacttgaactcttattgaactcttatatttgatttttctagtttctaaatctattttattttttattatggatttcaattaatctttaattgtgttctacatgaactcttctttcattttttattgtgttatttcaaaatcaaataaaaatccgtgcacatgccatcatgctattctggttgctgacgtgtgcatcacccaaatacggctcactgtgcagccgcacggcttgacccgctgcttcggatttccgtcgctcgctgctagcatctatcttcatatcaacaaaaacgcatccaaattactgttctatagtggttcgttgcccgctgctttatttatatatgtgtattatagcctaattcatctctaactctggttaattggtttaggaaatcggacaaaactcttttgagtccgtttgcatgtaaaggtcctagctagagattgattctaattctacacgcgtacggtactccgtatctcttaattaacatgccaagtttgtcttaaatctcagacattgaaatctatgcctcttacaatccaacggtataaataattcatattttcttcgattaacgtgggaatttctagcctccacggtgaacgtggtgtctttttttcgagctgtattaataatataatagataaatcgtattaatcgaagagtggagtaaataatccaatccgttacaacaatccgatggctaagcttaaaaggaggagcgtataactggactgaacgaccgctggtgtggcgtgtgttgttcctcgctctcctgagagtcctaagtcctgacccagattggaaccgggattattcacagtgagggtcatcagcggatcagcctgttgtttttttggctcaaaattttctcggatttttggcgttccgatacgtcaagcaagaggcccagatgtcgtcatgtgcgtgacgacgaaaggcagcgaacctgcggagcacccggttccgcgatgcgtgcgccgtatatgggcccggtttattcgccatcctattgggccggaccagtacagcccgaactgccctataacataacaagcacatatctatctcctcatggattgagggcctgcttggtacagctccaactcctaaatttagctctaggagttgggtctggagtggagttgtggagctgcctaaacccagctccacaactctagttcattttgtgagagagctccacccagctccactcccagttttggtggagctgaaactgtttggctgagctccagctccagaannnnnnnnnnnnnnnnnnnnnnnnnnnnnnnnnacatgtattgtataggtgtgaagactgaagagggagggcacccctgaattaataatcccttctgctccggatctgatttcagtaccaatcagcaaaacaacaatctgttggtctgaagatggattctcaggctgttcgctcatgagaatgctaattcacgcgcgtgttgnnnnnnnnnnnnnnnnnnnnnnnnnnnnnnnnnnnnnnnnnnnnnnnnnnnn

SEQ ID NO: 49396 - DNA, 724 bp, Oryza sativa
ttgtaataattaaaactcaattaatcacacgttattactacctcgttttgcgtgaaacacttgtttaggagattcaaacaccatcataatctatcatagtggaaaaagtaaaaaaaaataatcaaagtttgtaacgactaaatacgaacaggagcaattgaaacgagctactgcaactgccgccttttctgtaagaataccgcaactgctgtcgtcttccgtttagcaacaaccgttttaattcaaatttacctttttccgagaacagctcgaaagcacatagcgtatcggcggttgcttgatactcacaaagtcacaagtacagccacatttcggctacagaatctgatccaaaggcagatacagagcgtatgcacgtatgcgtgcatgtggctgtggggtcgcctcaactactaagaaatcgaaaggtgtggatgattagagctctctccattattacaggattagctatttcatccactaattaattgctcttatttgacgcgcacacgtagaagttcagaaggtcagaatacaattagtttctgaacatctcttgttcttctgaagtctgaactgtactgctcatgcgtgcacataatgcagcttcttcccccaaacacctcaaaagctctgtttaactatgcagcacgatatatatgattatgctctttgccacgaaaaggggtgcgtcgcatcgaccgggggatcctctagagtcgac

SEQ ID NO: 49397 - DNA, 800 bp, Oryza sativa
ttgcttttgtcagtcgtacatgagacgcttgattatgtgagtcttttacccctatgccattaagaaagttgctgcttacctgtgtgccacaaaaaagtttggagttacgtgtatgccatgagcccaactttcgttgactcgtgtgccattttggatgaatggagacataacagaggtgttaggggctgtgtaaagacagttttgcccttgcagccccaccttcttccggcacgccacgcacctgttcggcttcgccggcgccgtcgacgatgatgcggcggcggttgcctcctccttccccttgagcgacgacgtcgggcgccgtggcggccggagtcatggggacgatgatgttgggagtggaggcggtggcggtggccggcgacgtccccttgaggtggtcgcggtagcacttggagcacatgttcttggtctccttgctgctgaagaacccacagctgctcgcgcacagcgctagctgctcgtcggcggcgggggcggccgtgctcgcctcctcctccttgttcgcgacgtcaggcgccgcgggggcaaccgccgctgacgacgccgcctccttgagttggtcccggtagcacttggagcagaggttcttggtcgcctcgctggcgaagaacccgcacccgttcgtgcacataggcgcgccgccgccgcccgccggcgctagctagcccgatgctacaagtggtgacggtgtaaccgcgctccggtcaccggagagatcagtcgtcagccctcgcggccggtgcttgttgaagagatctccgcggcctgggcgcacg

SEQ ID NO: 49398 - DNA, 2989 bp, Oryza sativa
  unsure (1)..(2989): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttagaaaaatagcagaacactttctagaagagatatttcagtattttttcacatagtcaacagtagaaagaatgagatgcctacacgcattgtcttcaaagaaacatatattgtacccattggaaaattgatcagttactgaccagcgaattagaaactataaaatcatgctcaatcaccttgagctctctattggagaactatgtctctgcttcctcttctttttaaggattaactgaaagtaaatataaactttgggctgcgaagatgacaagaacctctattttctgtaatgctttagttttgccctgaacaatgaacaaattagcacaatggagtatattgttaatgaaactcgataaagaaaataatcagcttatcccttgtagcaaggttgggttcaccatcctgattgtgcagcagtaagtgtaatcagatcattaacaggcattgttaattcaaaatcaatatctacccttaaatcttgaaatgttcctgagccacaaaatcataattagcttcaatttggatagcatatcaacgcatcagtgctgaagggtacatagttttaccttaaaactggagagggaatgaagttcataactatctcctacaacacacatttttatttagtggtaattcatggttcttttagttcataagttgactagttgataattattaggatttactgattcatgaaatacgaacacatgaatccataaaaaacattcctaattactacccactttggtcagaaacttgtggaactttaagtatcaaaatctttttcaatatttagattggaaaataaaaaaaacatatatgtagaatactagagttttcttggtaagtttcaaccaaaatactgtatttctgcgggactctataaatattttaaaatagaatcagttgttaaggttctgtgtgggaactgtgtcaatgtccaagacaatgtttttgtctaaccatgtaatgtatttatgatcacaattttgttacatattccttataccaatcctttaatttatggctaaatatttcctgctctaacaggaacttggagggacaaccaccatgatggaaagagagaaggcttccgttcaagagttaatgactgttgtgaatgaaatgatgcgaaacacagaatttgctattaggtcatatatgatgctgagaccaagatttatccgtccaggtgctggagcaaatggtggtggctcaaatccttctggtcctgctggagctcagtccaatcagccagtagcattggcttcaaccattgatttctatagtggtatcccaaagcggccttcccattttatgcaacagactatcaacaggtttgagaaatatcttggagaatgctgcaagtggatcgcggagctagagcagcttgttcaaatggagaacaataaaaggcaatcagcctcattagaatctctaccgaaggttatgtcgaatgtgcatgattatttcatctatgttgcttctaaggtaaatctcctttttcatacacacactgcagttgaactgttaaaatgcatttattttgaggttctcccccatgatataaatcatttattatgtaatatagtcataaaaataaatgtaaatctgtaagtcaaccaaattttttttgtaacagctgtatctcgtgaaaaaaataagagagattgcttacttttaggcttgctgcactgccttggtgcgatacccagtattttctaatgtttgtattttttttaggtggaaaatcttcatcaatatgttgagtcattgaaaactgaatatctacatgagcagcggcgattgggtaatgccaatgatccatttttagaggcaaatagacgagaagcggctaaacaagaagcagctgccagaagggtacatccaacattgcatttgcctgctcctgtacagcccacaactcaaattgctggaacagtgacgagtcaaccacagcaatcattgattccttctggagcgacttcttcaagtgcttttccatcattcagcactccagcttccgctccatcttcttcaagtctcttttcaactccaacaactccaactctatccagcaacctttttggtacatctggatcagcccagctgtccacaccatttgggacagtctctactccaacgcttggatcaacgccggctccatctggatttgggaatacaactccatcttttgcttcaacgcccgctttaggtggaacctcactgttttctacgccgttcggaggtatacaaactctcaccatactatatttatatttcctaactgttagatagtcatatgcttatgataagtcagtagctatctgaaaacaatttggtacttttatgttgtgaaattctcattttagatgatctcgtcatggtatataaacatttctgaagtgttggcacatctacagtttgatttcatcatggcaattcatagctctaaatttgttgttatgtttttggtctgaactgaaatttgttattggcagcagagtacacttagttgtccattatttttccaagtgggttatatagctcaggcacacctgccgtgcatgcccttcactgtttctactcatctatggttaccgtccatattgaaattcaccagcaatattcttctttttatcctacttccaattgaacttacaaatatatcttttcctattctatacatgctatgatatcctgatttttggaaattgcatgacattctaacctgtgtctaccttaggtggagctacagcttcaggatccagctttggtggtacatctgtaagtataatctccatcaatttatgcagtattcttcccttttcagctatagcannnnnnnnnnnnnnnnnnnnnnnnnnnnnnnn

SEQ ID NO: 49399 - DNA, 3707 bp, Oryza sativa
ttttttttggacggagaggatggattctttcagtcatatgaatacagatccctttattccaaatcatgttactgcaaggaagaaactcactcgctgttccatctgaaaattaataaactactggatttgctttccataccgagctatgaggtgtcctgcccaatcactgaaacccccaactccttcgaccgtgacagtggaagtttcagagaagcatccaagctaaccacatgtagaaataggtcagcattagccatattcttttaggtgcaggaggcgattatttcagtggcgttaagctgcttgtgctgtcgcaaaccacaggggatgaacggagacggttccacggcgtcgttcgatggcaacagcaggcagggacacagctcgtccattttgacttttttgattgctttggagtacggtcttgttttctcaatcgatagatcaaataaaatccctatcaggcaagcgccggtgtttttaacctaattgcattctgaagtcagtctctaggctccagtccaccgcagggtttacaatattgatgataactgcttagttgttgcggttatttcgagttatgaacgtataaccaaaaaattgatagtattaaaaatggtaaaatatcttaatatgtgtggtaaatatcagtttacagtactaatgatagccacgtgtttattgcggttattctgacctgttgaccgaaaacgtatgggtaaaaatttgatagtattcaatagaattattatgtaaagatatcttattgtcgttggtaaatatttattgtcccactctttacctttaagcgcaactcatttttaaataaaattttggtaaaaaggatgtagctatgcaccacactcttcggcttgcgtcaatattctacatttcacctaaatttattgtgcatactcaacgtctcccttctcatacgcccctcttaaccgtaaccccgttttcgtagggcattgatggtactccaatctatcatccaaattacttcatgacacatgaaactaacagaagcaccttatcgtattcacttcgtttttttacaagccaaccacagtgccatcaccactcaactaatttatctttattctgttttttttattttcaaaaattatccggtaaatccatttccaattttctcgaatatgtaaaagaactccaaaatcatttctccaaagttcaagggcctctggcctccacctcaccaaacgccgaaacggtgaggtgaacaaccacgcgtctataaaaaacacttgtctcctccgccttccaccttctctcttttgtactcgctttcgcagctcctcttccccggcttctccgttgaccgccaccggtgacctccccgccggggaggtctccctcgccggaaacccccccgcctcccaccttgtcttcgcggcggcgttctcccgtcatctgatcggccggcgcctttggtcttcgactgcttccgggggctactcgattcggttcctcttgatcccgctacggcttctcttgttgctcgccatggcgaaccgaatcacggtgtcctactccggctacgtggcgcaaagcctcgccgcgtcgctcggcctgcgctgctcctccgcctccacggcggcgggctaccgcttcttccaggacggcgggtggcgccccttatgcatgctcacctccttctcccccgggcacgccgagcaccaccggaacggcggtgggggcggcgaacaccgccgtgaagccggggaagggcgaccgcccgaaggccctgccgctttccgccgccgcagggggccactcgctgttcctctcgccggcgtacgcttcgtccagggcgcagccgccttcgctgcccgtgggtttgctgtcggtgctcgcgcagggggcgacggggtcgaagggtgggatctacggcgccgcgtctctgtcgggctcgtcgtcgtcgatctctctcgggttcaaccctgcctccttcctccctttcctgcagacctagaagtggctcccctgcagcgaccttgccacctcctcgtctgcgccgccgtcttctccttctccttctcctcctcctcccgcaccggcgccttcgattcgtcccaagaaggcgttggtgagtagtgcttccagctccccggcgattgcgaggagcagtggtggtagtggtgccgcgatgagcaggagcaactggttgtcgaggtggatgagctcctgctccgacgacaccaagacggccttcgcagcggtgactgtgcctctgctctacagctcgtcgctggccgagccgaggtccatcccgtccaagtccatgtacccgaccttcgatgttggtgaccggattctcgccgagaaggtagagcttgttgaaattggtgtttagtttggtaatcttgtcttgctgtgctatgttttgtgagtgtctaattctatgatgatcttcaggtctcgtacatattccgggagccggaaatcttggacattgtgatcttccgtgcaccaccagctcttcaggtataatttctgatttctataacatgttttttcacatacttcataatgatcttgatgtaaatgtgatgattgaattggaatgctactgcaggattggggctacagctcgggtgatgttttcatcaagagagttgtggccaaggcaggcgactatgtcgaagtaagcatttacctcaatggtagtggcgtctgtttgtctgtgttactaacttgctatgctgcaaaatgtttgtattggttgggttataattgctgctctctttgttctttgataggttcgtgatggcaagttgattgtcaacggagtagtccaggatgaggaatttgtgttggagcctcacaattacgagatggaacccatggtatgtgtcttcttcctatgctaaattgtgtgcatctttccatgattatactcatttcgatcttgcatagtagtactctagattgagcagattcttattgaaatgtttgatttttatcactggagtaaactaatgtgaaatttgacaatcaaaatgtagaattttagattgcacacttgagtaatcaaagtatcaatttagctgcatttccagagtgactgatctcctggaccagtgttgagttcacatattagtataccataatatccaatcgagtattatatatttcttaggtttattaattagcatttgtaattcgtttggcatattggttcatcaaatgcagttttagcaatataatccttctgttttcagttgattaatagctcattattgttcctgcagcttgttccagaaggttatgtgtttgtgctgggagacaaccgtaacaacagcttcgattcccataactggtatggtcaaaactaaactcaaatctgcatcagaagctttcatctcatagaatatgctagatctgattcgaatcaaatctgacatttcagggggcctcttcctgtgaggaacattattggaagatctgtgtttcggtactggcctccatcaagaataacagatacaatatacgagcctcgcgctgaatattctgtggctgggttgtcgtgaggtgtatccagaccttctggccatgctggatagccgatgtgtcatactcttttgtggagctccacttatgagccgagctccagttcacagctctcactggtggttatagaggggttggaaattcactttggctgaccaatttggtttttcaac

SEQ ID NO: 49400 - DNA, 4148 bp, Oryza sativa
gatctatgattgtttcttgtgggtctcattttactggaattatttcatatgcttgtcgaaatagccgcttcctttaagctgtactgttgcttagttgctgctgttgctgtaatctgtccggcccgaaaggctttctgaaaccatgaacctttaacatcaatatatattgaaaatgatactatgtttgctttgtattgaaaatggtactgtgtttttgtattgaaaatgttactgggtttttctataaagtgaatcaaacttaaataattttaaccttataaaaaggtaaagctttctataatatgaaatatactaaagtgcatagatttaagacgggtagaccaaaaccgaaagaagtcaagaatcatgattgatccaatcccggaagaactgattgcaatctcgacggatccaaaacagggatgagcttgcaaaatttacgaccgcgagcaatggtagcgacccacagtttcaccttccctccatcccaaatcttattccagccccatcttttcgcttgtgcttatgcttattagccaactttaaattttcaatattaaaattagagtttgaccttaaagttttctcatctaagtttattatgtagcctttacttttagatacttaagaacacgtatataaaaattttactcacaaagtatttttccgttacaaatataccgctggtttattcagccaaacaatgagtccgaaggcggcggaactcgccggtggtggtgccgcttcgcgccgccgcggcacgacgtgtcgacgtcgccttcgccctccttctccactcacccgacagaccacaccgcaccaccaccactcgtcaaccccgatccactcgatctctctcaccatcctgtggcccaagagaagaaaaagcaccggcgaacattggacggcatgaggcagatcgagctttcgatgccaacaaaacaaacaccaaacttttttcgagctgaaaacacaaagggggagaaaggccaacaaagttgtgacctgatgaaaagagtggagggctctcgtctcagttcggcaaaaggaaaggctggagactgaaaaagatggcgggaattgacatggagccaactgggaatccacgaaggcacgaacggaatggatgccagtagcgccactaagagcaggtacaatagcagaagccagttgcaaatatattttaaggaggataatgaggagagagaagagcagtgggctataaatttgtagctagatgtagcacggactccaagacgcagtgtatatatgacaagtgagactaggtattaataatgtagtatgtaactattgtataaataagctattagtagattggctataaatgaattggagttagtagttgactatactattaaacttgctttaaatataccaccagccgcaaaagttggtgaatgtagtattctgagcctgtgttcagtagcaacagaattggctatctttatgactcctttgttgcaccttatagtttagtgtgttaactttacagatttagcacataccaggatcttttctcctgtcgttacattttgcttaatccagtcatccagataatcacaccctcctaaaacgctactcctagctacaactttgtttatttctgggagtgctaagtttcgttcacgtttcattgcaatctgaaacagtaatacgcaaggaatacctggatcatacgatacgaatatctagagacaaaacatgatttgagtgattgatgatcgagaaagaagctcaaaaggtcttgaaaagtcgaaacgtccatcactgaaattcggtttcatgccctcagatcccattgctgagtaggacgcagattttcttccttcctaccatttcctttctcttgcttcctttttggtcatttgagatagctttatccatcctttagcaaaaaggaaaccaatagctagcaatacttgccatcatatatacctgggcaatggccggccaagcaaactcagttctctacattgaacacttcaggtttgagtagacatggcctctcggtgtcttgttaccacaggttttgaggatgagtgcagagagatccatgatgcgtgcaaccagccacgccgtttgagcgttctcttggctcatcggagcccatcggagaggcagaaaatcaaggcgacttaccgtacagtgttcggcgaagatctcgccggagaagtgcagaaaatcctcatggtcaaccaggaagatgaggtaagtgccctctcggttttgcactccttgcttcagactgattttcaagttcttacctctccatgatctttcccttcccagctctgcaagctgctctacctgtgggtgctcgacccgtcggagcgcgacgcgatcatggctcgggacgccgtcgagaatggcggcgccacggattaccgggtcctggtggagatcttcacacgccggaagcagaaccagctcttcttcaccaatcaggcataccttgccaggttcaagaagaacctggagcaggacatggtcacagagccgtctcatccttaccagagggtagcccttgcttgttgcttaccattctacctcagtttccaattgtgttctttaccttttagccagctgagctcaactcctcccctgctttctggtgacaattcaagcagctattggtagcacttgcaacctcccacaagtcgcaccacgatgaacttagtcggcacattgcaaaatgtgacgccaggaggctctatgatgcgaagaacagcggcatgggatcggtcgacgaggctgtcattcttgagatgttcagcaagaggagcatcccacagctcaggctagcattctgcagttacaagcacatatatgggcatgactacaccaaggtaagcaaactcaataacctgatggcattcacttcgcatacaacattactgaaatgactgccttcggacgttatcttgaaacaatctgccaaactactgaaatgatgactgttttctgagcttatcgttgcaacaatgcgtatgcaggcactgaagaaaaatggcttcggtgagtttgaacaatctttgagggttgttgtgaagtgcatctacaatccttccatgtatttctccaaggtgatggcagctgaaaatttgcagtttgtagttggtacttcatatcatgtctctgacccatccttctatttctttgtctcgtcagctgctgcatagaagtctgcaatgctcagcgaccaataaaaggttggttacaagggctattttgggcagtgacgatgtcgatatggacaagatcaagtcagtgttcaaaagtagttatggaaggaccttgaggatttcatccttgaaagcttgcctgagaatgattacagagactttcttttaggtgcggccaaggggtcaagggcctcatgaagtctgtggagagagatccttgaattatctagggaaagtaaagggtgcatatactgctttgcatgtaagagcaaattgaccatcaaaaacagcagttttatgttatctgagaataggatttaggtgagaacatcatgctcattttgtttattttgggtgaaaaaagttatcagttcaactaaacaattgttttgacatttgtgatggcaaaatagccaagccttatcttcaatagataaaacatagaagtagggtacgcatgttttggtggactacgttacagatataatttcagatgagcttcttctttcggaagtactgttgtagatgccaaagttgcaaaactgagactataatgcaaacaatgagtgatatgatgctcaaccatgtagccctagcattcgtcttctcactggtatctctcatatttgcttctctgcattgagaacaaccttttaagactatttatgcccttagttatcgatcaaattaaaatccatggatagctctttgagctacaaaaggaagtgtacttacttggatctcagcaagagcaggttttcatgtattgcttggacagaggtttcaagcttgactaattctagttcaactccctgttcaggaatgttgttgttaaggaggaataacaccaaaatgcagaacataagcataatatcctaatttcatgaacattacctcgagcttttcctttttagcaacagaatcccaatcttttgttgcaatgcc

SEQ ID NO: 49401 - DNA, 745 bp, Oryza sativa
acaaatgcatcagactactacagtcctcctcaagcaaaccttggcaggggtaccgaatctggagcttatgggtatagctcttcgttccaggtggatatggttgcaacggacctcctcaagcaaaccttggcaggggctagccatttcggggtcgcaaaaggaaaggaacttcgttgcagcctctaccgtctgtcaattaagagacggacaaactatcctcttctgggaagatagctggttgcaagagggttgcattcggtcctttgctccgaacatttatgataaaattccaccacacgtgcgccggcgtcggacggtggctgaggcactaacaggtcgccaatggatcaaagacatccgaggagcacttgggatccaacctattctagaatatctaaagctttggtcgcttgtccaaatggtggatcttgatcctactactcctgattcaatcatctggaaatgggagagttcgggccaatacagctcaaaatctgcctataaggccttgttttttggtcgtgtcgcctttctttccaccccaatttggaagtcactcgctccgcctcgatgccgcttcttcttgtggttggtcgcaatgaacagatgctggaccgctgaccgtctgcgcagtcgagggttgtcacacccggatcgctgtgttctttgcgatcagcaggaggaaagcattgatcacatcttggtagcatgccctgaatcgagacaattatggtggtggacgctt

SEQ ID NO: 49402 - DNA, 1465 bp, Oryza sativa
attacaaaagtgcatatttcactatgtgaaaggaaattcattaattaccaactacctattacattcgcttcaaattacttgtcattttaaatttgtcttaagtccaacaataaaaacttgaccatcaattattacaaactcatatgagtttaacatcatgagatttatatttttatattcattacgaaaaatacttgcatatatataatttacatgtttttaaactatagaaatttctaaaattaatgataaaaaaataaacatgtttgacttgaattatccacagtaggaatttcgttaactcacttctccatacggtgcaattgtttgagttcgctatcccaacttccaaagtaatcgtccgtcgccgcctgccaattgacaaaggaaaggggaaaaaaaaacaccgtcctttgttcatacacttcattgtgaagtgtgaacgtagcattttctgaggccattaaactagtcgtctctcctcttctttgtttccctccacagcagcttcggttacttcgaaccttccatccataaatccttcctttctcctcataccagaacgcatagcggcataggacgacgagctccctacacagacgggagagagagagacagagagacgagggagaagaggatgaagcccaagaacggcggcgcggccgcggacaggaggctgccgccgaggtggatactcctctgcgcgttcagcttcggcctcggcatgctgttctccgaccagtgagtgatcgagtcgatcccctagccttgattagttcagttcagccgtcccccgtgttggggtttcaggtttcttgtgttttgctatcgccatgcggccgtgcgcgcgagcgacatgggagagagtgctctgctttggtgcgactgatgtttggatgtttccggtgatcaggtttggatcggtgccggagtggcagaaaccgttggcggcgcagcgccgggtgcaggacaggaagctgcagatccttgatgaagattttgttgccaagccggtaaggctgactaacctaacctatgggactatgaaccataagtctttgcctttgcttctacctctctctgttttttctagacgattttttcccctaccatattgcaatcttgttatccccggaaatatccccattatcgaacaattgatcatcttgttttttcagacattgttgtttgtaactttgtagtgtcatgatccatgagtgtcttaattaaaaataataccttttcctgtaaaagtttggccgtattatcatgcagaaacagctgtttcaacaattaagcactcgcaaggcaccccttgattgcacctcttttacatggtagtacctggtttgtaataaaaagaaaaggaaaaggcaagttttttaaaatgaaaaaaaagaaagaacataaggttgaagccagctgttttatatgaatgcaatgcagagtagagttggctatctga

SEQ ID NO: 49403 - DNA, 2048 bp, Oryza sativa
ttgagactaatttggatagcgttttctgttcagatatctagataagtccattgccactctacaaatggagctggcaggtaagcgcagcacactcgagctacttggcaatggaaatggtataagccagcaaaggaagaaagcttttgtagtgattgggatcaacactgcattcagtagcaggaagcgtcgggattctgttcggcagacctggatgcctcaaggttcatacttttcaatgcaacacatagtactgcaatgagacatggctatttgcatgctttactaactttactggatttcttattcatagttagaagccatgcagaagatttgtgcatttgatcaaagtagaacgatcgtgcacctaacctgctttcagaaaatgatcatgcagctaacaaggaaatatagaaaatgatcatgcagatatctagtcaaataggaatatttatcatcatataagccttctaatataaaacaaatgcagttgtacctttgtcacctgcacaatttcttttaaatttgagcctttccgatgaatgaatcattttgttaggcgacaattgtttgtattttgctgtgctcctgtactcattgcttgtaagactaatttcatatctcccactcctattttcaggtgaggaactcaagaaattggaagaggagaagggaatcatcattcggtttatgataggacataggtaacatcatctgcagtttgtttcattattcgtaatacaaacaaagattttctagacatctctgtagtaacctttccgttttaggggcgaaaaaaaaagtactggacttgtgattcccagattagactgtagttagtcattttgctcaaactcgaaaagacagatttttcattgagtagctttgagctctagtaacttcataaacaaacagtgaactaatggctggatttgaaatttcacagggaccattaaaaacttatattgtttattaggaaatgcaaaatgtgcatacaacagctcatactgcacataattgatttcaaaattcttgctagaggttcatgggattttactacttatttctcagcataatgaatacgaatgcatcaactaatactaactactttttatgtattacagtgctacgtcaaacaatgtgcttgataaagaaatagacgcagaggatgccgctcatcatgattttcttaggctggtatggtgacatccaccaaaagtagaagcacatcattctttacctatttctgttaaaccaaaatctgttttactgtgattggggctgtagtccatactaatgtttattctgctgcaaccacacatgtatgtaggaccatgttgaagggtatcacgagctatctgcaaagaccaagatattcttttccactgctgtggcattatgggatgctgatttctatgtcaaggtggatgatgatgttcatgtcaaccttggtaagctttattatttagcctttgaccttgatgagagatttgttattcagtaattaactgatgggagtgatgcaggaatgctgatcacaacccttggtcggcataaattgaaaccccgggtttatattgggtgcatgaaatcaggaccagttcttgctgacaagtaaatattctggaaacaacataaaactacttctggaagctccatcgtatgaaatctctagatgctaatattcatttttccctgcatctttttatcagaaatgtgaaataccacgagcctgagttctggaagtttggcgaagacgggaacaagtatttccgccatgccactgggcagatatatgccatctcaaaggaccttgccacatacatctcgatcaaccggtaagcctagagaatggctgcacatgattcttcagacaaaatattcattttactgaattgttactgatactcttgtgtcccaccatataacccaggcctatattgcacaaatatgcaaacgaagacgtttcacttggcgcatggtttatcggtttagacgtggagcacattgacgacagagacatgtgctgtggaacaccaccaggtcagttt

SEQ ID NO: 49404 - DNA, 1804 bp, Oryza sativa
gaattatttggcccccaccaataataatctcccacatgtttcccgtaatcatttgggagagatagatagatatagatcatgttaataatcaccgttggtcccgtcccgactgatgagtcccgaccgaacagacatcccattctgccaggcagcagccagtcacgtcccgtagattaactattccgccgcgttcatcaggtgttgcgcgcgcgaaaacggcgaattcaccgcgcccgcgtcccactctaacacctgttcaccgctcgatcgggcgattcggcgttgcccgcaccggcaaaaactacgtgggggctacgtacgcgcgccgcccggtgaatagcctcccgcgcgcgcccgtgagatcgccactggcgccacacgttgcaatgccgacgtacgccacgcagcggcggctcagatcagtgtcgccgtcccaccacgtgcgcgcggggcgccgtacgtctccggccccctcgacgcggagaattctatggcaaaggaatggaggaggaactagcggacgcagcccagcgcgcgcgcgcgagcggcgaaccacccaaccaatctcgggggggcggattgcctgctcccgttcgattcgacggatcgcatggtcccgcgtctcgatgatttgaggcccaagggggtaggagtacagcttttttgactcgtcatcagcttcgatgatccgtcacgcgccgcgcgccgcgcggtgcagatctggcgagcgagagataagaggaagaacattccgcttacttttctgtagtgacatgtagtaccgtcgtactggtagtgtagtacggctgttaaatgaacgcacgaacaaatgtcggttttacacaccaaataggagtagtatcagtgcttcttccatccatataacgagatatttaactatttataactcttaaaagattactggaccatatgtcatacatatataaggattcacatattatagacttaaaagtggcaaaaagttaaacgccccttatataataaatcgtttaaatatttttctagttaaaatattttaagtttaattaaatttatagcaaaagatagtaacattatctccacaaaccaaacatattagcgtaatatattcaatactaaattaatgaaactaatatggtgttttagatattgctaagttttttataaatttgttcacacttaataaagtttaacttatagacaaatcaaaacaatttataatattgaacgaagggactagtagcaaatatgcatacttgtacgatgtactactacataggctaacaaaatggtagaggttgtagctcttacagtgatgtctgccgtgggggaaaaacaatggtcataggccgcgcacattgtgctggctttgatggacgatgatcctctcggagatggatcctaatcactccatggatatccaccagtttattatgttaactaaataactataaaaaaattgaaacaaatagattgttgtgcagtatattgtcagggttcctagttatgcacgatcgtgatcgaacctactattcggaatatcacaatcggatattgccatgggattgttgtgcacgatcgtggtcgaacccactattcggaatatcaagatcgcgcgagttctgatcgatggcggcagctcgattaaccttctcttcaccagcaccttggacgcgatggggatcccacgaagcgagttgacacccaccgatcaacccttccatggaatcactcctcagtcatcatccaaaccattgagcaaaattacgttgtttgtgactttcggccaaacaaataacttccg

SEQ ID NO: 49405 - DNA, 2670 bp, Oryza sativa
cccaaactgagctttacagcaaaatatattcttctataacttcatataatttgcataacaaatattctaaaaaaattacagcaaaacactatggtacaaggtataaactattagtgctttcactccatcatcagtacatactacatagtcatcaatcatcacataacagcaacacatatcagtccatcaatattcagtacttagagcgtacacagtaacaaagagtgatagaggtggagccgtggaggttgaggaacacctgctgctgctgggctaatggctgctgaaaggcgaggcatcgtgcatcggtggtggtgaggctgtccgcggtgtggccagtggccggcgtcatcggtgtcgtccgcgtcggcggcgtcggcatcgtcgcctcgtcggtggtggtggtggctgcgaaaatggtgggggcgaggaccgagcgagagagaggaaaggcggcgagacggcgggggcgaggtcgcgaggagcccactagccgaggacggcagccaggcggccggcggtggcgtgctcgaccccctggaggctggatgcgccgcctctctcgatctgtctctctcctctctagcctctgtagggttagccagttagggacctagggacttgggttgggcgggaacttgaggaggaattatggactatttggatgggcttttttttacttcggaaattccgacaaactttccggaatttttccgaccgattccgagttccgacggaaactgctattatcatattcgattccgtttccgagaaatttcgaccggctgattccgttttcgaaaacaggtccggaatccggaaaaaatctgaaccgttttcacccctacgcccagcccacctaccacagctgagtcacccaagaaagggagaaagacaaacaagacgccgaaactggacttcgcaatcaagaacgttccactctttagtgccaaccccgacaagaacggcaagatcggggcatcactaggcgagaaataggaactcgtgctcatcaccttcctccgggacaatgttgacgtgttcgcttggcagccgtctgacatgccaggggtactcagggaggtgattgagcacaaactcatggtgcgacccgacgccaagccagtaaagcaaaaactgtggagatttgcaccaacaagccatacgagaagagctcgacaagcttctcaaagctggtttcatcagagaggtactccatccaaagtggctagccaacccagtcatggtgcggaaggccaccgggaaatggagaatgtgtgtcgatttcaccgacctcaacaaggtgtgtcccaaggatcacttccctcttcttcgaatagaccaaccggtggactcaacagccggttgtgagttgttgagcttcctcgacgcttactccggctaccaccaaatcagcatggcgaaagaggacgaggagaagacaacattcatcacgcctttcggggtattatgctacgttaagatgccgttcggactaataaccgcaggaaacactttccagcgcacggttcagggcgcacttagcgaccaactcggaaacaatgtcgaggcctacgtcgatgacattgttgtcaagaccaagacaagcgactcattgattgccgatcgacgggaaacgtttgacaacctctgacgatatcgccttatgctcaatccaaaaaagtgcacgttcggggtaccatcgggcaagctgctcggtttcctcgtctctggcagaggaatagaagaaaatcccgagaagatcaaggcaatcgagaacataaagttgcctacaagactcaaggaagtacagaagctaaccggatgcatggctgcactaagcaggttcgtcgctaggatgggagagcgaggacaacctttcttcgctctactgaagaagcaagacaaatttgtatggacacaggaagccgaagaggcatttattgcactcaagcgctacctatcaaatccccctgtacttgttgccccctaacctaatgaagaattatttctctatatcgccgccacgccatattccgttagcactgtcattgttgtcgagagagagaaggtgcaacaactagtctactacgtcagcgaagctctccacgacgcaaagacaagatatccacatatccaaaaactactctacgcggtaatcatgacatcaagaaagctacgccactacttccaagcccacagggtcacagttgtatcctccttccccctcggtgaagtcgtgagaaacaaagacgttgttggccgcattgcaaaatgggtagtcgagctaagccaatttgatgtccactttgtgccacgaacagccatcaagtcccaggtactcgtcgacttcgtagccgattggaccatgcctgataacaggtcagacaaccaaatcgacaacgaaacgtggacaatggcattcgacggcgcactcaacagccaaggagcaggggcaggattcatcttgacatcaccttcgggagatcaattcaagcatgcaattcacctcaacttcggggcgaacaataacacagccgagtacgaaggactactcgccaagataagagctgtagctgcactcggagttaggcgactggtcgtgaaaggggatttcgaactagtcgcgaaccaggtgcataaagattacaagtgctctagccccgagtt

SEQ ID NO: 49406 - DNA, 2965 bp, Oryza sativa
ctgcagcatccaagtagggtgttgcaagctacagcctacaagaggctacttttttagtatcagccattgatgtacagcaccctggtagatgcatggagttatacattcatgattctaccgccacacagaaaatattatattgctatattgtaaaaggtctaatgaagtatctttaaaaaaacctctcagaaggattaatccaatcttttcttttttttttagagcatggaggacttctaaccatgtcttagcatgattttgataccctgtggcccatggggagttggatcctctaaccatgtcttagcatctgtttaaaagagtttttttagtggctacaacttcttctaaaatttacatctccgctatgcaatttaaattctcatctaatttgttagactctatatttataaaatctagaaaataaattaacagttagaaactatgaaacccaacctttttagattttcattactcccttcatgtcaaaatataagaacctagtcatatcggttgagatgcattctgtactatgaatctgaacatattcagcactatattattatattttaggatagaagaagtagatgacttagtaatcactagctgcatattataatctcgagctccacaaacaatgtcttaatcaattgatagtctcggataacttcaggcgtcgagttgtaccatcaaactgaggattttggaggcgtctgaacatgtaccaacatgcctaattgcctatcaaagtagtcctaatgatgcaacatcaatgtctggattgggtccaatcatgtctggccatgtcggttgtagaccaaatttgtaggaccctggactccagtggacatgttataagtacatcacataggtacgtagcaccattaagtgtgaccgtgtcaaaagggaggagctagacgaatggattgccacttattaacctgaagaaagtgtcttgtgaaagcacggtcggtgatgtcatcagtcatctgactgaaaatggttatggtactgttcagctagccacttgtgagtctccctccatcaatattgttttacagcagagatattccagcatttgttcttggactagacgtcttgattagggatgaaaacggtcggaaacgatcggaaaacagcctcaaccatttccgtaaccatatttttctcggaaaaggtaaagtcggaaacgaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatacataaattcaagcttatactatataaattataaattaacttcattttagccatgtacaaaagttagagatttattgaagagtcattcaatctataagctgtgggtcaagtatagacatgtcctataatatcgacatatttagaatacggtaattaccatattataagaaacggtaatttccgcaagaatacggtaaatacggaaatgataggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctagtcttgacgaacgaaaagttcatcgagctaggcagagtccgagctggaaatatgaactctgaatatagttacactgaatttgatacaatgtaatcacgtgaacaaccaaaatggatcatctaatttactgctctctaactttaaagtagctgatatgtaaatcacataacttatggtccacatgtcagcgacctatgtcagagaagtttcttcctatggacaacatagtttgaagccatttttatttgaagccttactaaaattttgataggataaaatatattagacagtttaatactaccaatattttatattagattgtctcaactacatagatttgataaaaagttgtatccaatcaaaacaactatcacgatcggagaactcatttttactaccggttaacaacctcttttattatcgattgtaacacgatctttagtaccgattgaaagaaccggtaataaagatgcgtactaaatcaaaaataacatgtgggatataggattcaaactcaagatctctcatctcaaccctcacacacgttaccatcccgcctactacacacatctaacttgaataaatatattttccttttaagctaaccctgaggcatctttagtaccggttggtaatattaaccggtacttaaaaatagctttagctagtccgagttggtggtaccaaccggtattaaaaatactaacccgcactaaagatcttttagctttagtctcggttagtgttatcaaccggtactatcttataggggcttgaatttttagaaccggtagtaatgcatctttagtacctatttttaatctaaccgagatatttatgtttaggggagtaagaccctctttgtttaggcttaggcttattggcctagacttttaagtcagtttattggcttatatgatttataagccagtggatttaatgtcctaagtttagtggtggagtcatacatctatctcatataagccaaaaaagcttctccaacctagcttttggcttaatagtgttagagtggcttatggcttcaaaaaagccaaataaaaaagttgcttgtttgttttggcttagactttttgacttataagttggcttataagcctaaacaaagagggcctaagataaaagatcgtttctagtaatgtactgctcaagttagcaaaaaaattggcaaggggcaacaaacaaaaatgcctcttccggttctttctctccctctctcttactcttttttcttgccaagcatc

SEQ ID NO: 49407 - DNA, 1090 bp, Oryza sativa
aaaacagctactagctgtttccgattaccagtttactttttttagaaaaacaaaggagaaacaaatttaaaggcaaaacattttcctttgcagcaatcaaaggcacatgtacatagttcatacaaattcaattttctgagttgccacaaaacaaccacgcgagcacaggacaactctgaccttctaacatcaaaggatcagggaaacacttttaattagttatatgaacatccgttcatttgttgtatgttaactaaattatttttatttttttaaaaaaattgacaagataaattcacatgtgaataatgtgatatgccactctataaacataaacatgtaagttcaaattcgacttctatcaattacaacaaaaataacaaatcaaactctaattagtacacatatatttacagttaaatttgatatttttattataacttatagaagttgaatttaaatttatatgtttgtgaagtgatatatgtcgacggggatatccgtagaccggatatagagggtattggtgtacgctggtacgaggatctacgtaatacgacatcaagcaggcagaaaacaaagattatactggttcaggccccttgataggtaatagccctaatccagttgatatggaattatatgatggaaaccacatattacaaagggaaaagcggaactcgatgataccgacgaggtcgtaatcgaacaggttcgattagatctcccggcgacttggctcctgtgggcttcaactccgtaggctgtcgtggatgtgttggctatgagattcgatgccttagatcctcccgggggtcccttttataccgcaggtcaactggtctccaagtaggactcggagacatcggacccggcacgatacaatgacgacccagttctgtccgagtaggactccttccatctgtgaactccatgatgaatttccttaacgtacgccgaaaacgtccgtatacgcgcaagtataccatatcgatatgtgacgtatatcgaaggtagagggtataccttacccgtaaccctgacagtagcccccgacttctgcttaaatgaactcatgtaactgatcgtg

SEQ ID NO: 49408 - DNA, 3357 bp, Oryza sativa
tgctcccgcaatggacctcgacaagtctacctccaccagcgcgtcgctgaagaaactacaggaggatggcgcccttcccggtcgcgggaccatggagagagaagcaggaggtattgaaccccagcctgtcctgggtcgcatggttgcgatcgaggactatattctctgtggttttcttcctccgccttctgaatttcttctcttggtcttgaatttctacggcctttctttgctccatttgaaccccaattccatggccttctcagtattttttcgcatctttgtgagacctacattggggtagagctgtttcttgacctctttcgtttctactacgagttgcgttagatggaatcaaacagggtatccggatgcgtcggtttccgactccgggatggcctgaagtcgtgctatatccctttccagtgcccttcctctcgtagcaaatggcgggcgaggtggttctatcttcagatagaaaattcggatccagtcttcgttgttcctgaggaacaaccagacaagatttcgtcttggaccgcaaaacccgccttaaccccttctcttcagcccttcatcgatgccatcgatgacctccgaatacgaggtttgtcagggtatgaagtcgctgccgacttcattggtaggcggatccagccgctccgggctcgagcccacccatcctttgactattttgggccggaggacgcgacccgggtttcttctcggggtatttttcttgtatttaaattgacttccttatgtgcgtgttcctcctgacttatcgaattctggttctcaatctgcaggtttgaacagcgaaaccatggagcgccgtgtcggccaattgatgatcagcggcgcgacaacggcgagcaaagtccccgtccccctttgtgagaagggggcagctgaacgcgaagctgccatcaatgtaagtgtactcagcagcccttttgcacttttcttccgagatcgcattgtgacttcataaagcgtaggctctccctctgactgatatcatcgggctgctcgtggattatcaggcggcggcgtcgctgaaggaggacgtcgccaaggaggcgtccgatgttgctgccgctgctgccacaacaagtggcggcaacgtttcgaaaagggggaggaaattctcctccgtgatcagaaatcgtcggaaggcgcccactccctcggtaagctttcctggtcctttatcgcgtagtcggaaaacttccacctcacatcatacccgttatactccaggcctcggatgcgtctcctccgcctccgtgacggcagtggcttgtgacgcttggcgagaagtaagtggatgaatttgaggttttgtcacttcgtcaaactcttgcagcctgtctcaactgcagccttccacaaggcggcgtgggcgaaggcggcgcaagacagatctggagggacctccagcgcgtctcctgctgtggcctcgacagatgtcgtggtcgtgcccaggagccgcgaggcgacgcctagtggcccagccagcgatcttgcggctggtcggggctcgccggctgtcgtcctcacctaggaggagctccaggtcgagatggggctcctccttgaggctggtgctcgcagcattagccgcgagatcgcggaggcgagggcggcggcggcgtcgtcggtgaatgagcgtgccgaccggctgacgcgtgattttgcggaggttcgcgaggacctccagaagatgacggagctggtggccggcaatgagcgacaacgacaagaactcgagcatcgtatgtcggagcttgagaacaacttgtcggaaacccgtggctcgttgcgggtcacctatactggtctgcaccagctcgccggggagtgtggcgtcaaaactaccatcccggcgaatcccgacgagttctcgctgacgtcttcgcttgcagaactggcgacagcgatggaggcgatccccctccaagcacgcggccaggatcggagaggagacgtccaacttgatctataccggggcatgccatgtcctcgcgtgtatgaggctggcacaccctgaactctatttgcggaagatcttggatcagggggcggctagcgacgcgcgcaaggacatgatggaggaagtcggcgatctgggggagtccgttctcccgctttttgaagagtaggatctttagtcatgatttgtaaaactctcattggttccaaccgcctttgtgtgtgcagtcaacaccttagttttctttagcatgttgatctcgagtactttgttgtcatttgtagagatgttgatgtcgaggatgtccagcagcgtgggcagcctgagttgccagtgatcgttccggcacttgcgttcaagccatatgtgccgcagggcgatgtagatcaaaatatgcctgtggaaacgggcatggcgacgacttccttaggttggttttttttttcatctcctttactcttccgtctggatcgacttgctttgttgtgttcttgggagagaagagcagtttgccttagtcatttacatgctgagcagacctcaagagtgcgcttgctgaccaagatcgccgcatccagtattggaggacgaaatttgaggtcgcggaactcgagaggattatgctggaagtgaagaaggatcaggccgtggaaacactccgaggtcgcgaggtgtggttcagctcgtatctgaagagttgttgcacatccatgacaagggtctgtagagagctccgagtaccccgtggggatcctgaggaatcggcggccggatacatctcgtggctaaatggggtttgcgcccagctcgaaggcatcggccagcgtatcgacgaggccctgaagcaggagtgccgtcgatcgagccgatatgccgggggcatgtattggcttgcatacgatatcattgtccgcagctgcacctcgagttcctccatgaagggttttctcgttctcggagaactcctacggagatagatggcctggcgaagtcgatggcgctgctggcggagaaggtcttccagtccatggactggcgttggccttcctggtagtcttcgtgtcctgtgacaaatgtcttagggaaaagtgtaatataattttggatttttacggaattgtaagaagtacttgtaaaataaaaaagaaatctatctaactaagctttcttactctggacatagtgtgtaagagtgtcttcttacttcgcaacttcgatcagtcgtttgagttatatactctccctagcccccaaccttgtcatcggagaattcttcttggaagataaggctcttggacctttgacctacctcggttgaacaagaactgatcctagcccccagccgtgaagttggaaagtta

SEQ ID NO: 49409 - DNA, 1295 bp, Oryza sativa
gctgatgaaagatttagattaggtccgaattagatccccggacatcactcttcagagcgtctagctagcttcagaatatatttggccttgcagcaggaatcccagcattgctcttttcaccgggaggcctaaaattttgcaggattcgcctcagaattcggcggtcacatcaagaatttctagccgcgatcgctgtggcctcgccggtgagttacaggtcgccaacacggcgatgccccaagagcattggtgcgaaagactgccgtgcagaaaaggaattttataaagcctcatggccccttttcctttcgccgttgctttcgtgcacagctttcgcccccgatgcgttcgcgacggaacggtgcaagaatatttcgaagccttttgtcaatgacaaaatcgtagaatctcttttggttctatctatctatatatataggtcactcggttgcacgagctgattaacggggcgttttggttaggagataattagacatgcggggggtttcggtggtgctcgtgctgatagcttgttggctgtgtggctgtccggtggccggcgaggcaaccttcgccggcgacatccgtgtcgacctgacgcatgtcgacgccgggaaggagctgccgaagcgcgagctgatccggcgagccatgcagcggagcaaggcgagggcggcggcgctgtccgtggtgaggaacggcggcgggttctacggcagcatcgcgcaagcgagggagcgggagcgggagcctggcatggcggtgcgcgcgtcgggcgacctcgagtacgtgctcgacctcgccgtcggcacgccgccgcagcccatcacggcgctgctggacaccaactgcgaccttatctggacgcagtgcgacacgtgcacggcctgccttcggcagcccgacccgctcttctccccccggatgtcgtcgtcgtacgagcccatgcggtgcgccggccagctctgcggcgacatcctgcaccacagctgggtgaggcccgacacctgcacctaccggtacagctacggggacggcacgacgacgctggggtactatgccaccgagcggttcaccttcgcgtcgtcgtccggcgagacacagtccgtgccgctcgggttcggctgcggcacgatgaacgtcggcagcctgaacaacgcctccgggatcgtcggcttcggccgcgacccgctgtcgctcgtgtcgcagctctccatccggcgattcttctactgcctcacgccgtacgccagcagcaggaagagcaccctccagttcgggtccctcgccgacgt

SEQ ID NO: 49410 - DNA, 1485 bp, Oryza sativa
tgaggctgccgttcgccaacgggagcagccccgacgacggggtgtgcttcccggcgcccgccgtgggggggggccgcgggaggatggcgcggcaagtggcggtgcccaggatggtgttccacttccagggcgccgacctcgacctgccgcgggagaactacgtcctggaggatcaccggagggggcacctgtgcgtcctcctcggcgactccggcgacgacggcgcgacgatcggcaacttcgtgcagcaggacatgcgcgtggtgtacgacctggagcgggagacgttgtcgttcgccccggtggagtgctgagagggcaccacgtgtcaactgaaaatcactgtagttatttttttttctttctactcctagttgactctttttcctgggccgtacgatatgcagaccgaatcgtggagcggtactggtgtcctatacgaacgacgagcgagcacacaacaataaaggtagccccttgaaaacacgtttaatacaggggttaatcataaaattttaaaccccaaaaatttgaattcaaatcatggttactgggtgaaccatccgtttcatatactcggcaattttaactttgatctagtttgatcacttctattttataaataaactggaaatatttaaaaatatattatattattggagtatgatatatgataaatataaaaatataccctacaccttgttaattataatcaaatgatttaaatataacattgctcaaactagagcaaacgcaagttaaaattatcaaatattatgaaacgaagagagagtacttgcttgctcgaataatagctattgtgattactcaatttaattttctttggggtttcacatcatttgcccacgaccttttattgcccaacgctgaagaagaatatgagtttagtttttaaaaattttaacgggtttttaaatctaggcctttcatttctttttgccaataaactacaatgataatatcaactcaaactcgtagtagaaccaagggataattatttctcctagtgatagaatttatatcgctagtaaaattactagaccttcgtaagatacaactaatccatagttaaatatatgccactattgattttatttttttttcaattctgaacactatttttctcctagaatatataatatactaataaaaatatatttgaaaaatatttataaagaaaaatctatccatttgatttttaagttttcaaactaaatattttgagctattaatggtcaagtttttgaccaaataaaattacctgcaacacatttaaatatgaagagattatgattttgatgtatgattagtcaggcggctcaggtctcaggcgaagaacttggaactctgatggagacatgaagcccaaggcttaaaaaaaaaacatacaactgaccagaacggtgttaggacatcactcaagtttgtattgcaaaaatcatagtatgattgtagcatatattt

SEQ ID NO: 49411 - DNA, 1585 bp, Oryza sativa
taggaggtatctctggatgggctcctcaaaatctgaagcaacccgatgaagatactacagcccacaatgggtatcttggcccaaagtaaccccagatgaaaaatccccaaataaccctcccagcccattcttcttttttccttctcttttcttccaccctctcttctcacgtcttctttcttcttcttctcgccctcctcgtcgaccattcgccgcccccgcctcccagcctgccgccgccacctccctcctctctcccccgccgctcgccgccaccgcttccctcctcgccctccccagccgccgccgcgcctccctcctcgccctctctagcagccgccttcctcttccctccgcctccaccagccgtgtcccaccgtcgtcgcagaagtggttccagcgccggcggcggcggatccggcaccgaggcgggcagatctggtgggcggacgcggccgtcgaggtggcgggtgcagtcgtcgccgggtcatcgtcattctctccgtcgcggaagccgagccccgtgccggttggtggccgccggctgccgcggcggtggccggatctggtcgtcaccgtcgcggatcctcgtcagcgacgcctctctcttatctctctctcgatgccatgccgccggtgaggggcaagaaagggaaacgccagaagagaatgtaggagatggggcaccgggtcgccacaacgcgtagcctcgagggagtgtctctggaaaaagtgagctggggagctagaggggcgcgttccccgcgtgagggtcgcacctccctctagagacacgccgcgcggacggacgggggacggcatgagcggggggacgacccagggacaccgactgtggatgggctaagaaattttgtttctataatttgtcccgcaatataagttactatttggaatcccaagataacacaatccctttcccattcatcaatttttttgctccctcatccataaatataaaagattttggttagatgtgatgtatcatagtactaaatcctttacatttagggacaaggagagtattactttattcttccacctatcaactctttgctaatttattccacatatatcaaatcttgtacaattttatcctcctatctaccacaatttgtattattttatcctcctatggtacaattgtgttaactaaggataatttggtgaaggaattagaatgatagtttaagatgttgttttttatgaaaaatgaaaccatctaccatctattcattgaatgtcattttttgagatttctttggagatatgtacacatttcttttgatttacatcctccacaaagtatgtctcatatattcgggaattggcttgttggtgttgataaaagaattaagaatcttattcttgttggagcatccgctttatgttgggctctctggcttagtaggaatgacatggtttttgataaatcaccatcaaaatcttatttacaggtacttttgagggcaacgtattggctctggtgttggacccaattacaaaggtgtaaagaagatatcagcctaattaatgatgcatgtcctaaacttgagtcaacgattat

SEQ ID NO: 49412 - DNA, 1878 bp, Oryza sativa
tcacataagcccaaaagaatttagctgggcagtaaataaaattttataccaaaactttattcatagagatttgtccaaaatccagtaacagaaacttgaaagcaaaatctcataagcatctctccatgaagagacaaagtaactaataagaaggtataaaagctgcaaggcggtcgattgaactgatccacgacggagctttccagtggttcacttcgaaagcttggacataaacctcttctttgcccttatctgaaaaatcagacgaagaaaagaaacatcagatgtgtgcaacacaactggagcacagtaaagcatagcatcgcaagagcgtactgatcaagccaatcacaactattccaacacacagtgagaagtgccgatatatgacttgataagataaagtcatcaacagcagatcaaaacaaagaacatgaacaatggcaagtggcaacctagcaaatgaaggtttacctcattgctgtggccacacttcttcttgcggcagttggtggacctgaggggaaggcgtgcatagcacctgcaggagaagacagtgcgtcggattcagcacacaaggatcaatcttatgaaagcattcgattcaagcgtaaatgcacatgaatcgatcggtcgagtgcgcgcgacgcgaagcaaatgtacctgcggcaaaccagcttgttctcgttgtacttctgcgcgagctcgcggaggttgggctcgatccccttggggtagccgcccctgctgccaccgcggaggcggagcaccaggtgaagcgtcgactccttctgaatgttgtagtcggccagggtgcggccatcctcgagctgcttccccgcgaagatgagacgctgctggtccggcgggatacctaacaggcagatttggtgttatgagaattttaaatttagacaaaatgcgatcatgaaatcgaagcgtaatacaattataatcctagaaactagaactgtcaaaagtacaaaaaactctccagatacagtttagatgtgcagaaaagcattggtttcttccgttacaagaccgatctgctgatctgcaccgtttcaaataaatagtagcgactaagggcctgattagttggcaaaaaaaatttttttgcccgtgcatatcacatcgaatatacagacacacatttaaagtattaaacgtagtataataataaatcaaattacagattccgccaggaaactgcgagacgaatttattaagcctaattaatctgtcattagtaaatgtttactgtagcaccacattgtcaaatcatggcgcagttagacttaaaagattcatcttgcaatttcctggcgaactgtgtaattgatttttttacatgtaatactgcatgcatgtgtccaaacattcgatgtagcagcgtgaaaaattttgtttgggaactaaacctgccctaaataaggcaacagggaacacgcaacgaagacgactaaccagaatgctatataatattgcttaattttctcagtaacaaacacaccgctacatgaacagatcgatctatcacttactactcacgtgcgatatatatacttgggcactgcacgaaacaaaatgagaaaaccttacagtttacacgctaccagggcaaaggacatgatttctagcactatatgttgcctaaacgcgatatatgcacctgcacggtgtgtgaacgtacggatcaacggagcaatcagcaataacatggcaacaacaagaagaacaacagttgaacggatggagaaatggcgaccaatgcgcataccttccttgtcctggatcttggccttgacgttgtcgatggtgtcgctgctctccacctccagcgtgatcgtcttcccggtgagcgtcttcacgaag

SEQ ID NO: 49413 - DNA, 1185 bp, Oryza sativa
actttgtgctgataatactccctacatcaaaaccacatatcgaaactgctgttcttttatttcccggcgaaaaaactgcctttttttttgtagctgaccaaaagcttccatctgcatatcactcactatatctttctgatttgctcgaggcatcaaacttggcctaattgatccggcgccttgtagacagagtgggacccagctgccggcggcacgaggccatggtctgcagccaggttgctggaccggccacgcagcaacgggtgaagtgaacggcaagctgatctggaaccatccgtaccgtgttgtctcgatcaaagcagcgcttaatccgtgacgttttggtcgttgataagctagtgaagttttacacgatgccgttccgttaaaacagatatccgcatgtgtcgctcttccgtgacattttcggtccctgattaagcttcgtcgctttcgctgaacggttgattttgactggaacatcacgttgttttttttaggagcgccatccattaattcgttcatttgagcttattataaactaacaactgtcgcttgctaacccccaaaagaatcaatgaatcatggtgcaggagacaccttgtgtgggcatgtggccggccgactagggttcagtggttcactacttcactcccaacagccgcggcatgtaggaggattcctaatgaatatattttgtataactacagaattttttttcagaactaattaaagttaaagatttaacatcgaatttaccatgaaactatatgcccaacacaaattaccataaactatagatttagtaatataattgtcacaaaactattacttcctccgtttcccactatatgatgttttgataagttactactccatccgttttacaatgtaagtcatttctagcattttccacattcatagcgatgttgatgaatctagacatatatatttatctagattcattaacatcaatatgaatatgggaaatgctagaatgacttacattgtgaaacggaggaagtataaaacatagcaacatttgtaatacaaaacaaacatattattaaaatatatttaatgctaaatttaataaaattaattcattgttgtaaatgttgctatacttttaatgaactcaaaaaagtttgatttaaaaaaaataaacgtcttataatatgaaac

SEQ ID NO: 49414 - DNA, 1475 bp, Oryza sativa
cctcctccgtctacggcggcctcaccaccccggactggatcagcgactccaacggcatcctcggcgccaagcccgacgccgccgtcgacgccgggacgactctgttcgtgccgctgcactgcgcctgcttcggcggcgtcgacaacggcctccccgcggtgtacctcacgtacgtcgccgggaagggggacaccgtcgccgcagtcgcgcagaggtaccggaccacggccaccgacctcatgagcgtcaacgacatggccacccccgagctcgccgccggtgacatcatcgtcgtcccgtgccaggtgagcccttttctagcttcaattcatagcttcttcttggatctggtagtttttggttttgttgctttgtgctaccgagatgtattgcgtggttcgttggtaattagatccatggccatgggtggttaaccgacaaatttggttggtaattttactccatactcagtaagaagtagcagtaggagtactatactgacagcgatgtgattagtctagtgtgtccttggtaatttagtgcaatgcagtaaccgcactggccacaagccttgctactgggagcatgagatttactccgaattctggatacgggcatgtgcagatttgtagtactagaatgcgtctaatccgatcctaagttgctatattttgggacggagggagtatctagctttgatatcagaaaggccatgtttagttcctatgcaaaaactttttatcctgtcatatcgaatatttagacatatacatggagaattaaatatagataaaaaaactaattacacagattgcgtgtaattgtgagatgaatcttttaagcctaattgcgctatgatttgataatgtggtgctacagtaaatatgtgctaatgatgaattaattaggcttaataaatttgtctcgcagtttacaggcggaatctataatttatttttttattagattacgtttaatactttaagtctatgtccatatatccgatgtaacacgccaaaacttttcatcctgtaactaaacagggccaaaatgcttcaagattcgtgaggtgaaacatgagtgccagcaatgcagcgcatcactgcttgtctgctcaaattgtttactagtgccagttcggatgctctgtttgtgtatctgcacgtactggcgctctcagctttaaaataaaagggtccatgcatgaaactttacctttccactgctccttttgatcatttgctgtcaattaagctgacacccaagaaaaggagatgaaaaaaaaggtgtagcatgcagcacgattgcacgacataaatttgacaattaagaatgttcaacacaaacttagagagactttaatttcactattgtgagaaagaaagtgttgtgtcgttttctctgttgtgaatagctgaaaggtcttctagagttcttaagtgcgatccatgtgtgatgcattgaaaaaattaacg

SEQ ID NO: 49415 - DNA, 1681 bp, Oryza sativa
ctgttatccctataccgttttctgcttcatttatcttacatgcaattaatcatgacggggtaccattttttttctctcgaacatgcagcgtgcacatcatcattcccggcgttcacggcggactacggcctggcggtggcgaacgggacctacgcagttactgccaaccggtgtgtccagtgcagctgtggcccaagcaacttggagtaggcaccgatcgatttcaccctcccatcttcaatctgctccagatcttacgcgaaccgagagatttctctcctgtttctgacgctgccgttgcccgttgctttgcttgcttttgctctgctgttgcagcctgttctgcgtgccggcgccgctcgccgactcgacgtgctccagcatgcagtgcgccaacagcagcatgatgctcggcaacttcactctcctcatgaccagctccggctgcagcgtcacgtcctgcagctacggcggattcgtgaacggcacaattctcaccacgtaattgatcagcttttttttttttgtgtgtgtgtgtgtcccaaatccatctcgcattttgctattcagaaaccgttgtctcaccgtagcgatacattttgtgcatctttcaggttaaccacagcactcaagcctcaatgcccaggtataaaattcgtgctcaattatgtctcagttcaccatttctgccttgaaaaaccgagactttatgcagctcttgcttttcgtgcaggtccgcatcagtatcctccgctgattccgccgccgacgtcgtccttcttcgagacgtacctcggcccttcgccgacgccgatggcatccgaagaaggcgtcatgtccggcatggcgccgacgagcaccccggcggcgagctccggccctccttcggccggccggcacgtcgtcgccgacgttcttggggcgttcgctctctgcctcgtcggcaacctgctgtggtaacagagcggctctcgccgttgatgctacataattttgtacagaagctgtggccggctgtgtttttgtcgggcagcgtcgggttgtgcccaatttttgttgcgttcattcgatttgtctgccactcactcctgtggaatggcaaacacaattacagaagcgcagatctctccagcgcggctgtaatggtcctgaattcctgatgctattgagaatgtgagtaccgagtagtgtgctttttatcgacgctttttactgtaccttctactactgatatgctttttagggcacccacaatggttatttataaactctctacaggagattcatatcagcatatttttctacttggaagatattaaataaagagagagagcaaaactgtttactaacttagagatagtctatagagaaaaacgaggcaatacatgagagagctatagatacccatgtagacatactattgaggtgatttactattaatctagtctattgctgagatgtacatgttttatagagagcaccttactttactattacgggtgctcttatatgcgtttccccaacgctaatcatcaatcaataactctcctaaccccactgtttttctcatttttttaaattctttttaggctatcttatattgttttacacgtcgctgctaatccctcttgctccttgcgcgtaagggggcaaccgcccataagcggtgcgctggttgatc

SEQ ID NO: 49416 - DNA, 1216 bp, Oryza sativa
actgaagatctatatctgtggtctactacagctcaactgttgtaaacaatacctgtgatgcatcgttcttccaaagtttcatagatggcctttgcattaaatagtatatccatatctttttttagtgaatagtacttgcaattttgagtgtgtgctttccatctcataaggtttccatgtttcataatgtcctcttgagtttaatttgagttttcaactattggaggaactataaatagcactagctaaatatgttgcacacgtgattcatgtattcagctcctttactaccatatataagtttttggcacattggatctatgattttgccacagcagggttaaaatcaaattgctctgagagaattggaccttggatttggatatccatccagccaggtcaatagtatgtgactcttaggctccaaaaaataattggcggtgatagaacttagattatgtcaaaaaatgacgaacttgtacatttttaatttttcactgtaagtagttgaaggtgttttctattttttttcttcgcttcatcattcaaaaggtgtaatttcttcagtattaccatgttttttttagggttcgctattaccatgttgacatgagtactttgtaacatggcaagttgagagttgaatttcacaattgagagttgcttacatttgtaatagttttagtaattttggaatgaacgtgcagcttggaatgtataatgttttttggtttgaaatgccaaatatatatgtatattggtttattaaaaaaacttcaattccatttgcacactctagatatttgcgacgcttcagttatgtataattttagccttgcgcgaatctttttgatagattgctggagctaaagcacaagctttaccctttttttcgaataagctagaaatagcgtaaaaaggttagtgttagaggtttacatatgttttgacttgttattcttgtagaattgatagtcttctaccataatgcaaattcttgtagttgcgtgtcttttttcatgatttaacctgctacacgaacgtatcaatgaaaaactcacatcttctgatgccactggcgcggcgcgcaaagcgcgcgttcacctctagttttcttttagaatataagtatatttggtatcttttcctctggattgaatcgcctccctcaactgctgactcaaacgagtcaaccgccgaacattgtctgcagaaa

SEQ ID NO: 49417 - DNA, 1408 bp, Oryza sativa
tgaggttattgtttgattaggacctaattgattgaattgcgtataggctagtgaagtctgaatattcgaattgaaacctttagatgttattttgcggagtgaacagcgtagtgtcatggtcacgttatctgcaatgtactatttaagaaagaaatgttatggtgagttgattgtttctgagataacaagttgtttgtggatgaatggagacattaaacttcatgctgagcagatatgcatttaggcaaatgcccaccgacatctccaattccctatgatgtagttcagctaggatgattccaatctacccttcattttgtttattctagttttcttgcttttggattttaactgccatgtataaaccatattagatcgagttccatcttcctgaattgactaaaatgttgattaatctgaagagtttaaatcatccagaaaagccataacaatgctttcttttggtggacattgcttttgaatgtttccatgaagttatagacacttgttctactgaactcattgattacactaactttcctgagtttaaattgtcttaattttggactaatatatcatctttggactttgtttctatgatccactacatagtgaatgcatgactgacatccatgttaggatgctacattatattttgcatggttaattagaatcctgtgtgcaatgggagacagaaggggaatttaagttgcctcaaaatattccctgcatagtgtaccagattgtaaccgtactacaaaccatgtttctcaagaagacaagttcagtgcttgagctagataaaattgcttcaagaaatattaacaaagctaagaaagttttgaacaaagtgaatctcagtatctaggcatagactaggttcacccaagccctttgtgctaagaaaatgtaccacaaggctgaagactttctcatctatgttcaatatggagcttagggttttagtattgtggatcatttatttgtgcagaatcttgaacttatgaagtatactctaaactaaaataactctttagttgataagtgctaacgttgtactttgtgcctttgtggtagcatttaattttccctcagcaagtcaccacaaaagcaatttgtatctccaaatcaagcacattttatagacattttctgccacaatattttaagcctctttgcttcgtttagagacccaacagcccaatcaaatacacttgcaaatggaatttgcaacgaagagatattttctcctgatgctgtactgtgtctttacaatggttcttaatttgcagggtgaagctttggctttttgtggcgtatgttgtctctttcgtctgcctagctggatcagtgggtatgttggtgcaaaatgccttgacagacaaaggcccttctgtgtggactggtg

SEQ ID NO: 49418 - DNA, 2175 bp, Oryza sativa
  unsure (1)..(2175): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacgaagccgagcggatttctaggcgcagcagactttacattattcacgaagctgaactgtacaagaaaagtccatcaggaatactgcagcgctgtgtatctttggagaaagggagacaattgttgaaggatatacattctggtatttgtggtaatcatgctgctgcacggaccatcgtcggcaaagcttaccggcatgatgcggacaagattgtgcggacatgcgaaggttgtcaattttttgccagacaaactcatttgccagcccaagagttgcaaaccatcccgttgtcctggccatttgcggtctgggggcttgacatggtcggcccatttaaaagggcagtcggcggttacacggggatccttgtgggctatcgacaaattcttcaagtggattgaggctaaaccggtcatcatgatcatagcagataaagcttgagattttttcatcaacattgtgcatcggtttggggtacctaatcggatcatcactgataatggcactcaattcactggcggagcatttaaagacttttgtgaagacttcggcattaaaatttattatgcctccatggcacaccctatgagtaacggacaagttgagcgcgctaacggcatgatactgcaagggatcaaagcacgagttttcgaccgactacgcccctatgctggcaagtgggtagatcagctgtcgtccgtactttggtctttacgtactactcctagacgggctaccggccagtcgccgttctttttggtttatggcgcaaaaacaatgttgccgagtgaagtggaatttgaatcactacgatttcggaacttcaacgaggagggctatgaagagggccgagtagacgacatcaaccgactagaagaagcccgagaagcagctttaattcaatcgactcgatatttgcaagggttacgtcgttatcataatcggaatgttcgatcgcgagcctttttagtcggtgacctggttctgaggaaaattcaaacaacataggatcggcataaattatctcccttatgggaaggaccgttcataattgctgaagtcactcggccgggttcttatcgactcaagcgcgaagatggtactatcatcaacaattcttggaatattgaacaccttcgtcgattttacgcttagacatttcgtttgtatctttcctctttgactgctaacttcaagtttttcctcgaagttttcagtcagggggctactataataataatggagtgtgatttttatcaatttaatttgcttacttgatgtatcattgccctgtttgatttcttggcttagtcaatgaggactgaaagttttttaacaacttttgcggattttaggctcaacaaggtttgacaaaaacttttaagaaatcaggagctaagttaagatatcaagcacaacataaattcatcagtattgtacaaattgtgcctccatcatcattaatcatcaaaattatcggtacattaatcagtatcagtcttttcatcatcagaattatcaggaccagtcggtcgaagatcggtgtcctgaaatctctcaactacatcagcagcaattttgtcagccgatttctgcgcatcactgatgaggtcaagagcagcttcttcgctcgtcccgtctgcaaagccatcaatggcgtcaatatcaactcttggataaagggatttagtcatcgccaacgccagacttgctcccatacttccagcttctttgatgttcttgaaatatgtattcggagcgactctcagcttgtcgaaaatttcagaagcatcaagtgcactcgggccgttgttattgaagaacatcgcttgaacaattggggtagcagcgttagcaacctcatcccgggctccttcaagttttttgatcttgccaaccaggatgtcgaattgagcttgagatttgatcttgcggtctgcatcaacagattcacattaatgattcagcat

SEQ ID NO: 49419 - DNA, 3630 bp, Oryza sativa
cttagttcgaaattggactcctagagctcagcaatccgatcccttagatcgtgttcgttcttcttggcaagttctctggcctcgtgtagttgactcctggtggcttcgagagttccgagatgagggactaacttctctaaggttgccgttttggcttcgttcctgagatgaatcctctgcaagacagtttaattagcgcatgaattaaatggcaaacaagatggttgagatcaagtaccagagaacttacatttacaatgcgagtcgcttggttgagtgcctttttcggtaggcagacctcttcgtcttctttttgccggtttattacaattccttgaggctgcaagttatcatcccaccacttgaccagaatgggagggcacgaatcttcggctgcttgtatacgggggatttcttcttcatcaccaatcattggtcctaatgtattcgctgacaaaggttagacaattgatcagagtttatttgggtcaacatggtttcagacaaaagtgttttcccgtaatgatttctgaatgagaacgagtggattcggatgcccttaaaggagatccagatctctggttattgctggcgttttgtccacgagggttgtctgcttgggtttcgacttctggaatctcttggtttggccttgcgtccgactggtttccagtcgggggctcctgattaactccggcttcggcttcggccaactgggtttcagttggaggtggatcaccggattctacatgatcggttgccggctgattgtcactcgggtgatccccaacagttggcccggtttctttggaagaacttgtgtccatgttagtcgggtcagagtctttcccagacgggtctatatcagatggtttcctacaaatttgattatcagtattattgccgcaatgggtgtgcatcaatacaagagggatcgttatatgagttgcacctggaagacttcctgatctttggcgcagggcgactggatgttttcttccttggagtagcctgttttggtagtttcttggtcgtctctcggtcttcaggcctcctggtggtatcatcggcttcgtcgtcgcttagaaccagcttcctctttcgagaatctgactggccgactggatcagaagcacttggttgagtttcagaccgaattcttggtcctccgctcccttgcccagtttggtggcggggagatcggcgttgagcgattgggggatccgacttcatcaaagcaaattcctgggtgtaatatccttcattgttaactgattcaacaagaaagcaagattatattttgagaaaggtcgaagtgtatgaatgcgtaccggtggaggggggttgaatgcattgaacggtacaactggcagcaagtgtgagtagctgacaacgatggcatttgaaaagatcttatacatcctttccttcatgaccttgaagtcaagagaatctgggtcttcacggtttgggtcatgcttgccgtcaaattcgaaggctgtacgagatctttctttgattggagctaaccgacacttgataaagtgccgggtgatctattctccttgaaggccctgttctttcagctttatcatcctctccatcagttctactgcttgtgcggcttcatctcccattggcagtgagttccaagtatcccgataaactggaggaagacaggagtactcgggaaggacaggctcggggttttgaacataaaaccagtttgcgtgccagcctttgtttgaggtcttgaagggcatggagaaatacttttggcttagcgttcctctgagttggaaaccagcgcccccaacaacgcatggtttgctcttgttcggctggggcttgagaaagaaaatgcggcggaacaaagcaaaatgaggcctaatgccctgaaaagctttgcatacatgaataaagttggcgatgtgaactatgtagtctgggttcagatgatgcaggctgattccatagaaattcagaattccccgaaaaaatcttgaggttggaagggagaaaccgccatagaagaagtgagcaaataccacgatttcatgcgtatcgggagtcgggaatgcttcgccgaataccggtcgccacccaatgatctccttcgctggaagaacgccgtgcgccaccatctccttcagattatcttccgtcacatcggagggcgcccactgactctcgaagctttctctttcttccgccatgaatgtgaactggatggtttgatttggttcgagataaggctggaaagagatgggggaatcggtgcggtggacgcgcggagaagtttcgtgggatttttgagaatggattggggcggattggtgaaccctagctccgtcggcgcagtcttgtactgtagcgaggaatggggaaatggcgagagtctcggcggggaagacgaagcgtcgcttagacttcggtgttttgttagagtatcgggagtgctaatgggcctgggcctgtacagtacttcagcccaattttatttccagcgtggcccgttgtgatccttagggacttaggcactttttgctttggcaatttgtgctcacaatgttgtggcccaatgctgattaaatcatttttaatgcggcttgctaattctttagaattaacacgatgcaaacaaaaggtgtctgacagaaaggtgttataccgtttttgtaagctttattaggctgcaaaagctgtttgggttgatttgagatgactggtttattcatagtcattcttttagcatgttatatgcttattttagttatggtaagggtcacagcctaggctattagactcattaattaccatgattttttatcatgtttggtgaatcattttaagagtttcttactcggattcctatcaaatatgtctatttttggaccttttgagtgttcatcactcagcccttcttgtattttctgtccttgatatgttcaagttgagaagtagtcggctgggtatcttactaagtaccatgcgtgcttcgctgtaaaaccactcggttcttgactatatgtttagtttttcaactaatcacatagtcgggggctacacttaattaggtgcatctactcgatacaccatgttttattttcgcccttcacagtcttttagcactcggcaagccggagcaagttgaattgaagcactcggattattattttttgtttcgagaagactgttttggtcgactgcgaaggtctcgggggctactgtggagattatggttaccccatatctacatggcagttatattccagctggatatacagtaccaaatatagatagaatatctttatgaggactcgggttagattctaaacttgtatatcaagaaagtacctgggatcctagtcggttacgattgtattttatctgtaatcccatattccgttaggatatggatattacggattccttcccctatataaggagggtccgtgtgcctcttggggcacgattcttttttttcccaatcatcaatcaataacccactcggcggaatcatccccggacaggagtagggtattacttcttgaataagaaggcctgaacgtgtataaaattccttgtctccaaacccatccactttcctagctcgatagccaccccttt

SEQ ID NO: 49420 - DNA, 2191 bp, Oryza sativa
caacaaagtctggcaagttgagacattcagtactacgaatctggacaagctcctagtctagatccgcagcactcgaatgtgtcacatctaactgaaatcttttatattttggtacggtggtagtagtattttgattaactctttcttataaacaaatcaatcatctatcaggtttcatccgcatccggtcttaaaaaaaacatgctttagccgaagctatttgtctaagatctacttccttcgactcgtattaagttaatatagtacgagatgtgacgttgcatattaccccaaatctagacaggatatgtcagatctcgtactagattaacttaatatggaatggaggaagtagcaagtgtggctataaagtttataaaaacccttaaaacttccatcaatttataatgccaatagaattaataatatttgaagcatttaggtagcaatatatatttaggtttccctttacaaactttcatttgatggtagtaggaaaatgaattttggtcacaccaaaattttggagacgtggcaagggttttttttttttttgtcacaccatggtgaatggggtggcactttgttgcacacgctgacaactcaccaacatatctactagctttttttttgttctaaatgtttaaattttaattttaccaaaatgcctcattttacaaaattgaatttgtccagagccagaggtacgcccatgtgagcagtcatttgtgtcctgctcagccaggctgtgaatggaccgagctggaggccctgccattatctttgacgtggttgaccctcattggttgcagcaattatggagtcatgatgcggtagtgattgagatggagaggaacaggaacgcagcaaaagctgatatctcgataaacgggagcatcacagctctccatgtactacgcattcaagactacagtacgggatggttggagtagttccgcatgggtctttctttttttttcccttcattttgtttaaaccgtctagagcaagtataatagtaagtacaatagtagagtattagccagctataaacatatttaaatgagataaaagatgagagagaagagtagcaggctacagatcggtagccagctgcagtacagactccaaaatgcaatatgtgtatgacatgtgagaccatatattaatagtatagtaagcaactatggtatgaattgtctattagattagctataaatgaattagagctagtagtgggctatactattaaacttgctcttatgtgatgatgcatgatgcacttgcagagttcaactaaagttgaacgagaaagaaaaatgctaatagcaacataaacataaaacagatggagaaaatagacaaaacaaaaattaagtttacattttatatggcgtatgaagcacaggaataaactgcctcaaaaacttagtacatgaatagacaaacaaagaagagtatggagaagatatccttacccctgcattccaaatgacagtataacatttatactacattcgttcctaattaagtactgcacttccataagtactgcacttccactattttaaaggcaaattaccggagcagaaaaataacttaaatgccatttattaaatgagcgatggttggaacggcggggatgattggtactaagatagaaagaaattaaaatgatgagtggttggattaaaaaaaattagaaatatagtactagtacacttgtgagtaaattgtaatagcggtatataaacttgtcagatgtgtgcaatctagtgcataaacttataaaatatttattttggtgcacgaacttatttggtgcatgcgatcaagaccaaaatcacttgacaaggataatcttgctgattttgttgttgatttgaatgctatgtaaacatgtgtctcagaaaaatatcacatagataaagatctgtttagcaatacatataattaggtatattgattgcataaagaaagttcggtcctgttcactttgatgtcatttttaaccttatcaaattttggtaaagttggcaaaaaaaaagtggctacatttagtttgctacaaaattttggtaactatatagaaaatcctgccaaaattttaataagttgccaaaattttcgcatttttgacattaccaaaatttggtaagattaaaaatagcatcaaagtgaacatgcacga

SEQ ID NO: 49421 - DNA, 2467 bp, Oryza sativa
tgaacaaggaaattatctgaagtagagtcggctaatggatacaaatgtattgaccccctccggaccaacttcagatcaatatacagttagataagccccttttgtttttttaattctgtgatgtggacagtatgaaattatgtaattatcttttgacggactcaaaatcttatattctgaatgtatgcatcttgcagctattaccaagatgactaaaagtataaggggcaagaaatgttcatctcgtcagctcagatcacataatcggaggctcttcagccaatgcaatttcaagagagttgctaacaaggaattggcagcaacagagaaatgtgcgtggaaagattcaatctgtccagtttgcttggaatgcccacataatgctgtccttctactttgttcgtctcatgataaaggttgtcgtccatatatatgtgcaaccaattaccaccattcaaactgtcttgatcaactcatagattcgcggagaagctcaaaagattgtgaggacctagactccatagagcttacatgccccctttgccgtggtgaggttaagggatatacattggttgaacctgctcgggaacagttgaaccaaaacaagaggagctgtatgcaagatggttgctcatacatgggtagttatggagagctctgcaagcatgtaagaaagaagcatccttcagtgaagcctcattctgtggaccctgtacatacttacagatggaggcgacttttattccggagttcactgcaagatatgatctgtgcaacgagttcaccaatggtgcggagggttttgtatgttatgttgcagtttgaggagttgatggcatctgtttggcacgaaggtcctcatggagctatgcaaatcaatgaaatgaacttggctgatccatgatctcaacctcactgaaatgtgagaatatcttatgctgttctcgcaatggggtcagtgatttgagccatgctgatccatcatgtgtgacctgacacagaaagatatagcttttttagttttctgttcttgagggaatatttgtcaccatcttcagaagaaacagatcctatcctatgctgccatgaattcaagaaacctggtcaaattgtgggtggaatgtggaatggcgttgaaggcttttgttgatactatctcattgtagtcccccctttgtgtcgtgtgatgaattgatcctgtgcatcccttttgcactgtattgacattacattctattcggaaatgcagagttcacttgctcctgtatgttttattgttcctacctcctcagaaggtacccatatatgtttgttgtttatgtcgcgtgacagattggtgtatactgaagatgaaatttgcttaaaggcctcaccgccaagctacgcgtggcaaataattattcgggacagataattattgtactggtctctccgatcggtttgtcgagatggtttagattagcacgaagaatatgctttctgatctgaaatagttccatcagatggtcgctgtgcagttctacaggcagtcaagcaacacttgcacttcgaatttcgacgcaccagttcacgtaaatggcaaggcctttagagtttagaggaactttggaggaaatgaatcgtttcatacgaaaatcctgtaaaactcctgcgttccaagaggagacctaaacttcgttgatcctcccaacgttcggatcactatcagaatcgtcctgtcgctgtgcagtgtggcgccaatggcaattgcaagcttggagttataagtcaggactaacataacttccagtcaatatgatgaaagttcaggggatcaaaccgtaagacgagtgaaatgacggttcaactaatcaaaggagtgaaactaagctaaagaatatgagctcgagcaaaaacgcaaacactagtcatgcactcagacacgtcatgatctgaagaatatttagcgcaaacgaagttccgcgtgcaaaggagggattttaaaagaaacatacggttcaaaatcaattcagatattcactggtacgcacatgcaacaccaatgatatagccttgtagcattaaggatgatccagctaggttcatatatatcataatatcaatacctgcacatctgcataagcatgtcaacggctgccggccgcatgtcatactctcactggaaccaaatgggacaacttgacaatcatcagtccacgaaactattggtctgcaccaagtgacaaagtttacagcataaatatcaaaccaaggtttctctccaaggttaacttaaaaatgatagttaaactcagggaggtatatatgctcttcacacaaatcataagtttagatgatgatagagacatcacatttggtaaatcatatctccccctcaaaaccatgtctgaatcatggtagccctataatgtgttgataaagcatacaccaattttttgttatcaagtaaagatagaggatgtaattc

SEQ ID NO: 49422 - DNA, 1173 bp, Oryza sativa
caaaattgtgagatggaagaagaaaggtatgtcaaacaacttcatgcttatctttgcaatttttttcagtcatcttgtgtatgcgctttgcaaattcttttcactatgtgtgtacacaagtcatatacttgatgatgatgtttttctatatagagagaggctactgccatgtatggtcccccatgttggtatggaattcaaatgttcagatgaggctgggatgttttggcatagatatggaggtcaaaaaggctttgaggttagaaaaaggtacacaaagaaaatcagatggtgaagtaacatcatataggtttgtttgtggaaatgagggtcatcgaggaaatgacaaaagggatcatctaacaaagtgtcctcgagctgaaaccaaaactaattgtcaagttcgtatgagtgtagcaatggacaaaaagaagggaaactataaagtgtctgagttggttcttgaacacaatcaccccttgcacttgcatgaaaccttgcacttgatggcctcgtaaaggaaaatttcagatttacaagcttttgaaattgaaacagcaaacgattctggaattgggccaaagacggcatatgagttggctagtcgacaagttggtggatcacataatctaagctacaacattcgtgatcacaagaactatttgcggagcaagcgccaaagggagatggcatatggtcaagaaggtagaactatttgagaactcaaggatggatgcttgctttcgctataaattcctctcccacaaatttctcaacttggcacaacaagctgctagctatccagagtgcaccttgttagtaaacaatgcccttgacaaccttagcaagcaaattgaagagcaactcagtggatgtgctagtatctcggatccaagtataactcacacggaggttacgcccccaaacaatttgttgagtaatgcacacctaaagaaaaaggatcggaggttcgtgttagaagttcaaagcgaacaagaaattggcttgataaaaagcgtaggactaggaccagacaacaagggaaagggaaaaagggaaaaagttcgaggtatgttatacaaaaagttccaacactatgttactattcagtactatgttttatggatcctctgatactcttttctttgaaggaacaaaataatgggggagatg

SEQ ID NO: 49423 - DNA, 2046 bp, Oryza sativa
ggacaatctgtatacatgttaagcctcactctcacatgttcaattcagcaacaccagcacattctactgtcagcaacaacaactgtctcaaatatttggcttaattcaatttacaatcacaatccatatcaatttatattctcctctcagcttctcgagcagttgctgtaagcctccttcagaaggcagaggtgatgatattagcctcctctagaaaatgcagcagccagtgccttcctcctgtcgtggtgtggcccatgatagtgctctgctgaggatgtggccgaagagttcgacgagggcgccgcctcccccgccgtcgtcgtcgaggcacgccggtagcagggtgactctcgtgcaggggaggccgcgggcaagagatgggaatgagggtggtgggctggtggtgaaaaggcttccctagatctatggtcgagctgaacccgccccaaggaaggcggcgagcttgcgagcaaaagcgagcagccggcggccatggagcaaggcgagaaaggagaggagaaaggtcgcatcgtcggtctttgattgttgactgtgcttctgtgggccggattttgttgtcatgggccgtgtgagccagttcattttttcacactcactgattgccgtctgatgcagatcgtgcgctccatcttgctgctacttccctctgacgtaacttcgactacgtcagacgatccgaatccctttgcttgtgttggagttggtcattgttgtggttatactcgtctgctcacatttttacagtgttcaacgatgtggattatctttgttctttcctgataggtctatttttctcgaacgctttcctgataggtctaatatttttttttccaaaacaaggttgtaatcagctcttatatttaatcaggcttgtttcggaaaaaaaagattaggtcaatttggaaccaagatggctgcaaacctgcaaattacacatgaagggtgtgtttagttttttgtgtaaagtttttgaagtatacggacgtatatttgaagtattaaacgtagactaataacaaaataaattacagattccgtctataaactgcgagacgaatttattaagcctaattaatccgtcattagcaaatatttactgtagcatcacattgtcaaattatagcgtaattaggctcaaaagattcgtctcgcaatttatatggaaactgtgtaattggttttttccccacatttagctaaaaacatttgatgtgatatttttagttaaacttttttggatctaaacaaggccgaagtgaacatggcacaaaccctccaagtatatgtctggcacatatatagactcccaaatcatatctagcataaacttcagattgttttttaggcaaccacagaaattttcttggcttcaaacccaacccctaatttcacgctcaaatcatacatttacacacacaataaataaataaataaataaataaataaataacaagggaatagaatccagtggactgaaactcgtcactttcacgaacaagtctttagtggcaagataaaattgcatccagtgccagtgaagtcctcggaaacacattagactgagacctcttgatttctaaaattccaatggatcatgccagctgatgtgctccagtaaaaagcttgctggaaaagacaggaaatactgcaggctgctgctttcggcgagctgctttggataagaaaacgcattgctatcgttggcactgttacgactcggtctgtggttctgacttccgatcatatccacaaatccacaattactccagtttgttttgtcaacagacaacagcataaagcatagatttttatttgaaggaaaacacgttgaggcaaaatatctagattacaaagtagttttatttcccagagaaaagcatccctcctaaaaagaccacaaacgatgtttttcttcaactaaaatgtactgtaataacaccaaaggagcattgtgaaaattgtcccgcccaaaatgtacagttgacacgagtaaagcattagtgttactcagatttacagtct

SEQ ID NO: 49424 - DNA, 1395 bp, Oryza sativa
cagaatggctttctcaagaaacggaagagatttcaaggcattaactaagtgaatggatttgtctgaggaaacttctcaacatagaactcagtcacatggcagatttgcatatataatatataaaatctccattatgtttagagcttatagtatacacgccttggcatataacattatcgaactaagtcatttaattcttttaaggtgtttcaaatatatgaaggttactatcaatctttttgtcaatcaatattcaatagcaaaaggaaattaatgtatcaatttaactgtggatttttttatctcaaaagacataacaagacaaggaatgataggtagaatggtataaagtccacaacaagtttagttgaatcttgcctgtatggactctttttaaatttctcagcaacagataatagcagctcaaggtacttgtttcttccttcggcctttgaatccaagatatctggaaggaaagatacaaagcaaatggcagcagaagcacatttctcttccatggcgtcctacagaagccaaaccacctcgtcaaaacatcaatcccagaccattgtctccacaaaaggataactttgttaatatcacgaaaacttactgggccagtcaactcagaaacttcaggtggagcagcattggcttccaactgctccaatgcaaaggactcgatagcagaggcaactctagccccctggtaagggaatgggctctccttatcggcaccaaataccaaaatagtaggaaagccttctaccttgtacttgctcatcaaagactgcaaaattcaagtcacacgttatgttacataagtggtacttgaaaactaggttgtatagtttgacaaatgttgtacagaacgcacatgaatgctttaaaaaggtcaaacattaactgggttttataaatatactgatacactgcctgaattttctgcctaagttcatttaaactcactcggtaacttttatcaactgaccaaacacttgaattagtattctagaaaaaaaaacataaaacttcaatcatagtacatcatgttaaactgttaaagagacaacctaaaacagcacaaaataagatcccaacaaatgccttagataaagttaggccattgctttccttgatacagcattttgtactttcctatgcatatcctgattgtgtccctataaactagagtgctaaccctcagtttaattttattttacaatacctttatcaaagtcctttgaattgatgaaatatccaatgcattgtcaaatttcagtttataattttgtataaattatttgcaaacaagaaatgcacatacaacaaaaacttatgaccaaatagaaaaagggcaagaacctttttagcatcacaatccacatgacctag

SEQ ID NO: 49425 - DNA, 3718 bp, Oryza sativa
aaagatataacgtagctaaaaaatgcctcttggtcaataagcatgatactgtaaaattactgtaaaaaaaaatatatgtctaaatatgacagagactcaaaatcaccgcactgcaggtacaatggcaaaggtacataactatctttcactcttgcttgccttctctcaggatagatgcctttatttcatttgatgagtgactaaattttcagttagagaatctgggatacataacctaattttctgattcaccaataaacaatgttgcatcagatattgtaaagttgcacaacccattggcttccacggtttcgtccttcataaaagtatgcatttcccacatctaaagtcacatatacacttttattggcaataaactaaccaaggccgctctcaccttcggatcaaaagaaaaacagataaaaccctaattaacaccaattaaaatgcttaattcgttcaatataattcaaaatccaggttattttttttaaaaaaaagagaacagcatccaatcaccatgctgaaaaagtgaaaaaataaataaatttactgtatgaaatcaacaatgcaccacattccatcaatattaatcccagctacagcattttaatatgcattaattcggtattgtataactcatatccgatgttaatgccctcctttaaaaaataaaaacgacgcccctttttgatcagtacgtgtagacaccaaacattgatcttcccatatttcctccaccaaacaaatgtggcattgtactctctgatactgagagctacacaaaaaacccataacaggtgtaacttttttttttatggagtcgagtttgcacattgcatatacgcagttatgtcctagctcgatcaaattacgttgacgcaacaactgatgcagagatcagatcacaccaggaaaaggtagatcagccaatcccaatgaaccgagatgccaaacaggacgtttgctcacctgcgcgagctccttgtgcgcgtcggcgtcgagcgcggcgaccgtggcgacgcccttgaggacgcccgcggccttctcccaaatcggcgtcagctgctggcagtgcccgcaccacggcgcgaagaactccaccagcaccaccccattcgagttcagcacctgcacccccaaccgaaattcgaactcagcgagagcccccaagtaagggaagccgatccggagacggaagggaagagtgtgaggggggagtcgatcgagagaccttggatttgaagttgttggggttgaactggaggacgggagagccggcggagtaaagggcggaaaccggcgaggccgcgacggcggcggcgacgaggaggaggccggcggcgaccgcggggcgcatggcggggtcgagaaggttctaaaaggagtggagaggggaggaggtggaccttgcgatcggcgccggggtgcgactgcgattttaagttcgctcgcgaggaagacggacggacgcgtgtgcggaccaatggagagcctccacgtcggattcaccgccacgtcggagcagtttggctcgcttggcgtgaggggattggccagagagcgtggagtttgtggactcggagcaccgtgatacatcggatataactgggcccacacacgcttggaggtggtcccaaagttcagtgagcctaggctacactcagttgtttggaaacacgatgtggccattgtggccggtgtgatggaatgttcacgaatacaaattctcatacggccttgctagctcggaaagtccgttgactctccctcaactatactgagcctgattgtcatccctcaaccgtgaaagtgaaacagatgtatggtcttcctcatacatcaaaaccgacttattttacatgattttatcgacgggctgaacccacctatgagatatttgtaaagtataggaattgttggtaccaaggtatacgcgaaacttgagcaaaagagacagtagacatggatttttatacaagttcaagccccttaattgacatatctaaccctacttctggtgactgaaccagtgctgcctttatatatatcaatatcacatgagtacaatatttgagatgatctaatctattatctatcaacctaatgacgtggtgctctcacatgtgatcgacggttagcgtagtctggttcctcgaatatgaactcgatgagattggagatagctctagctagatcccttttgtcggcctatgtggctccatattggcttttttaaggcttgcctttggtatattttggtttgtcttggattggctagatccgtcttggcttgtcttcgcctctctcgatggtcttgtatttatacccccggatgtccccttatttaagtagaactagagaactaacggggtcatcgtttaacttatttagggaataagctaaacggtgtgtttgcaaacaaaaataatttgttaataaaaactgttatatacgtgttcttagcgatctaaaagtaaaggctagaaaataaaccacgatttaaaaaaccccccaaagtgaactccaaatttaaggttaaaaattcaaattttggcttataagcatatgcacaagcgaaaagataaggttgtaagtgtagatataatccgagtggtccttatcgtgccgaagcgggactatgtttctcttttcttatccaaaacatctaatgtatatgaggcttgattgcttataaaacttagtatgtggtaggcttcactgagcttaacacaagaattattaggtatgatttatccataacattgacatatttgaacagtggttttgtcttacatggcgcctacatggcatgttgacctaacttcgaacaacgtgggacccacatgtcagtaaccaaacatcttcttttctactacacacaccctccttactctcgtccctatgcaacagtagaagtagctggcaacaaggtagtgcttgagctcccggaaggtggtagtcgagtgctctctctctcctatccggtcatagagctcgaggatagcgatgggcggagtagtagcaacaggctagcttggctccttggcggcacaacatcagctactgtcaacatttcctcttcgccattatcaatccgccacctcgatctaggtactgcccaaggctctatgcctagatctaacatcgtcgtcgccgccaccgtcttctaggagagcttgagctcaagcttcgctaacgctgtctcctcctccctaagaagttgatagaagctggcgagcatgagctggaaaagctggcaaacctcctcattgagccattgtctctccttgcctcttccgccctaaggggaggcgatgaggcataggaggtaggcaagataggttcccgccgacacgagctcttccgctaagtcggcaacgaagaagggggggattggtgatgccgccattgccttgttgttgatgccaccaaagatgcaacaaggcatcagaaaaaaggggaggaaaaagagaaaacatcttacattaacacgtggagcccattgccttttttgttttttcccttgctaaatttgtcataatagtggagaaagctccaaatcacatttgacacatgcatacatgcaaggctgcgtctgtgtctgtagcatgcacgtagtgaggagaaaggctggcgcatgcatgcaagcaggagcaagcaagctagctgccaaaatggcatgacaaatcaatactttctctctcttttaatcaaa

SEQ ID NO: 49426 - DNA, 2371 bp, Oryza sativa
ctggtaattgggcaacatatccaatgcacacaggccctcacgtgtacatacgtgcacaccaactaaaaaatgtaccaaaaaatctagaaaaaatcatacacatactttcaattgtattacacctagggttaaaatcttaacgtcaaattcattatattttagccgtaacaaaaaaacaaaaaatctgacagttttaaggttgcaattttgtcagaattttatcttttttgttattctgtatgtagaatgaatttgaagatgcgactttgcacataaatgtaatactattgaaagtacatgtataaattttcctagaattttttgtgataatttttagttggtgtacacggtgtgtacacgcgagggactgtgtgtataggatacgctccctggtaattgatggttagtacatcccaattgaatgctaatggctgaaaagtctgctgcttgtgccaagtcttctaattagaaatctaatcttcttgctttgcttgaaaaatcattacatcggttgattttactgcggagaaatcaagcaacctttccatggtttttgctcccgcagcccgggccactgcccgcccaaaccgggcggtgaatccgccgctgcgcgtctccatctcctgactctgatggaagtatggaactgatcccggtgacggccgtttcgttggctgctgcacatggcctcgccttgcttacaaaccctcccgttgtttcaatcaacgttcatttcgaactttgtcgacctactgctattggtacttctgctggctgaaccgctgaacttgtgtactaccttcctccctaaatgtttgatgttggttagttcgattttgagccttctttaaacaacttaaaactcatctagacctcgaggagaatgtgacatttttttcaccttatgatatattagagtataaacttataggatgtaaatctttgggttattaaccttcttgcgtttgttcggtcgaattatgacttctgaactgagatccttttgtatctgttcctttggttcagatttcagagtagtatgacttgtaggatcgctactggatataattttttttagataaatatgacaagaacttcgataggcgaaataagcacacgctcgcgacacagatctctaaatctcctaccctagcttgcgttgattggaagggacggagagtttgaataatattgcatcattgcaagctcccctcgtttccatacccaaattctctgctccatggccaaaccaccataatttagtacatgagatgatgagaatgaggtgtatacaccccattaatccagcagttcgctcaagcacaagcaaagccctcatgtcttcagggtcagtgtcgagtcctacactcgtgcatggacacggtataaaacacaaacccaagaagccttgtatctcactacattctacatcccgttcaaggtagtagggtagtagtagcatttgctgccgtgatacgctctctgctgctccagagaatggcaagcatggcggtgttcttgctcgtcttgctggcagcgcttgtttccgtggatgtcgccgcggcgcattccggtggcggcttcggcttcaaggcgacgcttacccacgtcgacgcgaacgccgggtacacgaaggcgcagctgctgtcccgcgccttcgcccggagcagagcccgcgtggcggcgctgcagtcgctggcgacggcggcgaacgcgatcaccgcggcacgcatcctgctgcggttcagcgagggggagtacctgatggacgtgggcatcggctcgccgccgcggtacttctcggccatgatcgacaccggcagcgacctcatctggacgcagtgcgcgccgtgcctgctctgcgtggagcagccgacgccctacttcgagccggcgaagtcgacgtcgtacgcgtcgctgccgtgctcgtccgcgatgtgcaacgcgctctactccccgctctgcttccagaacgcgtgcgtctaccaggcgttctacggcgacagcgcgtcgtccgcgggcgtcctcgccaacgagacgttcacgttcggcaccaactcaacgcgtgtcgccgtgccgagggtctcgttcggctgcggcaacatgaacgccggcacgctcttcaacggctccggcatggtcggctttggccggggcgcgctgtcgctggtgagccagctcgggtcgcccaggttctcctactgcctcacctccttcatgtcgccggcgacgagccggctctacttcggcgcgtacgccacgctcaacagcaccaacacgagcagcagcgggccggtgcagtccacgccgttcatcgtcaacccagcgctgccgaccatgtacttcctgaacatgaccggcatcagcgtcg

SEQ ID NO: 49427 - DNA, 1219 bp, Oryza sativa
  unsure (1)..(1219): unsure at all n locations
cacacactgtttagtagttcgaaaaaagtgcgcgcaaaaaacaaaagacgtgagttgggaacatgaagtgccaaactcagcatggacaattatgcatacacgcttttcaaactattaaacagtgtgtcttttacagaaattttaaaacgatgctattactacgacggcggtgcccctccccgtcgaccgcctccagatcgatgccgccgacgcgatggcgcccttgccctcccactacgtcacgagagagaaggtaaagagaaggggggagaaagagaagggatagggagggaggaggaagaagagaaagacagaggatgacatgtgggcccacatttttttcgagtaaatgacatatgggacctacgaatattttctaatgccacataaacgtcatgtgggatgaagccaacaacgccacgtcagcaaaaccgccctccaaaaccactgagggggatcaaattgcactggtttgaatagttcggngagtcgtcctatccggtttttgcgattgagggtcacggatcagattcaggttactttttaagggagccaaagtggacttattcctagtctgatagtaaccgactaaccgttgctttctgggccgtgttgtactggagcacaggttatgacgtgcggaggcccaaagagttttgggccgtgggggttgcttatcttgccatccttgacgcgcgctgagctggcccagacgcccccagttccccttttttgatgctttttttttaacgactcgcacgagacggtgcgaagttctaattacaagattataaccctggagggtcgtaaccaggaaaaagaaaaaaacaacaccacccacacaccgacatcgccaacacacaagcccaggagaaggctagcaccggaccggccgccgctaagcgtgaccagccgccactagactaacaaagggacacagctgagatcgctccctaggggatgccaaaacgacgtcttcaagaagagaagcgacggaaaaaccgccactgccgtccgtcgggactcaaaggagccaagactaggctttcgcccggcaatcgcccttgaggggtgagacctacggctgacacaccgatgctccaccaccacacaagctctgccgacatgtgggacccctgcaccggcgtcccctgccgaccagccttcgtgcgccgaagatcgcgccacacccaccagcagcttcttctcacacctaggt

SEQ ID NO: 49428 - DNA, 1189 bp, Oryza sativa
aacgtattcccagagtgatccagtcttattttttccagttcttatcacgcaggaaattacaggacacaatatctgctgcaatttgatggtgatgttgttgaattaaaatttaggaacattaattggtttgagttatctagctaggcagaaatttggggtcgacaaggacaactagtgatgatcattgcgttgatctttctgtcttccagagattaccaaagcatcgatcaatgtcaacgcatgtgctcgtcagtttcacgaacagagtcatcgattgctccaagtctgcatactgtacaccaaattgatctcatcaacgacatgaaccttggattctacctcaagtggaggcgctaagctagcatgcatccttctgaaaccatcataggcatcgacatttgacgtaccaatgttcatcattttactcgatcaagacaacatatgattagtagtactgctgcaattacatatctgaagatttttctgaaaatgcaatgtcagtatgcagcgcactagtaaactgcagtctgcagaagaacacacatggaacataaatcccagagagaaaacgatctggcgccttgaagtggtgcaacttgtggtagtagtttttcgccgtgtaaatggcatcgtcgatcaattcacagctgctgcgtgagcgaagtaatgaggctagctatagccgtgtccctgcttaaatgcgtcggcagttacgttcatgtcctccggtcctccccttgttctgactgtcagagtgacagtgctcacgtttactaccaccctgaacccagtgaatactagcattattgctacgtacagtactagcatagtaccacgatgcagtgcttcacaaatcacaatatgcatgcacgtacagtttctgaatttcatctccaagatctgcatgcatggctgttgatataagttttcagagaagaacacctgcagcaattaaatccgtgcaatgcatgggtgtgatatcattttcatgtaaacatagttaagaacttgatgagatcgagatttgatgccaatgcagaaatgcaaggtgttgaggtgcataaaactgcagggtagcagttgattcagagtcagtgagaactgagaaaatgagaagctcgcagcatgcgtttccccgcatgagcagcatgcctgacacacatatacactgctcactgtctacaaaaac

SEQ ID NO: 49429 - DNA, 2260 bp, Oryza sativa
tgagattgatttataagttttacacccaagaacttataaatcaatggtcgagatcactttcaaagcgaggatagtaaaatagtgtcagtagagagcaccatctcgaaagaactatcaagactgaatttataatgccttgaaacattttctaaaacaactctactccactgcagctcgattatctatatattaccttgtcgtcttctcctgcaccagatcagcagcaactgatcagctgatcggtttatggaactcaaaaaactaatacagttgattgtggactgtaaaaagccatggcaatgcacagtttgactgatggcttagctttgggaacatctgatgttcagagattcttaccttgaacacctcgacaaaaaaaagtgaatgactttttatcacattagagttcagtttttgcaagcattgagatttgacagcactttctcaaatcgagaaatatgcatttgtaatgcaaatgcaaaccgtgtttatattttcaaaccggctcaccactcaaaagattttcaaaccggcccaccactcaaaaaaggcttaaactgtcaccaaaacaaatttggaacaaggcagatataattaaagcccaaaatgtggaaaggaataaaacaatggcaattcctctactctttattgcatggttacttcatctgcctgcccattaacagcctaaggtgtgtgttcttcagtaatgtgatccatttatatacatggttatataactccacaaagtaaggtggcaacatggatctgctggatgcttactacttttacataacataccccctatatgcactgacaagcaggttggatcattaaaacaacaatctggaattccagtaccccatggataaaaaactccttggagtggttgaatgcttgatccatctgcgtaagtgaatgaaagaatgtgtctcactctcgcttgccaggggcagcagggctcaaagacatttcgatttcctcaagagaacgtcctttcgtctcgacaatgaaattgtaggcgaaaagtgctgacaagaaggatactccaccaaaacctgcatagacggctccaacgcctaactttttcacaagctccaggaaatacagtcccaccagaaaattgcatatctgatgaacaacccaatccataagtattgaattagacaggactaataaactgcatatcttgacttgaagcggcaatgtagagtacatacaaactacacactacacaaggagagttacaaggcgattttatacagttggaaagtgcatacccaatgtacagtgaagctgaagcccataactttcgagcgtgtccgagcaccactcagctctggtatgatgattcctgtaactggtccggctccaatggcgaatgtaaatatgtacctggaaatgtaaagatgaataaataagtgagataaaaaaaatcggttagtattaactgttccataaacacaaaatgtgtgagacctgatcagttgccagatcatgaagtagagtataaatatgctagaaaaggatccttaaaattgtccatcagcaatgcaaaggtgaatggcttaaattatccatcagcaatgcaaggtaaatggcaaactcagaaattaaacacgtgaattttccatattccaagcaaggattttgattcacagcaatcataaatagacctcaaagcaaaggttccaaaaaagggacaccctttgtagtaacctctgtaaaaaaacagctatcatgttcaacaagtaaaattctttcaaatactaattacaagtactttaccagggaacattgtatcatagcaagtggaatgaagaatatgaaaaagaaagtaatgcagaagtacatacaacagagttccagtaattgacaggccatggctaactccttcatcaagggggaagctaatagcatatactattaggaacattgcaagtgcctgcaaaaagtagaaaagttgcatcaggttttgtttaaggactacagcagatcacaacaatatttccagaacagtaatcatgctataaaaaattatatactcatcatagcttacacttgccataactcctccgaaacaagaaaaacaatgcagaatttactcaactataaaatattatattaaaacttcctgaaaagcatcggtagaagcaatatataccattccaagatagcttcctgtcaagagtttctttcgaccttgcttattcatcaaaattgaagcaacaattgcccctgaaatttggtccatgagcttatg

SEQ ID NO: 49430 - DNA, 2498 bp, Oryza sativa
gatcggacacgatcgactggggtattccatggaggcgcacgatgtcggtgaagaaggctgcgccacggactcggcggtgtacgggtgcgccaaggggatgaagtggcaatacttgctgaagcggtccacgacggagaggatgatcatcttgccgtgcacccgaggaagcgcctccacaaagtcgaggccgatgtctgcccacacaatggacggaactggaaggggctgtagcaggccggccgggtggagatgttccgacttgtagcgctggcaggtcgcacacgccttcacaaagtcctgcaccaaacgatgcatgtggggaaaatggaagtcgcggcggaggcggtggagtgtgcggtggacgccctcgtggccgtcgtcatggaccgcggccacgatctcctgtagtagcggcgaggccggcgggatgtgaagccgcccgtcgtaggtgaccatgtccgtgatcacggcccacggcgccgcgcgcgtgcctgcacggacctcgtcgtggatggcgaccaggctcagatccgtggcctgggcgtggagcagccgctcgatgaaattgaaacggggcgcggagatggccaggagctcgccctcctcgacgtcgcggcgggagagggcgtcggcgacggtgttcatggcacctgatctgtactccaccgagaaatcgaagcccaagagcttcccgacccagtggtgttgcggaatcgtcgctaggcgctggtcgaggaggtacttgaggctgtagtggtccgtcttgacggcgaaacggcgtccccataagtacggccgccagtgccgcacagcctggacgaggccgatgagctcgcgctcgtacgcggcgagggcgcggtgacgaggggcgacgggtcggttgaagaaggcgaccggatggccctcctgagtgagcaccgcgccgaaaccatgggacgacgcgtcgcactcgacgatgaagagcttggcgaagtccggcattgcgagtactagggctgtagtgaccgcggtcttgagggccgcaaacgccgccgccgccgcatcatcccaagagaagccgtctttcttgaggagggcagtgagcagcgcggcgaccgtgccgtagttgtggacgaacctgcggtagtagcctgccaagccgaggaagccgcgcactgcccgaggcgaacggggagccggccagtcacggatggcctgcactttggacgggtccatggcgacgcccgccgccgatatcacgtggccgaggtaggcgaccgaggaggcgccgaaggagcacttagtgtgcttgacgaagaggtggtgtcagcggagctcggtgaggacggcacgaaggtgacggagatggttcgcccatgtcttgctgtagatcaaaatgtcgtcaaaaaagacaaggacgaactggcgcaggaaggggcggaggacgtcgttcatgagggcctggaacgtggccggggcgttgcagagtccgaacgccatcaccaagaactcatataggccatcgtgggtgcggaacgcggtcttgtggacatcctctgggcgcatacgcacctggtggtacccagaccgaaggtcgagcttggagaaaaaccgcgccccgtggagctcgtcgaggagctcgtcgaccacggggatgggaaagcatccttgacggtgagcgcgttcagggcgcggtagtcgacgcagaagcgccaagacccgtcgggcttcttgacgaggaggaccggcgacgagaacggggagtcgctgcggcggacgatgcctccctcgatcatggcggcacattgccgctctagctcgtccttgtgggccgccggatatctatacgggcagacagccaccggctgcgcgtccggcttgaggatgatgcggtgatcgtgcgcgcgctggggaggcagacgcgtgggctcggcgaagaggtccccagatgtcgccaagagcccatccaggaggagctcgctgtcggtggtggcggtgagggccggggcgccgggggtgggcatgccggaccagcagacggtccgcccttggtgctggaacgacatccggcggctggccaagtcccagacgatgggccccagggcgcccagccaatgggtgcccagcacgacgtcgaagcccgccagcggcatcacgaagaggtcggccgggaacaggacgccgtcgatggtgagcggcgcggccttgaggacgcccgcgcaggtgacgcgctcgccgttggcgaccatggccgttagccgggggcgtatgtgcaggggcatgccggagcgccgcgccgccacctccgagatgaagttgtgcgtgctgccggagtccaggagggcgacgagcgacgccggcccagcgcgaccgcgatctgcatggtgtcggcggcgggtaccccggccagggcctatagggagaagacaggcgcctcggcgtcctggtccgcggcaccctctgcgtcgtcggcgtcgtcgagttccaccccatcgatgaagaagacgcggcggcagacg

SEQ ID NO: 49431 - DNA, 1168 bp, Oryza sativa
ccgcctaccttggttccccgcgtcttcctcctcactcgaaacatcatatcctctgaggcacagctgccggtccacctactcgcccatatcgtctcctcttctcttggtagggctttctatcctcttcctttacgcgcaagtgggaggtggcagatctggttgcctagagctcaactaccgccacggtccacctccgagtccgcagcatctcctcctctcttggcaaggtaccctatccacttcctctttgtgggagaccggtgcacaagtgagaggccgacaaactcgtgggaggtggcagatctggccgcctatagctcaatggtgccttgatgagcaggcagtagtggcgagcatctggaggtcgaggaggatcaccagatctagttgcctagaactcaacagccgcttgatctggccgcaacaagcttggggttagccaaatctagatgatgcagtcggctcaatgatggacttcacccatggcaaggaggacgactagaaaccctagccttctgttcttcggcatccttctctctgtgtatattcttccattttggtgttgatatattgatgttgattttgtgattgtgttcttcgctattgattttgttgttgatataaatatcggttgggaagtcgatcgatctcggggcgatgggacttccatgattatgtatttttgttcttgattgatcgatctcagggcgatggggggcgcttgaaacatcagcttaatttgagccgatgaatggaggaagccttttcttttcatttctagaacatcaaaggtgttggtttctaaattggtacgtttgattatttccattagtgccgctaatggaatatcggttgagaaaattacacctatatagggttactaatcggcactcacgatgtgttctatactagtgagaacatcttatacgtgagcactttcaggatgggcgatggaagagggacatgaaaaattttaaatttcaacccaagctagtacattatgtttcagaacctcttccatttcttccagctgccccctcttcttcctccactcattctctagaatagttttgttaaattactaggctctgacaaaattcgatgctaatcatggtgacctcatgaaccatgggttatcgtgaaaatatgaatacccgttgcagacact

SEQ ID NO: 49432 - DNA, 711 bp, Oryza sativa
atgattcttgtgtcagatatggagcttcaccagaaatcaccatgctgcaaacaagaaatagttatacaaacagacccaaagaatactgagtacgtcataattagtggagctcaacgaaagactgaagattatgatgtggaggatgcagagacactactgctacctgcagatgaaggttcaaatacttgcagaaattaatctggcactcctatttatgaagccattgttttaaaatgattacttgtctgttgtggatttttcttcagaaagagacaagcttgcggatcctatgtataagcttgaacaccaggaagaggatcttaaaaagaagaaagaagctgaaccagttttagttcgccttcaacgactctccgatagccggcattctgatgactacgctcttaacagagcccttcgtgatcgtcttagggtcatccaatgaaatcctttatcatattttttttccaaaatagttatttaaaagtgtcatgattcttatccacttgtcctatttgtgtagagccaaaagaagagagttgctgaagagaaaagatcagctagaaagatgggacttggagtacggcttttaccaccctctgcagaagatgccactgcagcggcttctgtgaagtttgcatcaaaatttgagaagagcagaagggacaaaagagcagcaattaaggctgcttccatcttcccggagtcatcaag

SEQ ID NO: 49433 - DNA, 939 bp, Oryza sativa
aagagcaagccagggtcagtcgttccttacaccccttgcctttgccccccactctcgccagatggcgagctagatggtgccggcgcccctgctctcctttcctgcccggccatgaggtggggtgcaagattggaagaagggggcgacaacctcgacgacggctgcccacatcagcggtggagcggatctagagtggccacggtgagttcatcgttgcaatcttctcttccttgctgactggcgcccacaatccccccgccgttctatgctctcttcagcccctgaaccgccagaaccctcttcttccttcttgctggatccagtggaaggcgagcgtgggagtaggggcaccacgtccccaacgttggctcgttgccctatgcttcacgcggcttcgatctgaccaattgagtcttcctcaattggttgttgtagtaatctagtggaatccttcttgtatttatcgaatctgtagtaatcgttttggttgtagtaatctctttcgtgttgaacatggtatctcccctctctgtctttgttcgatcgtgatggcgcgagcgataggcgatggactcaaattttgtgcaaactacagccgtactactgcaaccaaatttttttgtctcttacgatgtaatatctgatcacatggtttcctgctttgttttggttgcaatgtgcatgcctgattggtcatctgtttaggaacactcaattctgacatgtaccaatgtagcaccaaaaaaaattcaaattttagtttgctatatgccatgatgcttttatttgatttaaagaaacttttgttttgatatgtgatggatattttttcttacttgcatttgtttccatgatgcagggacagtatagcaatattggaaccaaggactatacatctaaattatcagtgtgctgaggttcgtgatagtgctctgctga

SEQ ID NO: 49434 - DNA, 743 bp, Oryza sativa
atcaatagtagagataaacttttggtctttagatgtgtagacttgagatgtataaaatttggtgcgtaaatctatatctacatctatatacctaactatacctaactaaaaaataagtaaagcttaactatacctaactaaaaaataaagcttccggtagggttttctcgtccgtcaattttttttcacacgcggtatttttctcacgcacggttttttatccgattccggtttttttacgtgcgttttttgcccagtttttttgtccgattgttttttagtgggcccggttttttaattaaaaaataagtaaggcttccagtagggttttttcgtccgtcaattttttttcacacgcgcggtttttttatccgattccggtttttttacgtgcggtttttgcccggttttttgtccgattgttttttggtgggcccagttttcccccaccgcgtccgattttttttgggcccggttttttatatacaaaagaaaaaaaaccacaggaatccatgttcaccaggttcacccacaaaaacacagtagtccaggttcacgcacaaaaaacacagaagtccaggtcacacacaaaatatagaaaaaccagagtccaggtttaccaggttcacgcaagaaaacaatatcgcatacgagtcaggttggttcgcccacaccgttttctgcttctgtttgcccagcccaagtcaggagttagattctatcccgagtcagattctatcccg

SEQ ID NO: 49435 - DNA, 948 bp, Oryza sativa
tgggtgagtacgacttacccctctagacctaaaaaccaaacatctttcacccttaactatcaataccagataaaaaaccaccacgggtagctttataagcgattttgatcctacgtggcagtccagtcaacaattcttctattaaaaagttgatagggcccacctttcagatctctctcctcattatctatttcgctcctcattatctatttcgcctctcagacccctctctcttgtcagatgccaaggaggagacgcgtcagcgactgcgtgcgtctcacggcggagggccaaggcagtggccagcgacagtgaggaggcaggagtggcagagcggggcaagtggcatggtcttagtcgagccatgtctcgaggtaggcgtgatgcaatatgtggctgcagggagggcggttcaccaccgcatccgcctcgaatcgcactaggcagacacggcagttcgtcgtcagcccgtccccatcggccgccgagagagatggaggtgaggggaggaataagaagagaggggattagggaaagagagtgagaggggaggagaaagagatagagagggtgagagactaataggtggggcccgctgattttttttaaaaagaaattactgattggactgacacgtaggatcaaaaccacttcggcttgagtgggggggggggtaatttccggtattaatagttgagggtaaaaaatatatggtttttgggtttaggggtacttcgtactcacccaatagtttagaggtgtaattcggacttttcgcaaaaaaataatgacatcaatttttatgattcagatgttccatcaactctcacgagtacaatgcatggaaaatcgaagtataagaaaatatgatttccttgtgtcatgaactcgaatgttccttttaagtcaattccattgatttttcgttaaagtactaaaaaatattaa

SEQ ID NO: 49436 - DNA, 739 bp, Oryza sativa
cacatcaatgccacgtcaggtgaagagcgactcaaattagccacgtaggcaccatgtcagctaaaactgtcgtccaaaccgccatggaacctatattgcaccggtattgacagttgagggacccgttctatctggttttccggttgtaagacgaaaatcgaattcgttgacaagttaagggacctcagatgaacttattccttcaggatatggtagccgatacataacagtttttccttgggcttaaatccaaactgctcgcctattaacttttcagaacttcattgcctcatttctttccttcttttttctcttttatttatcttgctttttttcaactacaaattgatgaagacatcccagctacacttggcgtaaacaagggtgatggtgtacgtcatacatcacataaagaaaatgaagatgacgtaaaccaagttgatggattacgtctcagtaagaacgatcaagcatatcatggtacaattatgcgcagccatgctaaggaaaatacaacaagaggtgaactcgctattttctcaacttaacccaaattttagtgagaattttatactgcctaaatgctctacctttgtattgctaaggtgcacgcccgaggacatcatcactacgataagaaggatgggttaagttgaggactacaagggttacgccgaggaggaatcagcccatgcccaaccagcagctgtttacgcaaacaagaagatggtttgcgctg

SEQ ID NO: 49437 - DNA, 713 bp, Oryza sativa
actgcaagtagttcatcacctgttctattttccagcaagtacaagcacaaattgaaattacagacctgataaaacagattggggcactgacgagcctctaggtacataaactaaatatcgctgaggcgactatccaggaaatcatctttaatgttaatgatagctccggaggggaacaagcatgcagttcaacaatatgttgcctcatttgtagaagtcaaagtcagtctcaggcttcttgacattggttcggtaacccttctcgaagtccttggggaggataacataccgatttttgcgcacagcatgcataccagcttcttgacagatagcagcaatctgaaaaacagaacatcacaatgaatttcagaacagcacaagggaaagcgaatataaatgcttacagtatttattgagcaaaagctgagcagagagtaaatgtgcatgtgtagctgccagcaacatttatgccaaagcacagaattacaaatgaaaagaaaagtttgatgatgaacaaggctttaaggaacctctagggttacaaaaattattagaacatataaaggtaatctattagaggtggtactttcacataatgaaaataaaaaaaaaggtgtggtaaactacagtcatgtaatgaataaaatagaaccctaagatttggaaggttctcgaggggaaacatatatcttagattttgatgttattaactt

SEQ ID NO: 49438 - DNA, 717 bp, Oryza sativa
tctttagccaaacggaatacatctcgaaccatcctaggtccctaaacaaatgaataaaagaacttcatcaagaaaagaactagtatgcccaaaaaccatagaaaatctacaaacgaagtctcaacatccaaaacataaagcaaacttatgcatactattattgagcatgaagcacaaagacttggttaatttggagttgtcattgatggtcaaaaagattgtttccaaagaatattcagacaaaaaataggaattgttcaaatgaatacacagcatgggcaagctagatatttactagcactatcaaagttccccataattcttcagctaaaaatgattagcctatttcgattaacttatccttaacatttgagcagaactaatccttaacacattccttcttagtattcagtagcacagcagttcaaacattatgcagttgaaccttttaagtataaggctagatttgttatttcagcgaacaagatgtaacgagtgagctaagttattaatatatatacataaactggtcctaacatacctcacccaggtacttctgcacaaactctgaaccaacaactctgataaatgcagcagtagtgtggtgtgccacagctttggcgagcatagttttgccagttccaggtggaccatacagaagcacacctcttggaggatcaataccaatctgcttgtacagctcatgatgaactactg

SEQ ID NO: 49439 - DNA, 1550 bp, Oryza sativa
agaaaagactgcaacaaagaacaaccaagcaactcctctgagcatagccttgccacctcttaattatcattgcatagtgatgtaaacacattcatgaaacaaaaaaattatccacaggcagagaaacacgcaacctttgatcacgtgaacacgagaaaggatcagtcattctgtgcaactccatatcctcatatacataatagaatcccacaaaattggaatcatgctgcatcagtaaagattcggggatgagaggagatttcttcccgtaactcaccgagatggccactgagaagagtcatgagggtggggcttggacgccgccagccacctgactcacgactgctacgagcagcggaagcagcagggcgaggaatcgccaccaaggttgagcgcccattgtcgccgattgaattggtaatttttttttctctcttgtgaaagggatgaacaccgcggcaaagacaaggtgaaggaggatctgagacccttcgcgtttctgttgcggtcgattcgtcccctcgttgtcgttgacaacagcaagttactcgaggagagctcgatcctgtgtctgctagatcaaccacaaacaaaagccagtactgcttgagatcacaacacacaatcgtcacagctgcacaaaagacaaagattggcatagattaccttggcccttggggcgacacgggccatgagagcggcggcggcattgacgacattgttctcaatgaaactgattgtggagttgatgatgagtagtgtgatgatgcccacgaagtcctgccagttcggcggcttcccctgaaaaccccaaacaaatcaaccctcatcaattcaatcaaacctctcacaatccctcacatgccatgctctgaaacatcattaaattcattactacttactcctccattggcgagagcgatggccatgattgtcacagcctccatgacctaggacagcgggttccacatgaaccccaagaacttgaagaacttgctttcctgcacacacacacacacaaacaaacaaacatgaaaaaaaaactttgcatcattgaatcgattcctaaacagaacaagaaacttttctctactggatcttgggagagaaactgcggattgggtgggttaccttcttctccacgagcttgttggggccgaagaggttggcaggtaattagcattaaagatgaatccatcctaagcacagtgaaaatgcaatcattccaccatttgttattacctgtcaaatatactacaaagagaattcaggtcccaacagagatataagacaaatttctacagctaatgcaaagattggcaaagtgcagcagaatagcacgctgctagattcaaggaactaagaaataacacgctttgtaagtagaaaactatctattctaagatacttttgtaggtctttctccaaagtaatgataatacacagaaataaatgatgttataattctgaaatgcaggctaaaacattttaggaaggaaagcaaagcatctttaaaattctaagtatcatgctatctttagaaaaggaca

SEQ ID NO: 49440 - DNA, 2213 bp, Oryza sativa
ctgttgtcagagaatatgaaattgcagaagattcttgcaattttcctgttaagtgcatttctgcatgatgtctgcatgacctacatgataggagcacaaagcttttacatctttggtaaggctttcacttacatggattaaaagaatgttaggtgctagcgaaatactagtggagtaattcacagcttctctgatgtaattttgtcggagctaaaaccctgcaagctatgataatcaaactagactactgatgttggatagaactgcatattgtcaacaactccaccgtccagatatcagccatgcatgcagtcaacgaccgccctcactacaaaaatttctcttctgttaccatcaccaacatgtataaatgattaaatgtactccgaacaaatgaaatctttcacctttgctcaactgcacttccattgggggaggaaatgtaggaagaataattttcaatggttacaggataaaagaaaccaatgtatcaagtcctaatcatcgtctgtccttgcctaatgacgtctttgccaccgatttagcactatcattttgctgtacctgacgcgaacttcgtatatctaatattatatttcatcgacttcaaaatttagagttcccatttgctcctctaccgatcggtgatccgaactatctagaaatgtagaaagtgcagtttgaagacatccagtataacctcactgtatctagcgaagatattctgagttgagaatgcttctacctgaccaactgttgaaaaatgcgagctttcaacaagagggcaataattatcagccaaatcacacagcagactttccctagttactcgtatttgtcatgcatatggaagtattccctccgtttttaaatatttgatgccgttgactttttaaaatatatttgaccatttcctatcatttaattcattgttatatatatatatatatagacacacacatacatatatatatacatatacatatatatatatatatatatacatatatatatatacacatatacatatatatatatatacatatatatatatatacatgtatatacatatatattacatattccacaaaagttcttgaataagacgaacgatcaaatatgtgctaaaaagtcaatggtgtcaaatatttagaaacggagggagttgaactagtttcaacagtcagacgaaaaacaaattgtgaaccattttcctgcacaagctaccttttccttgaattgagaggaagagttttacgcaacttgtcaacagtggcttttcacggtggaacctataaaattcaaaattttctaggcatgacgttatattttgtaaaaggaacaaaagcaccgggcagactttttgagtgtacactggcaagaaaaaagaacttcacttcgtttcgtcagaatcataagaaacaaaggcagcaccgcagcacatcaaacatttcctgccattcaaatgcacaacatatgatccatattattactgctagctaacatccagagtcttagtattctcatagccacacattagtcctactcctacttaaatttcataatagcaacaaaacatttggacaaagcaaagtgcggttgggcagaggctagtatcaatcatagaacaagctagcgtctaattaaaatgtttttggtgatcatccgcaccgcccgttctattctaaaccacaattgaagctgacgaattaagttgccagcacgacgccatgtgtataaaaggggcctaagctgaacgagcttcgccacatcagtaatcgccaagctctctttcaagcgtagagacctctccacacttatcagagtaataaggaaaaaaatatagattaaaaatggtgaagctcgcattcggaagcttgggtgactccttcagcgccacgtccgtgaaggcctacgtggcggagttcatcgccaccctcctcttcgtcttcgctggcgtcggatccgccattgcctatggtgagctcaacgcattttccggtttgatatgtacagtagtatgtttcatttctgacctaccgacggcttggtttgtgtagggcaattgaccaatggtggcgccctcgacccggccggccttgtggcgatcgcgatcgcccatgcactcgccctgttcgtgggcgtttccgtcgccgccaacatctccggcggccaccttaacccggccgtgacgttcggcctcgccgtcggcg

SEQ ID NO: 49441 - DNA, 1802 bp, Oryza sativa
ggctcgtgtacggcgacgtgttcatcggctcataccagcccgttgccgaccaggactacgcttaaaagtggatgaaccgaattaattgaagtatccgtgtcagtttgcatgcatcgtacgtttgcttgatttgatattcgtcgtgtgtgatacgttcacaggctttgtattttccggtttaccttctttttgtcaaacacggtacatgtaaaaggtcactttctgcgattgttgtctggaaggggaaatcaaaattgtaaaatttcatcgacacaattgataagatcaatttgcattagatttggtttgtaccaggaaatttggaagccatgtcccttttctggctaagataatctatctatctatctatctatctattatatctatctatctatctatctatctatctattatatctatctatctatctatctatctatctatctatctatctatctatctatctatctattatattattaaaacagctttgaaaggagacatcacgttcgctgtgggggttagaaatttccacattaatcggagaaaaagaaaaaaaaagagtccaagtagaagtacaatttaaaaatagctgaaattcggaattaaaaataaacgttcgctgtgggggttagaaattcccacattaatcggagaaaaagaaaaaaaaagagtccaagtagaagtacaatttaaaaatagctgaaattcggaattataaaaataaacaatattgaaagaagtttccatataagaacccaatacgagattaatcaaaattcgaaataaaaataaaataaaaatccaaaattagaaaaggaaaggagagtccaagtagaaatacaatttaaaaatagctgaaattcggaattaaaaataaggaatattgaaataaatttccatataagaacccaatacaagattaataaaaaattgaaataaaaataaaataaaatccaaaattagaaaaggaaatgagagtgcaagtaggaatacaatttaaaaatagctgaaatttgaaattaaaaataaggaatattaaaagaagagtccatataagaacccaatacgagattaattaaaattcggaataaaaataaataaatccgaaattggcaaaagaaaataaaaaataagagttcaagtaggaatacaattctaaattagctgaaattcagaagtaaaaataagcaatattgaaagaagaatccatataagaacccaatacgagattaattaaaatttagaataaaaataaaataatatctaaactagaaaaactaaaagagagttcaaacagaaatacaattttgaaacaactgaaattgaaaataaaaaataaaaacattataataacacaatacaatattaactaatttttttaaaaaatctgaaattagaaaaagaaaattaagatttcaattaggaatacaatttataaataactaaattttttgataaaaataaatattattgaaagaaaagaccatctaaaacacatgacgagataaattaagtaacatgcctataaaggagtagagtggtggtggttgatacgagatataaaaattgttaataaatcaccaaaatagaatcctaatgacaattaaaaggagggacgtcaggcaggccgtgaagcaaacgtggaaaacggttgccgggacttctataaagtaaaaaaaaaacctcattgataatcatattcaatttttaaaatcttaatgacaataaaaagtagaagcagcgagcggggtgtataagagtataattgcagagccgccgatgattgacgggacttctag

SEQ ID NO: 49442 - DNA, 1087 bp, Oryza sativa
  unsure (1)..(1087): unsure at all n locations
atttatgcaaatataaaaaaacgaagagttgtaattaaagtaatttggataataaagtaagtcacaaataaaacaaataataattctaatttttttaataagacgatggtcaaacagtgcaagaaaaatgttaaaatcacttatattaggggggagaagtntacttttgtccacagctactagtataataacacattttttttagataatggaatataacatcccagccagtataataacacatgaatagtactttataagtggcttatgttttttaatttttctaaaaaaattaaataagacggataattaaagttgaacacggaaactccagattacatttaaatagtacttctgtccacagctactagtataataacacatgaatagtactttataagtgacccatgtttttcaatttttttaaaaaattaaataagacaaatgattaaagttgaatacggagactcaagattacatttaaaatggtacggagggaataactttgccgttaaaaatctaaaaagtttgaccatgttatctgcatgtggagaggagtgacacggggtcacgggccagccgcaactgtcgggttcaaaagatgcgttcgcaagaaagcaaacagattagagtggtggccccgcatgcagtggtaacaactgatcgaaaccacggcatcccgttcaagtagctggtttagctccacggacgcatgcctattctagtgctccactgccactatctttagtagcgccgtgtcgggctcccatatataacgtccctcgccgtctccatttggatttcagcgatcgatctcgaccgcaccggccccgcatgcctgcccactgcccaaataaagcgtcgtcgatcgaccgcgcgcgatcatggcgatggtcgtcgcggggagccatcggccgccgccgccgccgcagtcgctgcggctggtcccgccaccgccgccgcagcctcctcctcctcctctgacgtacaggcaccactgcaaggtgtgcaagaaggggttcatgtgcggtcgcgcgctcggcggccacatgagggcgcacggcatcggcgacgacaacgacacgat

SEQ ID NO: 49443 - DNA, 3611 bp, Oryza sativa
ttcgtcatcatcgtcgcgtgttgcacagccagccatcgtcgtcgacgacgcggaccaagagtcctgcgcatcaggtagcaaggacgaggagaggaacaggttcttggtgccgcagccaatctcgatggcagcccccatgatggctcagatgacagtgatcgctccgcaagtggtgccacagcacatctcgaccgtgccacgtggcatgttcgagtgcaaggcatgcaagaaggtgtttacatcgcaccaggctcttggcgggcaccgtgccagccacaagaaggtgaaaggatgcttcgccgcgaagctcgagagcagccgcaacgagactagtcagactcagactcagcagcaacacgtctcagccgctcctcatgacaataccagggccaccacctctcatgtcatcaccagcgatatcagcatggatgcaaacacgatcggtgccagtgctgatgctgacggcaaggcagcggcaagcggcgttggcgcaggtgaaattgtcctcgccggagcttcgtcgacggatatggccatgatgatgtcggtcgaggacttcgcgccgacaccgttggcgccatccgccgtctcaccgttcaagaagaaggggaaggtgcacgagtgctccatctgccaccgggtgttcacgtcggggcaagcgctcggcggccacaagcgatgccactggctgacgtcgggcgcaacggacccgctcacgaagctccagcccgtcgcccaagaccacgccatgatggccgccatgtgccaccagctcacgctcgggcgcccaatattcgaccctaccgaccagcggatactagaccttaacgtgccgacgaacccactggcagaagcggtcgcggccaggcagcagcagcagcagcaggtcgccgctctcaacgacggcgcactctgcctcaacgcggcggcgtcggtgtacctgcagtcctggacagggcacagcaacgggagccacgtgaacaagaccaccgcgacgagcagccgcatcaacgacgcggccggcggcgtgaccacggaggacgatgaagcggacagcacgagcgccaagagagccaagatcggcgacctcaaggacatgaaagtggcaggggagtcgttgccctggctgcaggttggcatcggaatttcatcagagagcaaagaaaagaacactcaagagtgacctggtcatgacaaggaggtcatgccgactaatgaactaagaaattaattaattaattaattagtgctaatctaatccatatatatatatacatattgtaggtgtacgtactatatcaatgctttatgtgatcgggatatatgtatgtgtatatacatccaatgtaagtatttacaagtagggtcaattcatgtgttcctaaaggtttgaggcaacatctagggacgtattgcttgggggactgtaaattaataggctagcaagcttgattctaaaaggtttccttactgtacgattctttgaggagccttgctttttatttttatttttttccttttattttttctattttgtaactaaccgattatttaatttgctgcttccaaaatgtatatatgcaagttgattttgtccttgtgttcactgcaattagacaagctatatgtgtgcctatatatgtttttttcttgcatttctacactatatattactctaaatatacgacgttcttaacttttaaacataatatttagctatacgttttatttaaatttattgtaaacataaaaaaatcacgccagatataaaggatctttaataatgcaaattagtaaagataaaaaaataatgtttaaagtaaactgaatgataaaataagttaaagcaaaataaatgaaacttacttcatagctaattttatgcagatatgcaaatgtataagccattcttaacaaatcaaatcacaataaaataaataatacttaacaaatttcatgtcaaaaagatatattcaaaaatggaggtggtactattctgcgggaggtgaggaacgtcaatttttttattcatatcgccacggtggagaagcttgctgatgttcgttaccagtccagttcgatggtgcatgtaaataggtcgggcaggcgcccgatacttataatatgtatataaagtgtatatatacgtatagacaacgtatatgtataatataaattttatgtatatgtattttttatgtataaaaatatatattcgtataaaaactttgtatatgtatatgtatacttgtattggtataatacaaagtttatatacatatgtattatatcaatataaagtttatgtatgtatatataaataattatatgtataaaaaatattggcgtataaaaatatacacgtatacaaagtttatatacgtacgaattaaaaaaaccgaaaaagactgccacccctctctccgtgcaacacatggctgcgacgcgcgggggaggagcatgcctaattagaattggaactagctaataatctgtcgacagtttttaaggctcaaaactttcaaatttttaaccataggatttgtcatcaacagttgaaatgggtactgttaacagtaaaatttggtaatcccaaagttaccatcggtttagagtcagtatcggcttcaaagttcgagaatcagccgatgggagtcaagtcgccacgatgtcgtgttcttggtggagttggatcaatcaaaggaagcttatctagaagagttcgagttcaagaaagatgcgacatgacagttatctattaattaggcatagtttattagtttccttttatctttaggaaagtgtgtttagtgtccgataaggactttatcttttcctttttagtttctttcttgtccgacaaggactagtatctccctatgggtataaatatgtacacccggggtcattgtaatctatcaatctatcgatcaataatactctcggcgcatcgccaccctcttccctaaggtttttacttatcttccggcggaactttggcacctgacgcagggctgcatcggctttcgatctccagcgaaggggtaagtcctacgttctgtcgggccctggtgaatctgtcggctacgttggtattgttcaaggctgcatcgattcgatctcttggatcgctctggtttggttgatatatttgtctacctgatatctcaattctatctctaattgcattgtgtttagagacgcatcggtttagttgggactgtctcggttaggtatgatctcctgtcttagccgatatatctctacaatcataatgctgttctaaatagatttgttatatctatcacattagatagatctatcggctcatcgagtattagattatcatatacaatctcgtgctgcatcggttaggttcgatctactagattgttgttgataatataagtcttgttaagtcgataggttcatgctaatgttttatcggggtactagccgataagttatctggacgttgcatcggcttgtagggattgcatatacatataagttggattagccgatggcaacaaaggtttcactatttaatctaatcttgtggatcttatgacatcggacctccagctgatgtgtgctttaaccttcggatc

SEQ ID NO: 49444 - DNA, 926 bp, Oryza sativa
cgctatcggctggtatcggtatcggctattatcagctatcggctggaactactccatcggcttgtcagccgatcggctgtttagatctactatttgcatatcttgtcagttgcaggagcaaactgactggcacgcccgcatctcatcaatctttggtcctgcacaggagctaagcagatctcctaggccggtgtgttcgatttttttcgtcaacacagattggcacgcctagtgggaccacgaattttatatccacatgtctgaagaagaagtcaatgccaagatcatggtcacggtggagaatttaatggaggaacaacaatattagctcggggggcaagtgcatcagtttcagcatggtggagcacatcagtatcagcatggttgatttttcattacattttaacactgttgttgtcttacttaacttggggaatttctgcaatttgcaagtgtgttaccttgcaaactatacctttttcttctatttgaactgtttcatccaagttcattgacgtgatgatcgattgtaattcataaacagcgtgggtctactcagctgtatccaacataattcgttcaccaagaagcaatcacccatagctactttattattatttaaatattcttatgttggttactgaatccttttttattaaggatcctgccaaacgtgccattttttactttattcatgtatcccgcaacaatgcgcggggtaccatctagtatacatattgtaggtgtacttgctttatgtgatcgggatatatgtttgtgtatatgcatccaatgtaagtatttatagtagttttacaagtagggtcattcatgtgttcctaaaggtttgaggcaacatctaggaacatattattgtaaaaagccagatgtaaaggatctttaataatataaattagtaaagataa

SEQ ID NO: 49445 - DNA, 850 bp, Oryza sativa
caaagtgcggagtgcccacttcacttgcacggtttgacctcattttgccccgtttttaggactaaccgtgaaggcaaagctgaatagcctgccaccactacgccaccacatactctcaccagttgctgatgaaatgtctttaggactaatcgtgcatgtagtacactttccggctttccgctccctgccgcctatctcggattctcggtgtgcatgccactggtgagtatacggattactataaggaatgaacacccattagctgcggaattctgtgtcaagggaccgattgccactagctatattttgactgacaaaattctaggagtagtacttgcctacggcctacctatggaccgtcagtgtcacttggccaacatcaaacgctctaggcaccggagggaggaaactcaatagtccagcctaaaccatgcatagatgcagacggctgatgtcaactgtaaattaagcatgctgagatgagctgatttaagcccagccgtttggtactctaagggattttgagtttttatttgcacagtttgaccactcatcttattaaaaaaatttagaattattatttttttgacttaatttattatttaaagtactttaagcacaacttttcgttttttatatttgcataatttttttaaataaaatgagtggtcaaagagtgtaagaaaaacttaaaatcccttatattatgggatgaagggagtagtatattagtgttggtgtgtgacctaactgatattcactgcacaccacagtcacatgaccaaacatacacggggatttgatgcaacagtaaaaggtctgtaaatgaaaaagcaaatccaggacctaa

SEQ ID NO: 49446 - DNA, 978 bp, Oryza sativa
agtactccaacttatggacttctagctattccaaaagtttttgatttctgcattgaagtatagcaaaaccaagccgtcaacaaaaaagaatagtgtgaaatctacaagttcaacagcatattgaaaggaagtaatgcgacttaagtacacaaaaggcacaaaagaaacatcaagatgagccctatgaagctagatacttcatttgtttaaaggagagcaaaattcaagtatacaacgcggaaccggtgttctcgtgcatttctctggagagaagcaggccttgtgggccatctctaaaacgctggttcgaggtagtccgcgtatgatcctacctctaactcgaaaaggctcgagatgccctctagagagtgtcgcgttaatgcaactttaccatactgctggaattaagggcaaacagtgcatgagcaggagacttactgtttattgcgtgcagagaacactagaatatcagtatggcaaagtattgtcaagggtattaatatgccctttggcagttgacacatttcactaataccctttagcaagaataaaagtgcatttaatgatcaggcatctcttttgcaaatctatgatgtagtttgagcatcctttggcaggctagtgaaaagtaacaaaataactctccatttgaaagagtgcagcaatcatacaagccgaaaactgcatgattgctaggaaaaaagtacagtttattttgctgtgtcataaacaagagtgatctggtaacctcagtaaatggcggcaatatggcatttggcatatcacaattgttctctcccaagttccggtctattctctttataaatggaagtgagtataaattagtttatacttatatgaaaaacatcaatactctttagtcagcttattagcagcagaaggtgagttgtggcataacagatcatacttgattcaccataattttccctagcagaaataatgaacatgtctttcgaa

SEQ ID NO: 49447 - DNA, 3171 bp, Oryza sativa
ggtttaagagttgttaattgtttcgcattgttcgatgttagtatgtatggttagcacatgttagtatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccaggtctgacgacgtggcgagtgtccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacagtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcacccccctgataatttgacatatcccactgagcagattaggcgtagtaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaccctaaatcacatacatataacattacaaaaatattttcctttcttacacactaaaataaattacatattattaaaaaaataacttattacaaataaatggagaacgcgaccctgtcgaactgcggcagttcgacggacatcctgtcgaactgcggcagttcgacagcccagcctgtcgaacgggggctgttcgacagccctgcctgtcgaacgggggctgttcgacaggtcctgtcgaacggcagccttccgatctcgtcgccagtcgcgctctggccgttcgataggcgccctatcgaactgcatccgttcgacagggacctattttcgcgattttccccggttgaccactacttttgcgattttccataaaaataatattaattctcaaaaaaattctctaactcacagcatgcactccctctgtatattcgttgtggcatgtacttatattttgggatgacatgctagattggccatattcgtcagtttccctgaattcttgattgccgttgataatatcctctaggaagcatattactctactgattctgagttttaagcaagatcaagtagtcctaattattcccataatcttgcagctgcttgacatcttagaatgatactatctgttgtttctcgtgctgggcataaatcaccgtggggattctcatcccattttttccttgccatattggccttagcattcggtctctgaaaaccaatagaggaatatacaacaagggcaagctctccctccaaactatgaagtgatgagtagaataactgatgctaagaagctccaatggattcacgaactatcacaaggcagttgactcaagctaaccagaataccaatgcaaaatccaaacaaaattgaagtcacaaacttgaacatttgaacgcatcaacacatatatgcacttcatcctacttgtttcacccagaaatcaagcgagaaggaactactaaattccgaacgagggtgtaccttcttttcgtcggagcgcgggggaggcacggaccgattggtggctgccaccgcagccggcgaggcggcgccggtgcaacagagctggagcgctgccgctccgggtcaggatcatcagtgccctccatgatacgaaccctaaccacccctcccaatgcgcccaaaccaccgtaccaatccctcctccggcgaggcgaaggggaaaggcaccaacccccagcctaatccccggattgcgatttgaggtagcaagccgaggaggtgggagaatttgggggcatttaactatttgcggtggttttggctgcgcctgcgagaggtgggaaaaaaaagttggcatggatccaattaacccttgttatagccaacaccaaaaggaaaagcacgtgctcgtgtcaaaccgcagccgctctcgcgcaccgcaccagctcgggagcccggtcatcacctactccgcccgccgccaccatctacaagtacccaaacactgtgccgcacgtccgacgccgcagtcttgtagtctcgtgcaccaatcgtcgcgccgcggcgacgttaggcatttcgtcgaacacctagagcgcagccatgatgctcaccaagccccacccttcgtccaacctcctcctccccaccaccacagcgctcccaaatcctagcccaaaccctagccgcgtcacgcccctggcttccggccgtggccgcccggccaccaccgcgtgtgcgcctcccccgtcgcgcccgcgcagcccgcgtcggtggcccagcccacggcaccggcgctgagccgacgtggacgttgat

SEQ ID NO: 49448 - DNA, 2011 bp, Oryza sativa
ccaattcaccagggagacgagagtacgagacgcagtctgcatgcatacataatttcgacgacctgcagatcgattaaaggcggccaatgcaagcttggcgtttgtccgcgccggcactgtttgcgttagctgctatagctaggctccgcgtgcggccgtgcagagtatggggtggcatactgctacagtacatgctacgcgctgtgccgcggatcgcgacggcggcatgacgacgcgcgctgtatcaacctcgataaatcgtcgcgattggtaggagagggatcggagggagccaatgcaagcttgccggctgtgcgcgatgatggggtgaaaacagatacggaaattcccgatcgaccgaacgacgttttcgtaatatgggtactgtttctgaccgtactttttcttaatttttaaaatttggtttttcataatttcttttacatcgtattaatatcgatactgagtagtttaaatgataaatatgttccattaccgatcgagtattgtttccgactgttttcagcccgcgcgtgcacccgagccggcggctgttgcggggacggtggcgtttaatgtggatgccacggggacacggggtgcggtgcgccggtgcggtggctggtggtagatcgagctatagcgttagccggaataggagtggagttcgcgggcccacggatcgatcaatcggtgccgccgcgacagcgtcggcagccggcaggccggccggccggcctcgcgtacttcctcctcgtgcgtatggagtcaaatgctccaggtgtttcacagttgcagcgaatacggagcacaactagcttggttcggttcctgcgcgagggtaatttcgcggtcagatcacgccgcgcacgcctacctacctgcacacctacctaccttgcaccattctactcctgcctgtttcccatcaaggccgtgtttagatcaccctcaacttccaattttccatcacataacatctaaaacttttctacacacataaacttttaatttttttccaaactacaacttttatcaaacttttaacttttttcaggaaccaaacacaatccaagtgcaaagttagtttttttttagggggggggggggctgaaaattccggaagctctgaaaatgggagcatctcaggtacaactgaaaaaaagaatcacgaatctttttcaaggaccaagtaagagcacgagctcgaataaggcggaacacagtgaacgcctctagctgcgatgcatggattgcatgacttcatcaggggtcaaagcaggaatgatgctaccgcgacagttcaaagtgcgggcaaggcttttcgtgacacgacccttctctggccgactggccgtcgaaacccaaccacgacacgcaccacgggagaaacaacagaggaagcttacaaacaaaagtgccatcttatcttggcgaggcgtggcagtagagcgtatcagggctccttcagtccagcaatcaatgtagggcatcatggacataaactcgataacaccaagcgtaccagtacgagaaaaaggaacagggagaaaggttttgatgccctcagcaacctctaccaacctgtctccacaaaggcacaagaaagccatcaatgagctctcgtcaggaaatggaccttaattgtaacaaagtcagaaattacagaacagggtccacccggaacaacgaatcatcgctaattctgctggcaagtgatcagccataaccataatacgctgatttaagcccgtgacatgagttatacaaatgcatccaagcttatcaaccaagttgcccgtgccagacaaatcaaattctgttgctaaagaaattcatttgatgtgatttggctagcagccaaaaaaaactggaaccgtgtacccggtaaaatctagactccagacgaaccagtacctttccatcatctcaaccattaggagcaatagaactataggagtataccatgcatgacatgttttggactcactatgcatcactctttcatagg

SEQ ID NO: 49449 - DNA, 1660 bp, Oryza sativa
  unsure (1)..(1660): unsure at all n locations
ccgccgcctccagcacaaacctgagcccccgcaaacgcgtaagatcatccgcgattggatggagagtgcgagaggtttttttgcgagatgatctgatccggagttcgtgtttctgcgtgcagtattccaggtgcaggagcgccatctccgcgcaccagcacacgatcgggaggtggttccaccacagggacgggagcagcagcagcagcagcagcagggtcgacaaggcccgcgccgagcgggcgcgcgtgcacgccgcggtcaccgtggcgagcgtggcggccgccgtcgcgccgtggcctccggcgcggcgaacgacccggacgacctcgacgacgccaagatggacgccgcgctggcgtccgccacacagctgctggcctcgcactgcatcgagatcgcgnagctcgccggcgccgaccacgacaggttcgcctccgcggtggaggccgccgtcgacgtgcggagccccggcgatctcatgaccctgaccgcctccgcagccacaggtgagcaaccatgcatcacgacaggccttctctagctcctgccacgcatgccaaccccgaagcaactaaatcatcttcgagttctctcgcaacatggcagctctgagaggagcgacggcgctgaggctgagagcgcagcgggaggcgaggagcaaggtggcgcggtggcgccctacgagaagaccggcagctgccgcggcgacatatggtgcaaggaagggacgctcctgaaacgcagccggaaaggtaaagctcaaaaaaagcctctccttgacacggacgcacgtcacaacgtcgtcacgtcgccgcgcgcccaaactgagctcgatcttgggatggtgattttttcaattttctcatcaggcgcttgcaccggaagcgcgtggccgtctacatcaacaagaagtcgcaggtgatcgtgaaactgaagagcaagcacatcggcggcgccttctccaagaagaagaagagcgtcgtgtacggcgtcgacgacgacgtgcaggcgtggccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaaaacgtaaaaacccagtgaattcgttttcgtttgctgtaaaatttacctgtcgagaccccgactgcccgttcattttatcgcaaagggagcagccgagacgtttcagtgttggagctgaagaataaatgtgcatacttgtaataacatgaataatttgtataaggatcagtagataaatgtcggtgttaagattttgatgtatctgctctctttacacacgccactcattacctgtttaggtagcaattccgctcaaaaatgcaaacacgcagtgataagtagtactcatatgaattctgaaggcgttgtttgacctttcagtcagggtctcgggggagagcccattagttattgaccctcttcatttacaggtatcgggggaaagcaacaatttttgcacgctaccaat

SEQ ID NO: 49450 - DNA, 2959 bp, Oryza sativa
gcctcgcacctgactccttccgcgccaccaacgttgccaccgcctccacagtcacggccgccgtcgccgctgccaccgacgcgaaccaccgcctccgcaaacgtcgttgcgccgtcgccctccaccaccaagcagccagcaaccgccgccgccaactgccgcgaccacaccgccgccgctgtcgccaacaggcgtcgccagccgaccaccaccgaccgcacccagatccggccgagagccgccgtggacgttgcagatcgcgggcgccgtcggcagccaccgccgccggcagcaccacctccagaagctcctgccgacggatgtcgccgccgctgccgccgcgacgggtgcccctgccacaagcttgccctgctgtcatcgccacgttgtcgcgagctccgctgcccccgccacgagctagctcgatccggccgccgggtggctagatctgccttcagcgtggccggatccagcgcctctgccgccgtcgccatccccgccgccgtcgacccagccgcgtctctgccgacaccatcgccttttggctgtcaaaccttacaattcgaatttaaaattccaccccctctctcgaactgagctattccgatgataaatcactaggacgacataagacagacacataacctacgtaccacaatttcttcccgccgccgtctccatccctgcgccagccgccaccccgccagatccggccgaggcggcgcggatctggcggtcaccgtcgccactgccctgggttgctcccccggccgcccggacgagatgaggttgacgagaaaatgaggagccccgccgccgccgtccttgcggccgcgcggctttgccggcggccgctcaggcggcggcgaggcggaggaggaagatgggggggaggggcggccggagattgacgcctcccgtgccacctatgggggagggcgacgcgagaggaagggtcgaactcgcttcacaaatagtgaacttttgaagctgatggcataagatggtcattaacataaattactcattcgatctcaagtaacaatgttcatacaaagactatagatttcactcaagtatccaccttggtttccaggtacaaattgctcatcttactcctaactagatgcaattcgaagaaactaatatagaaaaggctggtaaggagttgtaaggactgataaccgcggagaatacaaacagggtacgtacgcgacggcgcggtggggctcatcggcggcgatctccccggcggccgccggccgtcgtgctgtggcgtaagggccggatgtgtgggggaaaattagttcaccagctcactcgtccatccgagctggacaagtcaacaagccctccttccacatctcccgagccagccacacccgtccgatctggcgtcgcgattcatgcagatccgaccgccatgggccgtagtgcgctcgtgcctggacaggattaatgggccggtcgaagcaggaggcccattatatcgacaccgagtaggagaggccaatgcaaattagtaccacctcgcctggcgagagtggaggatgaggcagaggatgctataaaacgatgggcaaggcaacgtagcaactcatacctttctcggccttttggctaagatcaagtgtagtatctgttcttatcagtttaatatctgatatgtgggctatgtgttcactttgatattaaatttattttcttgtgggggaaggcccaccacggtagcttgctatcggggctctcgcgtgtcgccctagcgttgcactactgcttgggcccggcgcaccccaaccaatccacgtttcaaagattttgatctgctcatttagttttatagattttcatttgttataaatatttttttcaacttgcctaccgcagcgcaatgctgaattgctgcctgggctgaaaattagtatatcaaattagtatatcagtataatcaccggatggacgggggcatttttcctggtcgattagtccatttccgtttccgaaccttttggtcgattaatccgtttccgaaccttttctggtcgatcaatccagttccgaacctgcatggctgttattcgatgactcctgtttcttgactgtgttattctttactaatccctctcgctgcccgtccgttctatcgcaagggcgtggtgttggggctgaaggaataaatgtgcatacttgtaacatgaataatctgtaaaaggatcagtagagatgtaggtgaatcactgaaacatgcaaacgtgcagtaatatctcatctgtattccgaagacgtttttgccctttccgtcagggcgtcggggaaagcccattaggcccagtttagttctcaaattttttttcccaaaaacatcatatcaaatatttggacatatatataaagtattaaatatagataaaaacaaattaattgcacagtttgtatggaaatcgcgagacgaatcttttgagcctaattagtccatgattagccataagtgtaacagtaacccacctgtgctaacgacggtttaataggctcaaaagattcgtctcacggtttacaggtgagttatgaaattagatttttcattcgtgtccgaaaaccccttccgacatccggtcaaacgtccgatgtgacaactaaatattttcttttcaccaactaaacaagcggcagttattgagccttttcatttacaggcagtggaaagcaacaatactagactaggcctatcaatcgtgtatcgaactgagacagttcacaagctcagctacgcaaacagagcaagagtcaacttttgtagcatggtcattaacataaactactcattcgaggtctcagtcattatttgacttatacttataatttaaatttaaatgttacaacttggagtaagtttccatttgttttcttaatcatagtttattttacttcatttgcttttcttttacgggtcacgaggacg

SEQ ID NO: 49451 - DNA, 912 bp, Oryza sativa
aagctagaaggtgtaacatcgtggggtaacgaatgcactgcgttgtgtccaccgctgcagcgaataaccggcgacggcgatgccaagcgcaagcggcgcggatcaaaatccggcggaagatgatgccacggcacctgtagacgatacggaagaaattctccaacatgtaagcaaggcaagaataagagatatcttttcacttatgcttaagtttattagccaaaaattaaatttaatttttaggatttcttttcatcgtagtctttatttttagattgttaagaatacgtatatacaagttttattcacatatttttttttttcatttacaaatatatgttgtttgcgctgacggctcgccgagccagtggtggatccagaaaattgattcgttggtgtcataacgtatctactggtgtcatagtatgctaattatgcttaaatcatagtgctataatatatggataagcaatttaactatacgttttgccaaaattcgtcggtgtcgcttgacaccggccgttacactgtagacccgcccctggccgagccgccgatgatgctatcgacctcgcaaatgtgtgataaattgacgatcaatgcaggtgaaggacgtgattgcgaggtgcctggaagcacggctgtccaagggacaaatgttccgacaatttcgcaggagcaagatcgatccggtaatctactacgctggtaggatgaacgttcacatctgcaaaatcgatcgagctagttgagataaactaaattcagttcatcctgaccgtgcgcacatgtatgtatgaaactatgaatgtagtgtacaaggagttacgttcgcaaaacgaggagttcttcgagctgttcatgttgaaagtgtcgctgaaaaggcagatcgaccgggtcaatcatcacctg

SEQ ID NO: 49452 - DNA, 701 bp, Oryza sativa
ttcctcgcgcgctccgcgactaacgtttgcttcctctctagaaatcaaggggagggcaccgccaccggaagagggcaagaagaacggcgagaagatggcggccgccgccgcgatcccgatcccgatcccctgcgtcgcggagcccaccgcggcgtcccgcgtctcgccgggctcgtcccccgcccgctccgacgcctccgagggcgccgcgttctacgccgccgacaccgaggccgagccggaggcgtccgtcgggaggagcacgcagatgctgctcgcgatggccgccatgggcggccgcggggggccctacggccgccgcccggcgtcttcctacggcagctgcgccgcgtggagcgccgggtcgctcaccgaccaccgccccgcctcgccgtccccaatctgcagccccgtgagcagcaatggaggggagggctgccgcgacggtgatgacgcctcctcgttcgtcacgccacggctggttagtttccgtgttctttttccagggggaggcgcagtcctgaaggttcttgatttttttgctgcctttggtcttaatttcccattcttgcgtagcttgtaactattgaattgtggaaaacttcgccgacttcttgcgttagttctttggaggaaggtggtttcttggatgaggttgttcagtttcttgcatggtttacaggaacaaacgcctccagttt

SEQ ID NO: 49453 - DNA, 1064 bp, Oryza sativa
gctttaatgaacagattcgatgaaaaacaattcacaaacaagtgcgttttccagatgtcccatattgatgacaaacccgcacacccatgaattgagtcccaagagttcatcgcagacttgcaatgaaacctgccactaacatcgaggcagttcaatcgcaaaaaaacaacgcggctgcagaggtcctcaaaacccgtggtgattctcacccagtcgctctcacccattcgcattctccccgcactattccccgccttgtttccctctttccacgtcgcgagaggcctctgcgccccatccgctcatcataaaaacccaccactcccactgctttccctcccacctcaccacacaccacgccactcgcctcgcctcgcacagtcgctcgctcgcccgctctagctagctcacagctcgctcactcgctctcctcttccaaccaactccaccaccaccaccagtccaccacagcgcgcggcgccatggacgactcgtcgttcggttccgagccgaccacgtcctcctcgggcggggaggcgccggcctccccgccgtccaccgcgtcgtcgtcctcagacggcgccggcggcaagaagaagcggccgcgcaaggacgggcaccacccgacgtaccgcggggtgcgcatgcggagctggggcaagtgggtgtcggagatcagggagccgcggaagaagtcgcgcatctggctgggcaccttcgccaccgccgagatggccgcgcgcgcgcacgacgtcgccgcgctcgccatcaagggccgcgccgcgcacctcaacttcccggacctcgcccacgagctgccgcgcccggccaccgcggcgcccaaggacgtccaggccgcagccgcgctcgccgccgccgccgacttcccggcctcctccgccaatgcgggcgccagcaataaccccgacggatcggacgacgcgagcgccgggtccgcctcgccgccccgcgcgtcggacgccgctgacgacgcgctgttcgacctccccgacctcctcctcgacctcagatacggcccgcccagctcgggcctttcgtgcgcg

SEQ ID NO: 49454 - DNA, 4706 bp, Oryza sativa
ttcgatcgatccgggcccctccacttcgtcccatcccaaagcgcgaacaatcacggcagttgtaattaaccttgttccggcacagacagagagagccagtcacttcctttctctctgcagccgcacggaaacaaaaacacaacggataattcgatctgcggcgtgtgcgagaaacgcacgaaagatgggggtgtagtacgctgaggcgtacgttgacgcggacggccatgcgtggcgccacgccccgcaccggccgggacacggacatgcaggcagcgtcgcagcgaggacagcggggtggttgcgcgcataaatatggccgggccgcgcggacagtgagacgacgggcgacgccgcgcgcgggggggataaggcgagatcccatcgcccaatcgatcgatcggtgaagccaacgcccctgtactcgcgaccctgatctccctccgtctccgcccatgtcgtaacgcattcgtcatttcgtcttgggcttgtttttagggatgcttcagctttataccagctcgagttttttttcccaaaattaaaagaatttttagatatatttgtgtgttcttagaattttaaactctttcaaacagaagcttggactcgtggtgcgtagctgtgtgactgtgttgatacatgcgcacgagcaagggcatggaggtgatgcggtgatgctgctactactgttctgggggaacggagggatgggagtcgttatttttcttcaaagggacctcgttttcatgtgatacgtactatacgcgcgcgcgtgcctactcttctggggggaacggagggatgggagtcaagatgggttgcttgtggtcatccgtgttaccggtagtgggaagttgggatccttgtttcaggggttaactccggtgagcccgttgtttgtttctccttgagaatgaagcttctaaaccgcgtgctttaattcgtgattttcattgtcatggctgattaggtacgattttcctgatttgaagtaaagccttgaatacacatcttatccatcatcatcatacacatcggtacggccttaaatacatgttttcgtgaggaatcatgaaaaccacccgtttgatttccacttttttttgttactctcaacaatttctttcatttttagtttgttactgatttccaattatcgttctatatttatttctctctcttcacatgtttatcttttcagcaaaaaagcaagtttgtttttttttcccaaagcagcccactccctacgtgatagccattcgccaaatccatcctacccataagcggcatccgtaatctcacttcgtgacaagaccatttgtacgtaaagttggcaaatttttaattgaattggctctgctgttcacacaaatcacaaccagtaataggcagctgtctgatccccattaccaggacaccccaaattatagatgaaaaaagcgtcttttttctgggtaattaattaggactgttagtaagatggacgtccaacaatccacatgtggatcacacccggagatgaagtgagttgtacacccgtacccttggcaccttcgccagcaccagagggttcaggtcactatcagccattaaacaaagcttttcttttcagtaagcttgaaagacacaataatgaacttgtctaccaacataacgtgttaggagtaatttgcttcacttctggcgatagcacaagaaatgtggagtatggcttccttggccaattttttttaaagtatacgcacacacatttaaagtattaaacatagattaataataaaataaattatagattccgcctgtaaactagaggcgaatttattaagcctaatttattcatcattagtaaatgcttattgtagcatcacattgtcaaatcatgacgtaattaggctcaaaagattcatctcataatttacatgcaaactgtgcaattggttttttttcgtccacgtttaatactttatatatgggtccaaacattcgatatgacgtttttggcaagaaaaaatattaaatctaaacacggcgtatggccttaataaatttaatcatccccacgacagttcatttaaagctttgtaaattgggtaaattacactttataccgggtaatgtgccttgttacctttttatcacatatatttcacttcacactagagtgtattgatttaactttcacttaacaccaggatacataatcatcacacacacacacacacacacacacacacacacacacacacacacacacacacacacacacacacacatatatatatatatatatatatatatatatatatatatatatgaaagggctttatgatatttcattattttaataaatccctttcaaatattgtctaaattcaaaagggttttgaaagttttacacatattttacaatattttcccttcaattatatgatacaacacctagtgtgaggtacaatttatttcaatgtaaaaatatgtattaaatccggtgcaaagcaaaccaaggttcactctatccagtgcaatatgcaatttacttaaaaaaaacctaccaatgcgtttcatatatcgtgttaaaataaataaattgataaagctaccttaacaaagctttggataaaatattttaaatgcccataagaaatctatggtttgatttaaattctactcatgcaccctactaccattagtggtagaaggtactgaagagtgttggtcaatttgaaagataactgtaaaagtgccaaaatagcttacagtatctcgaaattgaaactccaacaatttgaattgcgttgaattatctacttacacaattagtctggtttgtagaatattttttcttcacctggttttgtagaatttctagtgttgtgtagtacttctacaagaaaacacgatgcttgttctacgtagctccacctaccatgtgggcctcatggggccgggaacaatggtacgactcatatatgggctacaagtaacaaaggtctgcccaaacgtctttttgtagagaccctctttttagaacaataattttttctagagactagaggtgttatttgcacccgttgcaccggggccaaacatatgcgtggtgtacaactggacatctctcctaggcctccgagaagcatagccggtggcttgaggtgctgagctgagtctgaatagaatcactttcatttctttcattcttttcacgagatcacgattaaatccttcagcagccagcctagtagggtatgggtagacagaccagccgtacctccgtttgctagctgcagccgaggggtgagagaccaaggaatggccaaaagtgctcgtcatataatgtgtggcagatcgtatcgcaccattttatgatgagacggagtaggtgaccttcaataagtagctgcgcaacattacattttttttatgttttcgttcttttaaaaaaaacttatttatattatgtcgtgacattaggtcacgaataagtttggagataaacaggaaagtttcttttctcgcctatccaaagaaatgagctcaaatacaaaatacagaactttgatggctaatgtttctctagtagtattaaattatgtcttgtcttgctacatgcttttgatcggctatataccccacaatcgtacatgtgagattacaactttgcccccatgggcccttgtgagttaaaattatactcttgccatgtcagcaaccctagatgtattatggtacattgtagaggtcattatggtcttttggcactagctggcatgagtgtttgaaaactggtctctatggaatcttcttttggcatctttcttggttgagtagctttttctctcgagtcattaagttgagtcgtcttttccatctttgttcatatttttcaacatgagtcgttttttcatcttgggtcgtctttccatcttgagatttcaaacactccttctcacttatatggctctcggaatttactttttactggttagaaacacactcaaacgggacgagttgcttcaatagcataaaaccactcgaatagaactttccactcgatagtactttaccgttcgagtagtattatactgctctcaccgctaaaatagtattttaccatttgaacacttgaaaatctcaagaccttcttctctttagtgttttggctgaacagaaaggatggtgttagtcccctgcaagtacatattatataaatagatccctataaaaacttattataagatgagatcattttcttgaagtcaatgaccctagtattgaggttcaatgtcctagtgccaacaccctcacccctagaagccgagatgtaaaggagttggagacaaagatgttaacgtcgatgacctatttatattttttaaagaaaggttgaaatataacctttttatcacaaataagtcctcaaaggcaaagagactatcacatggtgtctatttataagaaaaaaaattagaatatctattattatattaaaggaatagaaaaatgagccaccacgttcactcttatggactagaaattctcacattaatcggagaaaaagaaaaggcagagtccatatagaaatacaatttaaaaatagcagaaattcggaataaaaaaaggaatattataagaggaaactaaagtccatatagaaatacaagtagaaaataatagaaattcggaattaaaaataaggaatatta

SEQ ID NO: 49455 - DNA, 1092 bp, Oryza sativa
agggtgacaaataagtaagaggtagcgataggtgtgattttcaaaaatataaaactagaaacatggagataataaggttaggttgatcaaattcctaagataataatatagctatttaacttttttttaaaaaaataattttgtatggaagctagccgcgcaattgcgcggtcacccagctagttatattattaaaagaatagaaaaaggagctcccacgttcgctctcatggcctaaaaattctcacattaatcagagaaaaaaaaagcagagtcaatatagaaatacaatttagaagtaactgaaattcgaaattaaaaattaaagaatattgaaagaagagtttagagtccatatagaaatacaattagaaataataaaaattcagaaataaaaataaataatattggaagaagagcctagagtctatatagaaatcctagagtctatatagaaatacaatttacagaaaattcggaattaaaaaaagaaaatattgaaagacaagtctagtccatataggaatatatataatttacaaataactaaaatttgatattaaaaataattaataactaacacgtatataaaatacaatatgaatattatacatttttattttcgtaaagttattgcaaaatttaaaattatgatgtcattttaatatatttgaataatataatgagaaaacatatatgctattatatgagagaaaatataatgatgctagccgcgcaatctgcgtgggctaccatgctaattatttttttaaaaaaatacaaataggtcgtcaatgctgacccccttcacatggtgtcggtattagtgagattggtgcggagacattaaacgtcagcaccgataaccttggcaccaagaaaaagagtaaatttccaaaaaaaaaaagttttttaaggtttatttgcaaaataaattttaaagaaggatcacaatgtaaaaatctagctgcgctgcacatgtgcaccttcagatacggcccggttgcggtccggtgtggtactggtacggtccaccgagccgtccgcttgcggtgcggtgaatacagataaaactccgtactgaacccgaag

SEQ ID NO: 49456 - DNA, 2622 bp, Oryza sativa
  unsure (1)..(2622): unsure at all n locations
attgatcatatgtgtttgctattttactctaagtctcttgtttgccgaaacaaactttggtcgttgatagttttttttatggaaattgtattttaagtgacgatggacgtcttaaaacttaactagcttcgctcatgagggaatctcctctcaattttcactcattataagtgagaatcacctataagcatttgatatccctaaagaaaaggtatgctccctctctttcaatataaatgcaacttagcatagacatgacatatctcagaaatacgaatctagacagtattgggacaaagggaggaggagggagtattgtctataagcatgcggacatgggctttgagcctttgaacaagggacaaatttctgatatcaaaatgcattatatgtacacaccaataaaggatggtgtttggaattttcctctatatccagagcaggtgccatattggaataagccaaatcccccttgcaaaaaaaaggactaacctaaaatccatgtatctcgtgcgtggaaaatagattcctagatgccaaaaccattctctattattaaaccccccacaacaatcaaaacaccaaacgggaatcatgatcaacttgcgaggtcaacacacccaatgatccatctcaggaaaataaagaatttagagcaaaaaaacaaagaaagcgtcggcagaggcagcagctttatcacaaatatgcatgtactacgtatatcagctatcttatcgccattcgccaataataatctcgttcgttattcccgtatttcccctcgttgttttctcggggaaacaggcgtcgtgcgcgcgtgggacgtgggcgccatctgcagcacccacccaccagcaggaagtcgtccaccggcgtggaacgctccaggtttcggctgggcgacgcacgccgcggagccaaaaaaaccaacgcgcgcgccgcgcgcctgctggggagtacggcggcaaggcgtgagaccacgcgcggggcgatgagaactttcggcccgggtttcggctgccgcgcgcggcgacgaacgggcgagtttagccggtagagcctgacccctgtcggtggacggtggtgaggcaccgggtacacgtgccggcgccagcgccaagatcggcggggagctactacccctgattattcctcgattcacggcttggacatgggctttgtcaaccgtcaacaagtgatgactcatgatcactggccttttttgagcttctagtaaattaaaaaggctcactgaggcgtgcgtaacagcgacagtgcaccgtgatttatagctttggctactgtggacgcgtgtgatttagatagaccgacttgcggcgatgtttggatcccatgtgcaattggtccggcattcgtattaagaacttcagtacagtagtaagttcagtagcgtctaggaatgcgagcaccatagcgcttcactttctgccaaaaacacactactccagattttagggagaaacgatcagataatatatgccgatggacgtcggtggccgggttcgagtccggngccgattaaatcaactgcaactaacgtgcttccgagtcagagattacggacggaggagaagtactactaatcagcgtgctccgacacgatcgaactgaagaaaagaagagagaacgcagaggagccccatgtgccactggttaaacaagcaggcgcccctacatacacgtgtctcggatcggacaccaactgacaaccccacggctagctccacgaggcacacgatcctgcccgtctactcgtcagagactagtaacgtgggccccacgccaacggtcaactaattaacggccggttcggttttctttactgtgtttgccacttgctcctgcgtgtgttcctcccttattttagcagaaagatcacctgctccagtaggataaaaagaagaggttcgattagaccctagacaggcatgattgatgattccaaccttgtttgccaataaaaaaactgcgtgattgcataaaagctagtagccaatttaatttcttggataaattgaacagtttagtttgtttaaaaccattgaaaaaaaatcaataattcctagtttcggtcactatgtgtttccaaatatcaaaagatagagatagccatttaggacgatgctagaaaaattgatagcctaagaacaaatcaatgtattttagttagacataattttctctctcacaaaatattcatataattttaaaggatttgaaggggatttttggagtcagcctaggactaagccctaatttccctagcttgtagctccacccttagagatcaccaaggaagatgtcgttgccttttcacatcctgcatttcagtgtcctcgctagtgttgaagtaaagaagacatggttttcatgttgctaagggctgatttagtttgaagacaaaacttgccataccaaaatattggcattttaaacgtaattttgttaatgtttagtttgctacgaatacttgtcaataccacacaaatgttgccaaaatattggcattggcaaaaaacttccacatgatttggcattgccaatagtttggtatggttgcaaactaaacaagccctaaatctctatcagtgtctaccgtat

SEQ ID NO: 49457 - DNA, 3044 bp, Oryza sativa
agagagagagagagagagagagagagagagagagagagagagagagagagagagagagagctaaagattgatgaacatttgggaaaggaatggattcgaagatgatgttcagtagacagtaaaccaattgttaaatcgtgtgcgtttgagaaaggtttgggccagagatgttcgccaattcttggtttttttttatgcgtgctatcctaaccgccgagggcaactacctcgtgagatttcgttttctttatcatgatttgggcgttggagaacgtgatcacctacattatcaaagaggatggcctctgactccttccattttgtgttatactactaaccggtagcaacaatatgatcatgcatatgggattatcctatcgcccaaaagaaaatcatgagaccgatcgaccgatcaatcctccccaaattcgtcctcaaatcgcgtgtgatttacttcattgttgttttgtttacttcgcttttttgtttttaaaactaaagcttgatctgacattgatgacattagtgatctccggggccgtaaataaataaactcggagattcaactcatgatacacctgaactattagcagttagcttcctgacttctagcacttccatcatttgagtttgtttacttaagtctttgtgtagaggtcttgcacaaattgccatcactctcactcttaactttttttatttttttagaaaagttttaaaataaataaagtcaacaaagtaattatataatctccaaatgcacccctgaaagattcttacataattcttacaaacaaactcttaattgttggatgtaattatatgggagttaaattaaatctagattttagtcgatgtatagagatcacatcattgtttgtaaggtttttgtaagaaaaaacattgtacatatagccttttccttacatataattttgttaatattatgtacgcattccttaattagaaattaacatatgtacataaaacaacaactttaggatactatccctaataccctataacaattttattttattcatttattcacatttgacaactagaattataccagtgggtaaagaccaatgatataatagctattaggagctccgataaattgaaacattaggatcgctatatacatcataattgaaaagttaatgaaaaattcttccttggttttgggccaaatactattcattccttcctttctagccccaacctagtacactaccacccttcgctcggtctgtctcttttcgatccagcaggcccaacttgcacaaccggctaataaatatatttaatgtaattgtgctgcgtgtgcgtgtggtggatcgaatcagaaaaaaaaaatcagaagcctaaaaaaactggacggacagaaaaaccccgaaaactttatgtatcttttaattagttatattatagatgtaagaaatggttatctttcatgcagcttgtgtaatgacttgtatctctttcatgagagatgactcctcatatttctcttacatctcgtcatttgaatcaacatggcagtcttggaactaatacttactcgccactccatcgtgggcacttaattagccaaaatgaccacttttaaaataagttttagatgcattttttttctaaaaaaagttttagaaatggaaatttgcctgcataccttgagatttgggatagcttaagtccctggcaaacgcaggaaatttaaccaaaaaacaatatcatgccaacttcgggagcaacgtactactgtacatagatcaattctttacttatgaatggtatatataaaattgaactaggcgagatgcatggtttcagatttgactgttcttgaaaccgatcagacttgactgttagttgtgaagttttccctgtgttccaattacaagtagacactagctaatctaatactaacagtagcatccctcttggttgttctgtagtgtactgaaaactaatacaacaatgctactagtgcctgataagttgatcttcgaacaatgtgcgcttatagcaggtacatactctgagattgaatttctcaacttgtgttatcccaattgtacttcaccaatccacttccttacaagaaattcagctcgccttattttgtaggtactggatactgatcgaaaatcaacaacagttcgtttagcctttttccctacaccaacttgtcacgttctcaccaataattctcgaccggcagaatccctaaatttcttgccacgtacgtctgcatccctccaaaaattccctataaataccccttctcggccactccctgcaactcacccaagaacacactcgagctgaccacgtctagctagctatatctctcaacatcttccgagctactactagtagctagctagctagaggaagcagcagcaatggcgaaatcttgcaccttggtactactacttgtcgcactggtcgggctctcacttcttgtgagccccattgcttgctcccgcaagctcagcaagccgaaacccaagccgaagccgagcatgaagaagccggtggtccgggctcacaacaactacaccggtagcccgtcggtgacggtcaccaccggctgggccgccgccggcgccacgtactacggcgcccccaacggcgacggcagcgacggttagtgctcgcttgctttcgctttcgagcttacagtacttgcattgcacggcattggtcgagctggaactgaaattaaaatggaatcgggggaaaacttgcaggcggcgcttgcggctaccagaccgccgtcgggcagcggccgttctcgtcgatgatcgccgccgggagcccgtcgctgtacaagggaggcaaggggtgcggcgcgtgctatgaggtcagcacacacacacgacactgacacatgtacacacagcagtgtgtggtcacacgggcgagctagctattactgctgcgagagctttcgtgtagctccattaatggcggaaagtggtcggctgatcccaactcaatgcgttcatgtggccgtgtacgcaggttaaatgcac

SEQ ID NO: 49458 - DNA, 3106 bp, Oryza sativa
actcaatcctagatttgaaactgaacacattggtttttttttttaacggagggagtatgtcctagttgcagttcgaatccctgaacaatcaaccagtaatttgaactggagtagcacaagatagatgctgtacaaagaaaatactggacgtgcattttggtgtaaatcatcagcgcgctgtttctgtgtcctcctttttttcttttcgctgaaacctaatactcccaaacagcataaactccaatgctgcattatccgcccgcacattgcaaagtactactgtagtataagttgtgctataaattttgctctcctgttatgctgggttcctgccgacgaagacacatgcagttctcatcgaaagtagacaaaagtgcagagtcttgaatgttacacacactgattgtactcaattattagtagtttaagacacgaactggttttcaatggaattattaatgcatggagtacacttgtgctcctctacataccggagcttcgcttgtcctcggcattatgaactggaaactgagaaaagtcgtctagtttgtcatgtgggtctgacaaatgaagattatatataccaggagcgacgaccatggatttcgattcagaaagtttttttttctaaaaaaaactctgcctatttctgcacgagtgtgcagattaatattgtacagtacccgccgtcatatggatacagatttttattttaccacttagtttatgtcatttgatctacttaattccactagcattcaatttcttatttgaaacgtgccgctggttgcatggattaaaaataaatctcaaaattcaactagcaaccaattgcctgccccagatttaccggaaagggatacccacatgttagtgctcaactgcacatccagttttaccatgatctctacgtagtagaaattactttaaaccattatctttttttttctgatacaatgaaacgtatatttggtactagcatcttgactttttggttgtagaatatctttttccacaagcactgataatagaactaataaatcaataattgagtttgcttttaatcgtgacaatattagtagagaacaccgtaaaaataagtatgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaatgcaaaccacatccgatgctaacaaccaatcacggcctaacaaactagtagtgcggagtacgtgccaacattttgatatggcatagtctcagccagcaagcaaaaaatctgcgcttgtctcctttttctcgttttaatgcatcacatggcagaaagtgaccgtgcgtaaatcattcataactaggagtaggctatttcaagaccttcaattgctcacagtacaacgatctagcggcggtgatacgaaagagaccaccatctatggcacatagctctctttcccaagaagaagaacatgctgcagacctgacctgcaacctgcattcaggtgcggctcgcgcgagtggtcgatgtcaaaagacgctacctagtcactgtcaggatccatcgcgatcctccatggctgcgctccatgtgcccgccaagcgcacacgacaacgatctggatgaaaataataatcgctctcgaaacggcacagtgtacgagcggaaaaccgatcgagagctcccccatgctctgaccgctcgcatgttccgctcccccgttctgtctcccttcccctcccccctgctaataatctcggcgtcgatggatcgatcggttggtctgtgcgtttcacagtccgtgtagccgcctccggccaccaccaccatcaccaaccaaccaaccaaacaaccgagcgagcgatcgtgcaggcggcgtagcgtgaggtgaggtgagcagcgcgcgcgcgcgcgcgcgcgttccccaccgtgtcagtcgcgggcgcatgtggagagattctccggtgacgggagggtgaaagactgaaagcaacgggcgcacatggcggtggtgctgtgcatgcatgcgacgcgcgcgcgaccccgcccgcggccacggttcggctgattttgttgggtattcgcccctattcgaccgaggggtggtcaaaactcaaaaccccgcgaacatgttaattggcagcatcgaaatttctaatctgtcctgtccttccatacatctaccctggattcggatcaggccactttggcagtacccaatcatccagccatccagcacacgagagatggcccagatttaaccgtgtcatacatcattttagctatttgaacaagcatagaacagtttcagttcagattttgcctgcaatttctctccctttgatctgaattttcttgaactttaagacaacccaaatattgttaaagaaaagtagacacatacttcatttcattatattgaacttcataatatcttgcacgcataattgacaaaatgagctagagtttaagcccttgtttagtttccaaaatattttttccaaaaacgtcacatcgaatctttggaaacatgtatgacgtattaaatatagataaataaaaaaaagtaattgcacagtttacatagaaattgcgagacgaatcttttgagcttatctttgatcttatttttctattataatatataaaataataaatgtatatttacttttattatggtgttttgaaagacaaatttatatatgttgtcctttaaactaaatatttttaaaattattgatgg

SEQ ID NO: 49459 - DNA, 738 bp, Oryza sativa
gggaaattaagcaacgaatctagaccatcccttgtatgctggatggttagatgatggatactgctaaagttacatgatccgaatccatctacccctggcttctcatttcacacggcaaatgaaaacagtatatattattgtcctgtgcgtgcagcgtgcgtacgtgtctcactcttgttggtgtttatttaccggcgtccgtcgccctggtcccgacgtagtacgtggtgttatgttaacaggcggccgaatgtcgggggtgattcgtcccctaacctgccactgacaaacaacatggcagtagaatcgcagcaggtacactggtactggttacagcaacagttttttttttaacaaggctttccagtttccacatgcgtgtgtaacttctttgtaacatccagtgtgagtgccggcgcgtctttacatacatatacatacattatacatgcacatacgtacatatacgtgtcgtgaatgggcaggatctcttagggtgtgtttgaggagaagggaattgaggagattggggagttacgcaaaatgatgtgagccattagctcatgattaattgagtattaactattttaaattttaaaaatggattaatataataaagcaattttcatataaaattttttttataaaaatgcaccgtttagtagtttaaaaatcgtgcacgcggaaaacgagaatcaatctcccctatctcccgagacgaacagagccttaatttac

SEQ ID NO: 49460 - DNA, 712 bp, Oryza sativa
atttcgatagatctttcatatttcttagttgtaggaatagagttgttattacttctcttgttgtatatataggccccgttcgtttcctctgaaaagaatggataaagttttggattttcgtggcacgtttttcaaactgctaaacggtgcgtttcgtgcgaaaattttctatatgaaagttgttctaaaatatcatattaatttattttcaagtttgtaataattaaaactcaattaatcacacgttattactacctcgttttgcgtgaaacacttgtttaggagattcaaacaccatcataatctatcatagtggaaaaagtaaaaaaaaataatcaaagtttgtaacgactaaatacgaacaggagcaattgaaacgagctactgcaactgccgccttttctgtaagaataccgcaactgctgtcgtcttccgtttagcaacaaccgttttaattcaaatttacctttttccgagaacagctcgaaagcacatagcgtatcggcggttgcttgatactcacaaagtcacaagtacagccacatttcggctacagaatctgatccaaaggcagatacagagcgtatgcacgtatgcgtgcatgtggcttggggtcgcctcaactactaagaaatcgaaaggtgtggatgattagagctctctccattattacaggattagctatttcatccactaattaattgctcttatt

SEQ ID NO: 49461 - DNA, 1321 bp, Oryza sativa
atgtaaaatgacatgttccaattgagaataaatgatacaaagtaataaacattctggagcacctgaagattgttaggtctcattcaggtgaacattaggatcttttttgcaatagatggagcaaaagttgaaaggactatgtaaatgacatgtcccaatagataatgatataacataataaattgttacagagcacatcagaattggttatatctttctcacctgaacattaggatctttttgcaataaactgatataacataataaattgttacagcgcacatcagaattggttatatctttctcacctgaacattaggatctttttgcaataaacggaaggcatccaaaacatttctatgttcccttgtcagaagagcagttgagttgagagcataggcagcaggttcaatccagtcatctgatcctgatgaattgccagatgacgaatgtactgaggtggacaatgctgattgctcctcagtttcataagaatgcgcacgaaaaggatcaccaaataccctgaatgcaaatggtagcctgatcagatggagcaaacaacacagactacatctaaatggctcatgttcagcatagatgattgacagtatattgtatgacagctccatctaaaacaatgttcttcttgtcttcaagattatatgagtacagtacggagattagtttattagtttagatccattttcaacaaaagatagcaaacttgatcttttgtgtagccataagcccatgaatatcatcggttatgacaagaacacagtttgttaggtcgcttctgaataatagaagaaacccaaagtgtataagaaactcagccatgggattggaaaaggctgcaagcaaatcttgaatgttactacttttccagtcataattctgtatgtaactacaggtatatatcttgaattttgataccctcaataggtggatccatgtattgtccaattttaatcctttaaaattccattcagaaatcacctactttctccgtcccaaaatatagctactgaattagacacaacctaccctctatcctgattcgtactaataggttgtgttaactgtgttgccatattttgggacggaggaggtatagtactacagcacatgccatggaacagtccaaattttcaagaaacgtatgccctttaacgaactcatgattgttcattcatgaactctgcacggcaagtgttccaaggtccgttggcatctgtccgtgcagatcacggaagtacacgatgcttccccaggctcacatccaattatggaggagaaaccaaaccaaccaattgcaaac

SEQ ID NO: 49462 - DNA, 1224 bp, Oryza sativa
ttaatatgatattttaacatttgggaagcgtgtgcgcggagaacgagagaaatctcctctctttctccattgatcaaaaatttttgttgatgaggaaactctcatcaaatagtaatctcataaagagtttgctcggttatgttttaccatgtccgcaatgcagttgcaatcgacaactacaattaccgacgtcaacaaatgaatttcaatacttggttgttgtagctgctataatggttttattgtaaatcgcataactaaactggattaaagatgatacatagatgcggtgagcgtaataagaaaaagaactgcacataatgctcttctctctctcatcacgcatacagagaaaccctccccaatattttctcctttattcaagagcatttttccacatagtgtttaaaaggtaaactcaaatgatatttataaaaaaagtatatcccagtagcatattttattcgtccactcgtttttggggtgaggaaaaaaaatcttgtattgtgctcgtcattgaaaatacgaaacagaaaaaaaaatcacctactcgaaattaattaaaatcttcttgtttggttccacgcattcagcttacgtggagcaaccattttccatgcccttggctcttcgttgcaccatgcttgatgcttcctggtcatagggtagaattcatccacgtcgctttgcaggcttgctgcacctgactgctacgtgcacccggagtactactcataaaacaggatttgtcagacacaggcacacagcgaacctaaacgacggaccttttcaggccccacccacgtgccattgctttcacggatcagatactctccgcgtctccacgacgagcagaaagcaccaactaatcagctacagcgtgcgcaaatctcaaactagcaccacgctaatttaaccttctcagtcgatttatcattacaaaaacatgcgcaaaaccaatcaaatttacgcacgggatcgatacgagacttggttcttgcttgtgacgaactcagaacgacgccagctagcggcctagcgcgcgtggctgctgtcttcacgccaccatgcaccgcgcctgtatcgaaaccgtaacgcgaccagctgacacgtacgcgtacgcgcggggaggggacgtgcggcgccgaaaccgcagccagccatgcccgaggcaattggatagcgtgcgacgatcgagaagagagggtgcggcggctcgacgag

SEQ ID NO: 49463 - DNA, 4343 bp, Oryza sativa
tctatgcgaggcagggggtaaggatccttaggacatgccttgttaaggtcggtgtagtcgatgcacatccgaagcttgccgttcgccttggggacgaccaccggttcgccagccactccggatggatgacctcgcggatgaatccggcctccagaagtcgcgccacctcctcgcggataaaggcttgacgttccggggcctggcgcagcactttctgccggaccggcctcgcgcccggccgtacggcgagacggtgctcaatcacctccctggggaccccgggcatatccgccggtctccatgcgaagacgtcagcgtttgcccgcaggaaagagacgagcgcgtcttcctatttgccgtccagaagaccaccgatccgtgtggtcttggacgggccgtcgcccagggcaacctccttgaccgggacctcatcgcacgtgactacccgctgcctcggggcggcgggggcggatgtgccaaacctctcgtcgccaccctcgggcttggtcacgacggcgaggcggtccgcgcgctgctccatacaagcgagcgcgactttgaggtcgccatggacagagatggggccatcggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcgggtccaccgaaggtgaccgggaggtcgatatgacctagcggccaagtgtgccccggcgtcacaccgatgatcggctgggacggccggagcatcatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcaaaggtgagggcaacctccgaccgccgcgcccggcgcgtcgcctcatgagtaggggccgcggccaggagctctcgcttcatggccttgaggctccggcaagaaacgtgagcacacgctccccatcgacagtggcaatggtggccccaggctcttggaaacctaggtcatcatcgccatcatcgatgtcctcggcgggggccttctgcttggcctcacttcgccgattgccggaaggaaccgccggggactttccctctcggcgctcctgcctcctctcctcctcccacttcctcgtccgctcagccaaacttttgactacacggcagtccgcgaggtcatgaagggaagtgttgtggacggtgcaccacttgccggttgggcgctccctgctgggagcgccggcctctttctttttgtcacccgcaggcctcccctttcgggtggcccgcggagcgccctcgacggcgaggacatgaccctcgtcgtcggtatgggctgacctcttcttcctcctcctatcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtattacggacttgacagaaccgctgaatgtacgagcgaagtgactcatcatcccttcgctgtactgcgtgcaagtccgcttcctcaccggggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggcagcacgtcggtcattacgccggcgctcgatgctggtgcgggcgtccggccccccacgcagatcttcccgggtcgaaggagtcgacgaaggagtggcggccgaatggcgaacagcggctgccgctcttcgtgccctccgtcttgacgacgcggagccggtggtagcagcaccagaggccttggtggcggaggaccgcccaccagcacctaggcgctgccgtgcagtcatgaccaatttggccacatcgtccagccaacgttgggctggagactccgggtcatggacgacgggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacagaaaaagcttggcgcacacgaaggagtgcgagagctcagaagatcactcgcagagtcccctacctggcgcgccagatgacggagcgtggggctcctcaccgggagaccgcgcaggcccccctttgccggttcggccggggaccctgggtgagactctaagctcccaatctgtatgtggaaggttcgcgagacaggaagcacagaagacgccggcgatgtatacaggttcgggccgcttagaagcgtaataccctactcctgtgttttggtggattcgtgtgtgaaagagctacaaagtatgagccagcctctcccttgttctgggttcctaatctggaaaggttcagtccaagaaaaagaaaaaccccctctctcggtgggcaaggtcctccttttatatcttaagaggataccacatgcaccatttccctcttttttgtggggacctcccccaccttttcataaatggacggagatttgtatagttgccatccgagtcaccttctgatgggacggcccacaactacccccactttcgccgggagcagatgcgacgtggaatcgtggccgcctgctgacgacatgaccggagtcagaccagtcacgtcggtcattcttgtccaccacgtgtcagcttagcaatctacatgtccgcccttcttcacacaacatcttgcttgtaatggttaggatgaagcctggcatatatctgatcagggctaacgtgccatctctgggaggtaacacgctagctccagctggggacgagcgcctagaagccctcgtcctgacgggatggggcgaggcgtgtgtcagatcgcctgtggccacctaacccgcgatctgaccggtctgtgactggtcacagaccggataaacgagtgcactgcactacgttgcatgcggcgtgacacgctcagtcaaaccgcaataaatgtggtaggtgagccccactgtgctcacctaacccatacacgcggagcaaaaaacccacgaggggtcggggcgcctcggccctcggggccgaggggggtgcagcccgaccccctcggggggactaggaggagggcgaacacatcaccctcgggcccgacgtcccccgagggtgccaggccacgtgggcgattgcgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaatcacgcacatcggcagtggtaactcggctgtcaataatgagcggtctcttcaagactgccacattactcgagtagcacacgaatctggacatggcgattcgtttcgtttggagatatggtaacgtcgctttggtcggcgagcgtaattaccgcgcgcacgatatgatctatctcgactgccacaaccgcatatccacctcatgcgccgcaagcgggcgaatgggattagtggaagcatgggcgcgagaa

SEQ ID NO: 49464 - DNA, 1386 bp, Oryza sativa
cagccacgggggccggtgctgaaccgctacatcccctgcgccctccgcaagaagtgggacgactggaagagcgactggttctacaccccccttgccgacgaagtgcgcctccgacttccgagccagcccccggctcaggcctccagctggcgggcgccggtagatctgggggatggctatgacgccgtcctcgaccgcctggcgggcctgcgatcccaggggctcacaagagccatggtgtacggcgactacctccgtcgtcggattgcgccgctccagcggcgcgctcggggcgcctgggagtacaccgggtccgaagacttcatgaggactcaccagggagtgagatgggactgggctcctgaggacttcaagatattggtccaacgggtgctgaatctcaactccgtggaggcggccctcattcctcaaggaatcctccccctctgcagcgatccagaccgcgcctccatcctgaccattatgatggcggtcggggcctcagaggagcgagctccaaagggccacgacggcacaggcgggagccgccggggggaacaatctatcccgagagggggtcgtgcttctgggtcccgcgacaggggcccggggagcagccgccctgccgatgcccgggggaagaggaagcagggaggaacacctcccccatctcctccccgagggggcggggcggcgcgtgccagcagcaggcgcccggagggggccgcgccaacatcgcagcccgagggggagcgcaagaagaagtggccccgcaagatgggggagacagaaccatctcggggaaacctcatttcccctccaaagtggtcgtttaaccgaccccctcgcaggttcgtctctcgcccatcgtggttgtattcattctctcaacgcgagtttttactcacccatctcgttcgtcttctggtcttttcttttgtttcagcgagatcccgtcgcgtccctcccgccattccaagtccggccagtctgaggctgaggatccggcggccgcagaggcccgcaggcgggaatctgaccggcgagaggccgcggatcgcctacgggaagccgaggaggccgcccaggaggctgcccgggctcgccaggccgaggaaatcgctcgggaggaggccgcccgggcccgccaggccgaggaagccgtttgggaggaggccgcccgagcccgccaggacgagatgttggcgacttccgaggcagctcgcgacgaggccgcggacgcgtcgcttgggcccactccctcgggcgacgctcaggcgacaacttccggggcagctggcgacgaggctgcgggcgcgtcgcttgggcccatccctcgggcgacgcttagaaccaaccgggtccgctcagacatccccgagtccg

SEQ ID NO: 49465 - DNA, 2466 bp, Oryza sativa
tgagctcgaggcgcgggcgaaggagctggacgcaagggcgcgcagcggcggggcggccgcgggcgaaagcgacgtagccgcccgcctcgcagctgccgaacacaccatcgccgatctgcaaggcgcgctggactcgtccgccggggaggtcgaagccctccgcttggcaggcgaggttgggcccggcatgctttgggacgccgtctcccgcctagattgcgccggtcggcaagtgggcctctggagagggcggaccgtaaagtacgccgacaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggtccgggatgccgccgaccatatcgtcgacagcttcgagggctcggcccctcggcttgcgtttgcccccaactccgacgaggagggcaatgccggtggtgcagacgacagtgacgtcgaggccggcggtccgggcgcatcggatgagcccccagacccccgccattcttcagttttttcttcttttcttttttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgattaagggttcgtgcccaggtcccagtcctcaaaaggcgcgggtcggggctagtgcctggggagatccacatgtcgagactggccaggccgggaacgtggtgaccgagggttatgggtaacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagacacagcctttaggaaattgaaactgtctttattgaaatattgaaataagagaaataagaaagtgcatgtgtggcagcccccggccaaccctgcacgcccgagggggtgcggggttggcccgagcccgaaacctgacacccgaccccccctcaggggtagaagcgacgaaggtgttcgatgttccacgggttaggcagctcagtgccgtcgcccgtggccagccgtatggagcccggccgggggacgccgaccactcgatacggaccctcccacattggtgagagcttgctcaatccagcacgcgtttggacgcggcgtaggacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttttggggtgggcaggtgaggcgaagcagagcttgatgcccatgtcttcgcagtagtcgccgaagagttcactagtgaattgggtgccattatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatattgagtccccagacagcaaatggccacgaaagtggtatggtctgcagggcctgggccggctgatggatttgcttggcgtggaattgacacgctttacatcgccggaccaggtcgaccgcatcattgagagctgtcggccaataaaaaccctggcggaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttgg

SEQ ID NO: 49466 - DNA, 1222 bp, Oryza sativa
aattaaatttcaaatataggctcaagatgttcaaaggtggcttgccttgctcgagatctagagcttgatcctcgaaatcctcgcactgcggttcttcgggctccgaaactatacgcaaaacgggacaactcaacaaacggcgaaaataaagccctattaatgacctctaagcgtgccattagagagatctcgagatttgaggaattttggaagttgaacggagtcaaacggatttacggttgggaagatattgaatttctaagattactggatttttggtctaaaggaaaaggatttaattaaatcctttttgaaaaagaaaagaaaagaaaagaaaagaaaagaaaagagggagggaaattagacttttcctcgggcggctagggcgcggcctgagagaaaaggggcggctcggccgagctaaatgggccggccggcccaaggcggcccaaggcacgcgcgcgcgggaggggaggagagagagagccggtggaccgggctcaccacgcgcggtcccgggtgggacccgcttgtcggtgacacggttcaccgtgcggagcgagcacgcggcgcacgcgcgcgggcggggagggacgcggtgtacgcacgcggttcgcggtggacgcggatgcggcgggcccacgcgcagcctcacggctcgcggtggaacgcgcgcacggggagggactgaccggggtcggctcgacccggtcttggccgagctggcgccgacgtggcgcctacgtggctgccatgcgggccggcgggaggtagacgacgacgccggccggaacggacggcggacgacagcggcgagcggcggagcgaaccacggcgatacaggcggaagcgagcacaccgggtggttgcacgagacgaggggagacgagccaactgctcggattcaccggagggagcttgacggcggcgaattgcggtggcggcaaccggcggcgggagaagggggaaacggcgacgaggttactaggggccgattcccggcggcgagagcatctacgcggctacgggaattcgatgctagcgttggattaggaggaaacgcatcgagggaggccggcgacgagaggcgcttccgagctcgggcggcgacggcggcgagcaacggtgagtgacggcaacggtcagggcggcgccggctacctacgaggaggctactcaagctactacccgagtctaaggggaggagatggagcgaggaggg

SEQ ID NO: 49467 - DNA, 774 bp, Oryza sativa
ctatttaagtcaacaaatctgctattcaagtccacaaattaacaacctgtcatgcaaatgatcaccaaatccgtaattatgtccaaaaacacacctcgtatcacggaaatcaccaaatatatgctactagtactattcaagtcccagctgtagattttgaacagtaacttaaattccacattcgtctttgcctctcgcgggtaccgagcccgacaaataaaagcagaaggaatttaatctttcctttgtaccactgtgccgtcgacctgccagccacaggttgcagctgcctataaaatagacagacggcaagttgtacacacatatccaggggcgcgcacagtgaaggccgcggccgcgctgctgttcgatacacacaatcggcggcgacatggcattggcagccaagctcctcccgtccatcgtcgcgttcgtggctctcgcctgctgcgtcctccgctcatccgtcgcgtccgtcgaccaccaccggaagctctccggctggtccatcggcggcgcgacgtggtatggccctgccaacggctctggaaccgatggtacatctacctcacggactcgatcgatcatcaccagaggatggaccatatatgcgagcggcctgcaggcttaattagtactgacgaggcgtgctgcatgttgatgtaggtggcgcgtgtgggtaccagggagacgtcgggcagccgcctttccactccatgatcgccgccggcagcccgtccatctatgagtccggcaagggctgcggctcttgtt

SEQ ID NO: 49468 - DNA, 705 bp, Oryza sativa
aaagaaaaagcagccacttaggtcatcttgagttccgaataaggttttagatgtattgcatttgcttggttacaatactaaaataacctatatttaaaattagaaaaataatgattatcaaaactaagtgcatgccaactaacaaaatttccgagcgatccatatgatcatacaaattcggtgatgagcactgtaaaacatactcattgccaacaattaatctagcagtcatgtttacaaatacaaccaataaaatacgatgaaccataggtatgtaaccgtgtttttatcaaaatgcacatgattgttaagtttatgtatcagtttgcttattttacaattttttacattaaatcgcacccacctactagtttttgtaccgctggcgcaatttactctaagaataaactagttcgtccatggtactagagacatggcgactgcggaccggccgttgtttttgaatttacttttcaggactggatatttccatttatcaggatcaggcattgaaatattcctgatcatgcccaaaggtagtaatcacaaaccggttcacttccatccatctcgccgttgttccatcgcttccaacttcctccaactgaaaaattgtttctcggctcgtgccaggatatataccgtctcggcgaacgcgccgatcgaaccttcgcgagcacccatccatgcatcgatcagacgttg

SEQ ID NO: 49469 - DNA, 738 bp, Oryza sativa
caggtcttgaagagttcaagagctgcacgtggagacaactgcaacgtgcaagcgttcttctgcgcaggatatcctgcgcgcatcagttctctgaaaagagactgcttccttatccgatccagacgagacttgcgtggcgtggaatcaaccggtttccagaacgtccaagaacaaacaggcctgcggcgaagcagtgaagcacccgttctcgctgcctttgcctccgaagaggaaccacgcaggcagcgatgaggtagcgctgcagcattgcaaggcagagctagacctgacatgcaagaatatgtactgcactgcttccctagaaaaaaaatattgttccaatcagtccatattattcctgaaaaaaattcttgctccaatgaaattctgcattggtatagtagtacgtagtactccttgtatagctagcttaattagcaccatacattcatcatggctgatcacaccatttcattgcatgtgtctgtacgtacgtgccatggccgacgcatgggccgtactccgtacctcgcacattactcgcttggacaaattcaggcggtgcggcaggtgcatcgcaagaatcgatcgatcggcacacatgccgcagcagtggtcgcgacgacggccggcgcccacacggcgtgtacatgatacaccgtatctgcgtctgcactggcgcagttcaatggatctcggcggttgccgtacgtcttcatcgatcccctactccccctg

SEQ ID NO: 49470 - DNA, 2000 bp, Oryza sativa
tgataaaaaataaatatatatatatatttttgacaactttacaaaaagtaacatggtttaaaatgaaattaatctgaaccacccttcgatcttcgggggtactctcctcatcacataagatagcaacgtcgaactacgaatcttcttagtcccatccgggacggagggagtagtgcgcagtactgttaaacgccgttaaaagcttccagctctgaacaacagatatgataactgacgcggcgattacttgtgccactcctttcccctacatccactacacgtacgtacgtatacatggacacgtggcccgtctccaacccggtcggcccccgcctcgtccaaccaaaaaccgcgcacctgggaagggtccccccacgcatcacgcagccaagtgccagccgcccactctgccaccaccatccacccacgatctctctctcctctatatctcacgcggtctgcacggtcacactcactctcggtctcactccctggagctggagcgtattaaaacccttctccgtccattcgatcctgccacttcctttctctcgccacgatctcctccatctctctctctcttcctcctcgccggccgagtcagctatctcgccgccgcctgagtacgtacgtccgtctcggtatggccatggccagtggcggcaccgtctgctccatgtgcggcgacgtggggttcccggacaagctcttccgctgcgcccgctgccgccgccgcttccagcactcgtacgcactcctccgtatttgcctcgttaatttctacctctctccctattgattcctggcgtctaggtaggtacatagtgatcagaactgacgcgtcgtggcaacggatgcatgcatgcagctactgcaccaactactacggcgacggggcaccggtggaggcgggcgccggcgtgtgcgactggtgcctcagcgacgccgccgtcgtcgccgggaagaaggggccatcgtcggaagggaacgaggagccgttctccagggagtaccgtggcaggagcaagcaggcggcgtcgaccggcggaggcgagcaggagggcggcggcggcggcggccggagggtctccaaggccggcgctgtccgtaggtacaagcttctcaaggacgtcttgtgctaaagagctatggtctaatacggaccatagctgatggatcaatccttcattttcactgcgtcaccccgtcatgtacaaaactagctctagctagtaggtgcccatcgctaggtaattagatcatccctgtgtaaattgtccccgtgttaattaaccgcgcgtgtgtgtatgaatgtatgatactactccatcctagctaattaaagctatatgtatgttttcatagacatgtcatgtttgacgagaagtatcaacttgacaactagtgaaaggaggagctagcctaggtcttgtatgcgtgacattcaccaactaattgtcgtcaaaccctacttgcaatacgtgcggtgcttcccgtcattcattatcgatcgtcatcggatcgaggaaacgagctagactgtcctcaactcgatcgatcggttgatgtttacgctccaaatcgcgatcagtctccatccacatcgatcgtcttcaaacgatcgcgaaacacgaaccatacacatcagtactagtacttaattaagacttcaataattaagcactattacacgtctgcttgattattagtttcatgcatgaaagacgacgatccatcatccatcccttcctctggcacttgcgatatgtacgtggtactcggtagttgatcggtacgtactaatccagaagaagactctagaaggcgatcgcgttgcatgctcggcaccctcgccttttttttcttctcctcggcggcgtgccgatgcagaggaatcaaatcaacaactcgtacaagtacggagtatgctgcaaaatattaaaggactccaaagtggccgacaaacaccatgttatattccccccacttgtgggttagcc

SEQ ID NO: 49471 - DNA, 1628 bp, Oryza sativa
tcaatgataatatctattatattattaagacagctcgaaaagaagacaccacgttcaccgtggaggctagaaattcccacgttaatcgaagaaaatataattatttacaccgttggattgtaagaggcatagatttcaatgtctgagatttaagacaaacttggcatgttaattaagagatacggagtaccgtacgcgtgtagaattagaatcaatctctagctaggacctttacatgcaaacggactcaaaagagttttgtccgatttcctaaaccaattaaccagagttagagatgaattaggctataatacacatatataaataaagcagcgggcaacgaaccactatagaacagtaatttggatgcgtttttgttgatatgaagatagatgctagcagcgagcgacggaaatccgaagcagcgggtcaagccgtgcggctgcacagtgagccgtatttgggtgatgcacacgtcagcaaccagaatagcatgatggcatgtgcacggatttttatttgattttgaaataacacaataaaaaatgaaagaagagttcatgtagaacacaattaaagattaattgaaatccataataaaaaataaaatagatttagaaactagaaaaatcaaatataagagttcaataagagttcaagtaaaaatacattttacgaacaactgaaattaggaataaaaaataagaaatattagaagaataattcatatagacatagtatgagattaataaaaaaatatgagattaataaggaatattaaaagaagagtgcatataagaactcaatatgagattaataaaaatttggaataaaaataaataaatccgaaattagcaaaagaaaataaaagaagagttcaagtaggaatataatttaaaattagctgaaattcggaattaaaaataagcaatatttaaagaagaatccatataagaacccaatacgagattaattaaaatttaggataaaaaataaaataatatccaaaattagaaaatttaaaagagagttcaagtaggaatacaattttgaaacaactgaaattgaaaataaaaaataaaaacattaaaagaacacaatacggtaataactaatttttttaaaaaaaaattctgaaattagaaaaagaaaaataagatttcaattaggaatacaatttataaataactaaaatttttgataaaaataaatattattgaaataaaagaccatctaaaacacatgacgagataaattaagtaacatgcatataaaagagtagagtggtggcggttgatacgacatataaaaattattaataaaacaccaaatagaatcctaatgacaattaaaaggagggacgtcaggcaggccatgaagcaaacgagtaaggcggttaccgggacttctagaaagtaaaaaaaaacaaaccccattgataatcatattcgatttttaaatctcaaagacaataaaaaggagaagcagcgggcggggtacataagagtatagttgcagagccgccgacggctgacaggacttctagaaaataaaaaatgaattccaacgatattgatgttcgatttttagaatcacaatgacaataaacagtagacggcaaacgggct

SEQ ID NO: 49472 - DNA, 1411 bp, Oryza sativa
aagatttcaattaggaatacaatttataaataactaaaatttgtgataaaaataaagactattgaaagaaaaaaccatctaaaacacatgacgagataaattaagtaacatgcctataaaggagtagagtggtggcggttgatacgacatataaaaattgttaataaaacatgaaatagaatcctaatgacgattaaaaggagggatgtcaggcaagccgtgaagcaaacaagtaagacggttgccgggacttttataagtaaaaaaattaaaccccattgataatcatttcaatttttaaaatctcaatgacaataaaaaggagaagcagcgtgtggggtgtataagagtatagttgcagagccatcgacggttgacgagacttctagaaaataaaaaatgaattccaatgatagttatgtttaatttttagaatcacaatgacaataaagagtaggtggcggatgggatgttgaggtgcgtagtggcatcgtttgataggacttataaaaattataaaaaataatgaaactacaagtccaatttttaaaggttcgtaacttctaaaaggtaaaaaaaatgataatcatgttcaatttaaaaatctcaatgacaataaagaaggaaggcagcgggcgagctatagaggagtacaatggtaaagccatagacggtttggcgggacttttagaaagtaaaattgaacctagacaataattatgttcgatttttaaaatctcaatgacaataaagagaagagacattagacgggccgtagatgagtataatggcaacgtttgacgggacatctaaaaattataaaaataaaacccaacatgacaataaactctagaaactataaaatctaatttttaaaggttccaagaagaataaaaagaaatagtggtatatcgagcaagcaaataaagaacgagatgacataaggggtagcaactggtgtgacttttaaaaactagaaatacgaggatgataagggttggtctttcaaagtcttaagacaataagatagctatctaataaattttaagtaaaatcatataaaaaatatgtgatttttttaggtgctagccgcgcaattgtgcaggccatccagctagttcgtttcattttacaagtcgctttggaaaaaatatagtaacattaatttttcaacacaaaacaaatatattattataatgtattcattattagttttaataaaactaatttgatgttatagatgttattatttttttataaatttgatcaaacttaaataagtttgtttagtaaaaaaatatcaaaacacgacttatatatgaaacgaagagagcattagttagtgggcgtgtacttcaagacttcaagtcaacccttgtcaatgctaaactgggatcaaactcaggaagtt

SEQ ID NO: 49473 - DNA, 750 bp, Oryza sativa
tacagtagctcatcatcttagaagtagcttccatcgtgaatgcccttatgcagttttcccgtccaatttctacactgaggtagtatatatagtaggggcaatttgcagggaaaatgatggaagacattgactagaaataaaacagattgttcttttttttttccatcaatagatgaatcacaaaagttggcatggtatgaaaaagtagagaaaaattaagcctctcattgtatgcttctcttatttgccgaatccaaaatttaaattttaaaacttaattttagagttatttataagtttctttgttcatactggcttttaaattgtgaattatttttgttagtttgttaattttttaaggacttatcaacccgtaactcagaccaatcaaaacctaataagtaatccgaaatctcttcaagtttactccttcgggagtccaataagaccggcatgcatcaacatgctactcatcggtcgcacctcgcagtagcgcaactgaaacggctgcctcctgtacgtgcatgcagatgcagccgcatgtcgtctttggccgtttttgcaggtgacgcagcggatcggcagaagcaaatgctccaatcggaacgtactaatgcccctggcccagccgtcgtcgcaccagtgccgcacggcgaggcgaaccatacacaaacgggcagtaaatagttagtgggggtaatcatgtgagtttgtccgctgggatcgggtcatatggtgacccacgaccag

SEQ ID NO: 49474 - DNA, 4595 bp, Oryza sativa
agtctttttcttcgttttgcgtgttagtttgtcgtttccgtcgttgcgaaggttcgtgagtgcgccggaagtattcaataagattaattgaagaccgattattgcaaggcaagtcacacagaccctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaaacctcagttgaagaaaaaggatccagaaggagaagacgtttggcttataccccagttgagctgcctgtgggagtggagccggaccttcgctagaccgtaattccgctgcagttttcttttcttttgaaagtatgtaacactattattgatgattctgtatattaaattgtcagtttgtgtacctcggctgattcctggacgaggattttatgcacaaataagttcggaaattactagtgaatttctgggcgtgacaatttccccctctttattgcgcgcgggggcggcgggatgcggcggaatccgcggcggcggcagcgctagggcacgggcgaggcggcgggcgcggcgcgaggtaggggatgacgggtgggccctacccgtcagcgagggtggcgggcgggcccgcccgtcagcggcacgcgcgcggggaggaggccgattgggccgcgggggagaggagagagagggagggaggtggcccgagccggcccaagaggggaaggggggaaaagactttttagggtttttctttttataaactcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtttgacttcttccgtcgcgtcttctaaacgaacttgcctagcaaaacttctccactctggactgcttggctcgacctcctgttgcggatggaatcttctcttcacctgacttatccttggttgcaccttgagctgacttcgactggggtgcggtacttgaagacggggtttcagttcgaggacttctcataattcatacccttggtgtcaatctcatacaagttaccaatttcacgttgtgcgtcgataccaacttgtcattactaggataccatgcttgtcatcatgagaataccatgcttggcgtttccttccagcttaccaccaaatgctttagactatcatatcccgcttaccaaggataccatgattgacaacttgccactaactgtctcatattagcttttctggtctctgggtgctagatacttctgctattcactgcaagggtcgataactttgcctttgaattatgcttcccaagagaaccaacttatcccacttgacatgctttgacgtcttcccaaatggctttattgctggatttgttattgtctaatcattatcctgccaaatctgaggcttcgttgttagatgtgcttttaatctgacctctatagattatcttcgaacatatcacttgattcataactgggaatagctctcacgaacaagcaactcggattcactttctttacattcagtttacttcccattatatcttcaggttgtcctcagttagcattcaacgtattcctttatacctttaaccttgatgtgttctttcccattggatcatctcccaagacatggcattgcctggtaaccggtgcttgcacttttcactccgtgtagcatctgataccgagttgaagatttcactctttgccttcatagaaacacttttacccaggtcatcttgcttacttaatgacaaggtgactgttgcggggcaattacaatcaggggtcttccttgagcgatgcagagcatgtttctgtttatcaatcacctttcggcctacttctttcatgctagagaacatctttgccaatctcttttatcaatcttctttcggcttatctctaacaggtggtattctttaatgtggattgcggacgcttctggggacgatgaggtcctttggcttgctgcctttcagagaaaccttgaagtagttcgtcaaaagctagactgacgattgttgcctttgatccgaagaagacacatctgaaactcttagtccaaacaaatgtctctttggttgatcacttgattttcttcgccatcaacaggttggttattaactcgagattagtatatgattcctctgaaatgagaccctaggtctcctttatcagtaagcaattatacacataatcacatatccgcatcttccaaaagaatcctaatagaacttgtctgtattacacatttctcccttattacatgaatacaaggcactaccttaaacaaaaagggaagatgcttaacatcggtacattgtttctactatgggttatgattaactcgaggcctcacaggtatggcgtttgctccagtgaccacaaggcgagtgacttgtcttcttcttgcataatggccggagtgatggcgtaggttacgcttcggctgtggacaatctctagagaaatgacctggttctttgcagttgtaacaaatcaacgtcttctttgttgagctgtccatctggggacgatcattttgacttggagttggaattggtggttgaaatccttgctaacattggcatcagtggtaccatagttgctatcaccattggagtctttctcagtgtcaaaattgctaaggttgtcattctggattccaacattgatactatcgttgacatcttggtgaatgctactgacattgcacgctttattcgagtggtcgctaatgaggcaagaaccatggttgttggtggtatcatcatcattagtattgctagtgttgttgtctgcattgcgtccatcttcttggggcaggaactcttgatgcacaacagaagatccggtgatctgaagtggctcagtgcgctgtctttggttaccacatggaaatactgggatgttgacaatcctcctcttgcagttcgtcatccgattatgctcactttcgagttgcatggctttgtccacaagtttctcaaaatcttagtaatcctctagaaggagttgcactgcaagctcatcttttaacccctggagaaacttctcttgtttgtcttcatctgtttccacatcttctggtgcatagtgagccaaacgatagaactcgtgcaggtactttgtgacggtcaaatctccttgcttcagatagcgaaactctcattttcttaatgtgatcattcctgcgggaacatgtgatctcctgaatacagatgaaaactcgttccaggtgatggtatgtccttctggccgtgatgcttcgtagctatcccaccactctgaagccggtccaaccagctgaggagttgcgaagcca

SEQ ID NO: 49475 - DNA, 3517 bp, Oryza sativa
ataacttgcactgttgctggactgtaggtacttgaacgttggttgtccctgctgggttgttccaattctgtaatagttgaaaggctgttgccaacatgttggtttggttaaccacaatttggattagctctggtgaggttttgttgatgcttttctcattcccactggcttgggttcttgagtcatcggatccatcattcccatagcctttgttaccagtgttatccatctgtcacaaggtagaggttgagaggggaagcagacaaggaaagaatggaccagaactagggacaagaccttaaaggaactaactcttcttgttgatatgttgtttgtttcacttattctgcaagttgattaagcaaacaacctagcatggttacatcacaacccaccgatgcaaaccacgcgctacacacacaagcaaggaacacacgactaacaacactaccctatagggtggcttaggttctgcgacgggttctccaagatcttcactccttcacagctggcttcactgcttcctccacttcgctagcggatcctgcagtcttccggagcttcggcgaacaactgacgatgtcttcttcttcactgacctgaccatctagtactagttgaaatttgaagaaggaagaaaagggtaaaccttttgcaaatagcattaggggaagaagaaaaagaggaactttcgcaaatagttttatttataaaatatgtccttaggttttatccacttggcttatcctacagtcgagatggctctgataccagcttgtcgcgaccgagaaaattgcattttcccgaacgctagtgtattaatccccgtcccaggaaaagccagggtacaccatacaaacatgatataaaagacacatctttattatatcgataatatttacattattacaaaggcacttaaggcctgacaatcaaaaataaaaagcagcggactagcgggcctacggctccatcttcacaggcgctcaactggggtataagccaagactccacctaagacttcttctccaaagcatctcttactgaaggggggagaaagatagagcaagaatgagtacaaccacagtactcagcaagccacaccggcagatgcacgactaatgcaagggggtacaaggggtaatgatataggggttaagttatgcagaaaacagcatttaaaagtcacttagttgcccaaagccattttataaagacgatcctagagctacacagtattattaatcaaggccgtgaaccctcacgaacctgccttaacccaaggcctacgatgatccagaccgaactggcaacccaaccctgggtcccagctcgtcccaagccaacccaggccaaccattccacattttagttattgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacatgacatagtttccaacccatcctagccatagacaagagtaccgacccaaccccacctacggccggaacctccgagacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtggccagggtgctacttcccacaactggcatgcacccaaaccccaccggaaaacaggttttaggggttttgaaagaggaagagaggtgtatgtccaattccaccataagccaaccattccatagtatccaaatgatatgagaattcccaaagtctaaagttataaaaaccacctaatgttgtcctatttaatcagcgaagcatctacctaaattcatactagtggaaccatgaatagagtacccactagttggggttttgttttcctagggtgaacaaggtaataataacaatagcaataataataaggtcataacaaaggtaaataggcatggctaaataaaacagtgataacgcgggaatttaaataaagcgataatgcaataatttaaatcaaaataattttataaattgggattcaatatgttcaaggatgatgtgacttgccttgctcagagagaacggccttccgaaccttcggcgacgaccgaaaaccacgcttcgggaacctccggaacgacgaagactacgcgaagcacacaagcaaagctacaagcctataaagaagcaataacaatacataaaaagaaagcacagggttctttaggttataacaaacattaagagacttgaacgggtcgattcggagttcgtatgaccaagatatgatcatccgaagtttagtgctgttatatggagatttgcggattattataattaagctttgcaacaataaaacatgtggaagcgctagcctggaaaagacaggaaggctgcgctgttgacatgcggacccgacatgtcaacctaaaggaccgcggtagaccaggtacacagagacggtccacgggtcgacggaagcggaccccgtgtgtcaaccgaggcgagtagccgacaaacggactccactagacaccacgcgggctgcacacgtggaaaccacgcggctaccgagcgaacacactaacacggacactacacggtcaccacccgcacacgtgaacgactaccgacaccggtacacgggtaccggggtcgacgaccgcacaacgggtacggggcgacaccaaaaggacgaggacggggcagcgagaggacggatccttaccaccacgcgacgaggcgtgggaacgacaacgacgaacgggcgcggcggacggcgagggaacgacttcggcagcgatcctgggacgaaggcgagacacggccggcacgaggcttgacgacgcggaggcgaggacgaagacgacgacggggctgctgcacacttgacgaaacgcgggcggcagacgagaacggcttgacggagggacgaacgccacaacgaccgggaacgacgagaggacgacgacgacgacgaccggggccagcgaggagacgacgagggcagccggcagcggctgcacggaggcgaggatggcgtggaacacaccgctgcgatgccgacgacggaggcggcgccgcgagacggcgagccggcgaggatgaacggtgaagacgacgacggacaccggcggtgttcggtcggaggggaggcgaggccgaggacgacgtcgcggctgcgatgccgaagatggtacaggtgcagcaagccgacgagccggggaggtggaaggggcggccgaaaggacactggcga

SEQ ID NO: 49476 - DNA, 1226 bp, Oryza sativa
taataatactgtgtagctctagattgtctttataaaatagctttgggcaactaagtgactcttaaatgctgtttactgcaaaacttaacccctatattattaccctttgtactcccttgcattaatcatgcatatcccggtgtgacttgctgagtactgtggttgtactcattcttgctctatctttcccccccttcagtaagagaagctttggagaagaagtcttaggtggagccctggcttataccctagttgagcgcctgtgaagatggagccataggcccactagtccgctgctatttatttttgtttgtcaggcctgaagtgcctttgtaataatgtaaatattatcgatataataaagatgtgtcttttatatcatgtttgtcaggcctgatgtgcttttcctgggacggggattaatacactagtgttatggaaaaggtatttttccgggcgcgacaagctggtatcagagatatctcgactgtaggataagccaactggataaaacgtaaggacatattttataaatgaaactatttgcgaaagttcctttttcctcctttccctaatgctatttgcaaaaggtttacttccttcttccttcttcgaatttcaactagtactagatggtcagctttgtgaagaagaagagatcgtcaatcgtttgccgaagctccagaagactgttggatccgctagcgaagcgaaggaagcaatgaagccagctgtgaagcaggggtgaagatcttggagaacctgttgcagaacctaagccaccctctagggtagagtcgttagtcgtgtgtttccttgcttgtgtgtgtagcgcgtggtttgcatcagtggggtgtgagtaaccatgctagattgtttgcttaatcaacttgcagaataaacctaacatacatcataacagaaaaaaaatagatctgttaaggtcctatccttagtttctaatctgtctctccccttttgttttccctctctccctctccaaacctagtaacagatggctgacaataaaaaaggcagtatggtcagaaatcaggacgtgggtacctcaagctcccgagtgaatgaagcaccagacaccagttgtatggcagtggtccaacacctgattaaccagaacaaattgcttatagagatactacagcagcatcagacgccaattctgaacccgagtcagatgcaacctcaagtgcagttggaggcagtcc

SEQ ID NO: 49477 - DNA, 1282 bp, Oryza sativa
  unsure (1)..(1282): unsure at all n locations
caaaaatgcaagtccggaacttcctgtttccaggtccggaagttccagtatgatgaaagaaattttcctaagtattatccggaagttcctgtcttctaggtccggaacttcctgtctagttttcagttcaaatntgtgagtaacggctagatgacgtcacatatacagctcgtttccagcttgttcattggccattccactttcactttttgaacctagagctgttgctagcctctcccaagtgtttcttgccttctccactcaatctagagcctaattcttatgagaaagagagattgagaggaagagaagaagatttggagatgtgtgaagactaggatcttgggtgagcacttggaatatcttgtgggctgtcatctcggtgcttattactcttggagatgatctcctagatggttaggtgtcgcccgcgagaatccgttgcatattgtggatgtcccgggtaagtttgtgaaggatctcctctcctccaaaagggaacgaggtaagttaattaagttcttgtgctgagattctagaggttttccaagtagagcaacgtatacttgtggcgaatttctagaagtagtttgagttggatcttggtggtcactcaattctagaaacttgcctaggggtgtttgtagttgaaggctgtggatttcctctggagtttttgcacaagtcaggcaaaggggttaatcgagacccagctctttggagctcctcaacggagagtaggatcgcaagatccgaacatcaggaaaaaaatgctcttgtctctttctgtgatgtttctgtggatgtttctgtgatctatctcctacttagaatacctgtgcatcatcttgtgaagattggcttagtctcctgattcgaaatttgaatttcatccttgttctgtaacccggaagttcctgtcctaagaacaccggtagttccgggcctggcaggccagaagttctggagttccttaccaggaagttccgggtctgtttgaattttaccgctgcgatttgtttttaagttttcagggacagcctattcacccccctctaggcttcatcagcacgttcaattggtattagagcaaggtgctctgattcaagcttcactgctttgagtgatccacaatgtcggacttagggggaaagaacggggaaaatggaaatgaagatggagcgagcagcaagggaactccatcacccaagggagctactataccttttgattacagcaaacttaccattccccctcacaactttgtctccgtgccttctgg

SEQ ID NO: 49478 - DNA, 748 bp, Oryza sativa
cagaatgtagtgtaagaaattacgatcttcatatttcacagagcatgcgaggtgacaatccatgatgaaatctaagcgtatctatgaatgtttccaagttatagattgcacagttttctaaagtctttatctgtaacaaataagtacttcagttcatgtcaattgataccaaacaaaattgtagtaactaactagtttaagtatttatttaagttcaggtgtatatttaatggaaatggaaagacattggaagatcttgttttagctgcagagagcggagtgtttgtaaacatagacagtgaatttgatttggagaatattgtcactgctgcgagagttgctgggaagaaagtccctgttttgctcaggataaacccagatgtggatccacaggtaaagtttttcctcccacctcaggatacagtgggggatttagttatattggtatgctattgtgttattgtcatataatactagaaatcagattatatagttttgggtacccttgtgttttccattttttcttgaaaaaagttgtgtactacataggtgattattgatcttagttgtgcgcggtatcaaacatgtactactccctccgtcctaaaatatagcaacctagtacttgattagacactagggcatttcttttgcattaattaattgaatggataatgtaggcaaattttgctacgggacatcgtgacttgaggttttagctgtaggataccgtgcaaagtgacttttg

SEQ ID NO: 49479 - DNA, 1767 bp, Oryza sativa
atgaaccgttagcatatgccagggttttctcggttagtaatattcctctcccctcctgtgcaagcatgtgatggctgcatgcattcttgtacagctgcagcattcttgtacagctgcaaggggagttcttctacacattaatccttgtgcaatgagctaaaatgtcttgtaagtacttctgagccagcggacatcttttatgcatcatgctcaaacaataattcgtctcgccgtagcttccatatgatgttatatccatccaagcatgttaatatggcattcagatgattaacattaatccatacttctagctagttgagaacaattaagtaacagttggaaattgctagtaagaaattgcattttgggctgcattatgctctgaaaaatgtgcttttttgttgatttgagtttatttagaaagttattgttgccatttgttttagtgtatgcgaatggcaacaacagatcatttcaatcactaagaattataggaaccacactgctctgattcaaaatgtaaatagttatatgacttttaggtacctgtcccattttttcctctattccccttgtaaattgaatacatctcatgaataaataagatatcattccaatgtgctatgattatgggcaacaaggtcattttaagacttccttaattactgtgccaatgtctgaaacatctacattttgaaatttgagacttaccttctatccaattgtatagtactgaaagcattatggaaataacatagtacgtgatctgttaatgaccatgaactagatttttggcatagctgaccttgcggaactagattgaatgttcaaaatatttttgctcttgtttctgaactggccattttagaaaaaagtgatttgtttttttcaatgtttcaagcctcaagtcacaggcatgagtacctccacatgcaggtgtcagactcttagctccaacggaccagcttttcattttaccctctgtgtctcactctctggaaactaagatgtgtcagttcaatgggataaaatggggaccatttaacatgaaaccaaatttgttaacattttaaggtgtgttcggtgttctaggttcccaacacccctccctcattttccgcacgcacacttttcaaactaataaatggtgcattttttgcaaaaagtttatatatgaaagttgtttaaaaaaatcaaattaattcatttaaaaaaatagctaatacttaattaatcacgcgctaatggactgttctgttttccgtgtggggagatgggttcccaaccccaaactaacgaacacaccctaagttttttttttatccaaaacattttaagtttgataagaaacatttaaatcaagacacatctttccaatttgttaactttcaattgtcatagaaaagcctcctgcacacatggtgtagttgaggcgagcaggttgctcactgaaggtgatgtaggcagggtgatgctataatggaggtggagaatgaggggaacagcactcacagtcgcacacaggtgcgaacaagggttagtggtcttgggttagactaccatctgtgggctttcgaatgagggttggcttgactgcatatctgagcatctaatttgaatcgaggaagcattgctaatagttttgatttgtttcgccattatatgatcaatatttctgcaatactgtattgactgcgtactcctgtctcggatacatatctggtacaggaatatgctgttttctgttgtatcggtgcatcataatgt

SEQ ID NO: 49480 - DNA, 2470 bp, Oryza sativa
gcatgtccgacgtgattttgtttcagtggatgtggagcaacggtgatggaaagcatcgtgttcgtgttttggacgctgtaatgtttttctcttgacaagtagtataatgatcagttcggggaatggaaatcagggatgcagcaccgggtatggacagcatcaaagaacccgtgctcttctctcctctcctctcccattctccattgcttgtgaacttgcagcttatgtgaataaagcttactgaagaaattaggagaaagggataattcctttcttgtgtgtatactatttctgtgcagcagtgtgtccattcaaaaagacttattatgctgactttgaaacttcatcaaacttaatgtgtttgtttctgtttatccagggacaagcccctgttaaagatgtgggcttatgcttatttgctaaataacttttttttcttcagaccatgttcaaataattagacaatacatttgagctacatggtatggtatatgatattgttttcttgttgtctaggtcgatatatttagagatgcggcaggtcttatggtgaattatgttgatgaaattcgagcacaaggttttgaactggaatatctcaatattggcggtggcctgggcatagattatcaccacacggatgcagtcttgcctacacctatggacctcatcaacactgtgagctcaatatccatgttatatttccgattctcatcttcgtaggcacattatttatttaaatagatcacttcctactttggatttttgcactgttaaaatttggcatatggcgtgattcttatatgtgcccctgtgattttttgtaggtgcgagaattagttctgtcacgagatcttacactcatcattgaacctgggagatccctcatagctaacacttgctgcttcgtcaatagggtcactggtgttaaatctaatggtacaaagaatttcattgtagttgatggcagcatggcagagcttatcagaccaagtctatatggagcataccaggtttgtttagtgatacaactgatagtggttgcaagcagagtgttggttttgtccattgttcataatagctgagttcgtttggataagatgctcaccattcataaatatatgatgattgtaacgttggtctcaggtttagctctgatctttacatctccatctgacctatatataaataacatctttccaacaatttttttcttgcatacagtttttccaacaaatgttcaaaataaacatgaaatatacattcagttatttcgtactatgttgttttatcatgttatttacctgtcatctctatccacatggtgcagcatatcgaactggtttctccttccccagatgcagaagtagcaacattcgatattgttggaccagtttgtgaatctgcagatttccttggcaaagacagggaacttccaacacctgataaggtttgaccatatcttgtgttttctttttgatatccttgttggtaccctacaaacatattgcgcttgtagggagctggtttggtggttcatgacgcaggagcctactgcatgagcatggcttcaacctacaacttgaagttgcgaccacctgaatattgggtacaaactgacctatatatttttcatccgaaatcatttgttgataggttttcaaaatgctccctttatgcaatgtttataattgttggttcccatccaatatgccctgttatttgtaatgcaggtagaagatgatgggtccattgctaagattcggcgtggagagtcatttgatgactacatgaagttctttgataatctctctgcctaactcgttttcctgcaattgtaataagatttttctcttgttatgtgtggctgtatcaggattcggattgatagcgcagtacagtttgctgtagaatcggtatttttttttattgtactgtgatgtcggtaccttattttatccaaagatttttggcaaattttgctacaggacacttaaattttgtagcctttgctgtgagacactaaaaaacgtatatcttcttgtgaacattaaaaaatgtggtaattacctgtaggactctcgatgtattattttattatttttggtgaaaatagagaaagagtgttgaaagtactgaaatgcccctggacactattcttcctgcttatattctcttttccttctcttttcttagcgagcttgggaggctgctggcaatagaggaccgagtggtggcaagtgagcgcaacagtgggcggcggagggggtagacgatgggtggggcggcgaccggcagagaggcggcgggagaagcagcaccctcaccctccttgtcgggtggccctccacaccgtgtgtcttggactcctcgtcactggccagcctctcggtggatgccgtcgtgagtaccacgtcaaggctagcggcgcctcactgccactgccatcgatcagcagtacaccacctct

SEQ ID NO: 49481 - DNA, 1677 bp, Oryza sativa
caggaagttctggctagagggtctttactatgattcatatgtaattttcaaaaattcagagggcaaagtggttgcttatttcaatgggaattacaatgatgagtaccgtacttgtgtgtgggtgccaaaggctttggtgactaacatcaagggacccaaacttagacaagtttgggttcctaaatcccaagcttgatttcttttgtaggcatactcctccagtggctcaagttgggttgtggacagtggctgcaccaatcatatgatgggagagaggagtatgtttcaagtcttaatgaggagggtggaagtcgtgaaaatattgtctttggacatgatggtaaaggaaaggtaatgggtctcgatcgtgtgtgtagtgcttgccaagccgggaagcaagttggcagtccacatcctataaaaaacatcatgactacaacaagaccactcgagcttcttcatgtggatttatttgggcccgtggcctacataagcattggaggtaacaagtatggtttcgtcattgttgatgatttttcacgcttcacttgggtgtactttctccatgacaaaagagaagctcaagatgtcttcaagcgcttcgcaaagcaagcccaaaacctctatgatctcactatcaagagggtgcgaagtgacaatggaggagaattcaagaacactcaagtggaggaatttcttgatgaagaaggaatcaagcacgagttctccgccccctatgatcctccccaaaacggcattgttgagaggaagaaccgaacccttattgaagccgcaagggcaatgcttgatgagtacaagacttcggatgtcttttgggcggaggccgtaagtaccacatgtcatgccatcaaccgcttgtacctccacaagatcctaaaaaaacttcatatgagctcttgagtggtaagaagcctaatgtttcatattttcgtgtcattgggagcaaatgttttattttaagtaagaggcctcgctcatctaagttctcacctaaggtggatgagggattcttacttggctatgaatcaaatgcacatgcctatcgtgtcttcaacaaaacctccggtattgttgaagtcactagggatgtgacatttgatgaatctaatggctcccaaggagcgtaagttgttgtacatgttgtaggtgatgtggatccaagtaaagctataggcactaaggctattggagacatacgaccagtcgagacgcaggatgaccaacaagatagggatcaacctccgtcatcgacatccaatagccctacaagtgctgtctttgctgagctgaaagttccgggtcctattgatcagaacctccggaagttccgggttctacagtctggaacctccggaccagtggcagtgaaaacgtgccaacggcacaagtggatgggatcgatgctgcgggcactttagagcatactgatcaggctcaggtcccccagtgcaccatccaaggatacatcacactgtccaaagagatcatcccgtcgacaacatacttggtgacataagaaaaggggtaactactcgctctcgtgtcccaagtttttgtcaacacttctcgtttgtctcttctttggaaccaaccagggtggaagatgcgcttggtgatccggattgggtgatggccatgcaaggggagttaaataac

SEQ ID NO: 49482 - DNA, 1342 bp, Oryza sativa
acatgcataaccaactttaaaatccatttagattttataacatacttattataaacacgctatgactggcaactcagacaaaattgcagccatggaacacatataatgattaacttatttcgattttctatgtaccaagaaaaatcaaggtatatcaaatgttacaaactatgatacgcatatatttatatgtatgtttcacatagggaatatcaataatctatgtaccatgataattttaagccactttgtcagttctacatattggcaataagaaaaaggtggtgtacgagatcgaaagtggataggtagaaagcaaaaggtttagacaagttcagaccctcttgacaaagaggtaatacccctactcctgtttcggcgattgaattcgtcgagtgttgtattgatctaacgatcttggctgtggttatgccttcaaaacaccccgtgtccttgtataggttggtgcaaggttagaagggtagaaacctaaccgaatccggcatcggtttccttatatattacataaccgtatatgagtaagacttatgagacttgccgtaggaaacaaggcaataataaatccccagtcctaattattacataattcctagactcgacccacctcctatcttcaatcgaatatccaagcgagtgggtatgtggtatccataatatccacacacttatccattatttttcattacactattacataaatgtttttttacatatgcggctaaaatgttaagccgcttgtattgatgccttagctgcctcaacctcagtggccacttttgcaaataacatttgtagtttacacgggtggagaaacctttattagttccggatggtaacccccttagtcccggttctcaaaccggaactaccaatccgggactaaagatcgctatcattagtcctgggtggaataaccgggactaaagatcgatctttagttaccggtaccaaccgagactaaagatcgatctacctttttttttatttgcatggccctgttgctgcatggtttatatatatatatatatgtgtgtgtgtgtgtgtgtgtgtgtgtacacatatgtatatatatatatacatgtatatatatacatgtatatataaatgtatgtatatatatatatatattacatatatacatgaataatatatatatgtatttatacatatttatatgtatgcaaatgcatatggatatgtgtacaaaatagacatatatgtatatattaaagcacttaacattttatgtgcatatatgaccaaaatatatatttacagtaaagtaaatgtgtacatatataaatatagacatgtattacaa

SEQ ID NO: 49483 - DNA, 738 bp, Oryza sativa
acacaagttagttccctcttcctgctttgcacactatatacatgacaaacgacgagagatttaatatacacttatatttgaattagagattcaatataaatttagatcatgtactcactggaaatttgaacctctggctaagtttttctttccaagtgccgcggaccaaatgacagaaccgataccaagccctacatggagtttaaagctacgatttgtactagcaatagcaaaattcataataataacactggaacatatgacattacctatctataagttcaaaaacctggtcaaaagtagactcatctttattcattgagtcatagacattaactctgcatgcctccaagtcgaagagtaaaaggacccagtggaatatgcaatttgtgttagatgatatatgaaacactgtacatgtatatgtacgggaatgaaatttgttcggtagacaataaaaactaacgctgtgttgtacggcagtagtatgaacgtcttgaaatgctgctccttgaggagatggacgagattttcctcagtggcctgtggatacttggtgaccatttcgacgtttacattccgagggtcgatgaatccagtatcgaaaaccccccgccgtcgggcccattgaatctccattttacaacaataaaggaattgttatttatggtgtacatatatacaaggagctaattaaaggaacgtaagaaatataactctcaacgatacgtacaaatg

SEQ ID NO: 49484 - DNA, 2277 bp, Oryza sativa
cttataatgattacatacaagttggtttcgccgattgcaacaaagggtttaacctgattatgtaatcatttggattttatgacaccggacctctagccgatgtatgctttaaccatcggatcaatatttgttctatcatatcattattagtcggttggtttctattggattatattgttgcttaattacattattatcaaccgattgtctatatatcattatttacttaagtatcagaatatacattggacatatagccgattgctcaaaaccctatcgacattagttggatcggcatcggctagtatcagcatcggctagaattactccattggcttgtcagccgatcggctatttcatctgttgtttgcacatgttgacggttgttggatcaaactaactagtacgccctcatctcatctatctttggacctgcattggagttaaggagatctcctcggctgttgtgttcgttgacttagttcacgccaatatagttccggcactatctgccgagcgtggatttttcgtcaacaggacgggtggccggcttgatgactagactgaatgtcttgtcaaactcaaaccgttgaggtgttgaggatgagggagcgatcctggacggggtagctgtcacacccggagttttcccctttcccttagtttacaattcatcaataaatcgcccaaagaaaatgttttgtttaacctggagcaaatcttaatttaacaatgcgagaaataatcggaattgtaacataccaagaattctttgaagctaaaaaaaaagaaaatgaagaaaacttagcaaaaatttgattttgatcttgtccttgtcatttgaagttaattttggtgttcttggattttccatgcacctcataacgcatttgcatgcaataaacataacaaaaaaaactaattaaaataagtggtagagacttgaaataacctttcacaaatctcacaagttttgcatctcaattaaaaagatgaaagcatccaaaatttgattcaaattaaaataaaaacagtgaacttgtttgaattttcaaaaaataaactgctcttgagaaaaatccccaaaatttaccaagtggaggtcttgaccagactaacctctagaaattttagcacaagcttttgagcacattagcatatccaaaaattaatcaaactctcagccttcttggaaatacccagagagaaatcccctcacctcatcccttctcccgttatctctctgatcagtgggcctaaggatcattgggcccacctgccagccaccatccccatatccctgctctctgtctttctcccttctctccttctatttctttcaggcaattcatcgagcacctagcgtgcgagattgaggtcatcgtttccaagccgaccaagcaacctctgcccacgattctcgctggcaaagatgaggcaaagctggtgcacccctgcccgaggccctaccgctgccttcgccgcgtccctcgctggctcgcccaacccggagctcagtggcggatctagaaaattgattcactggtgtcataatgtgtctatcggtgtcatagcatgctaattatacttatattagtgtgttataatatatggataagcagtttaactattggttttgccgaaagtcatcggtgtcgcctgacaccgatgctaacactgtagatccgcccctgctggagctgccgctctcttgctctccctctctccctctctctgcccgagcaacgacgcgacgcgacactgcgccaccctctgcccgcgaatcccgctgtgccaaggctgcataaagccgacgccgtccctgccgattccctgccacgcccaggctccgaccaccgcagccgccgtggccaatccaacaccgtggccctctgcccgatgccgaccaagccagaccgacgcagccttcctcctctgcctcctccctgcgcaaagccgatgccgctgcctccgtctgcaaagccctctgactcacgtctgcaccgccgatgctgcgcctggcaaagccggcctcgccgcgcgcctcgccaacccggagccgccgccccctgccaaagccgacgcacgaagcgacaaggcgagaccgaccgcccctggctccccgtaactatccctgcaccccctctgcaatccctgcgcaaagccggcgcctgctgcaagccgtgttccccgccgaccaccgcctgcgcgcgcgagagacgccgagcacttcgcgacaattccccgcacttgcctctcgctccttcctcgcgtata

SEQ ID NO: 49485 - DNA, 8630 bp, Oryza sativa
tacagtagttcatcacctttgttcatgtagggttaccttttgtgcaagatgagataagctttcaaactcctgagatgaaaacttctccttgatcgaagttatcagaccctgaaaacccaaatcagctagctgagaatcggtcaaagccaaactgtagcacctattcctcatctctctgaatctctgaatttaatcctgcatagattcatcatgcctttgtctgattgctgttaagtcagataatttcatctcatggattccactgtaaaaataactgtgaaactgtttctccaaatcggcccaactattgacagagttgtatggcaaagaagaaaaccaagtaaatgccgatccggataaggacaaaggaaacaatctaacccttaaagcatcaacagccgatgcttcaccacattgagccaagaatcggctgacatgttcataagttgagacattgtcctatcctgagaattttgaaaaatctggaactttgtatcggttaggtaatggaaccctctcaaaccactcaaggtacggataccgatacaagtttccagtatcctttggcttaagcccaaactgctccctcatcacatctgcaatcatatcggcccattgtctctactgaggcaccccttgcgcttgttgctgtatcggctcaaactggttgaactgaggagcatactgaggctgaggcaatcccccctgttgatagtgaacatgaggcgaaggaggctggtattgataattcaagttacccccttggtagttctggacattcggctgaatattacacactaagtgctcagggataacttgggtagcaaccgattgatccggttgtacaacgtgtaccagatgctcagggacaacttgagtcacattctgatgcgacggctgattatcaggcgtcctcaacccagtcagcatctactggatcgtttgttgctgaatcagctaagttgtctgctgttgaatcggttgacctatctgctaccttggcggcgtctgctgaatggatccaccaatcggctgagttggcaaaaacattgaagcaatttgctcttgggacagccgattgatattctgaccaggatgttgcggttgttctttagacaagaggcgaggattattaattatttgccttggtgccgatgatggtgcagcttgtgctggagtcgaagctgatgccatcggctggattgatggtgcattggtagcagactgctggttaccagttaccaagtttctgtaatttgggaaaacgcctcctggaagataaactggccctgtagcttgatgctcagctattgtaccattaaccacagactttaccatgtttgttaaggtattgactaggactcctgattggttgatcaaagcatgttgcactgcgtagtcaatccgatcttggaagttgttaaactgtggttgcacttcattgttatcttcatcaagatcctcaaccacttcatcctgaaggccgtcacctttattgcctgagccatctgcaatgcctttatcaccttgggatgagcttgagccaactttgtcggcaacaactactttcactttgtacttttggtagactttcccgcgagtttctacgaacgacttcatgaattgctcctgagcgctcttcatcattaattcaaaatccttcttttgttctggtgacaacttgtctatagtgactggaacaatgttcccttcattaacgtcggacccagtcggttttggaatcttggtttgagggtctgacgacttgcctgtcgatggcagaggtggcttttctgctgacatgtttgtcgtgtcccaccaggtgtgccaaaagcgtgttgatgcgaaaaacacgaggcctggaagatctgcttaactttagtgcagttccaaaaatcttacctttaggttcgtgagcgtgccagttgattttatcctgcaatcagcaaggaacaaagacaggaaaaatagcggttaaatctataaacgatagccgatcggtcagtcgccgatgacgtatcatttatctttgagccgatgtcatatttaagtcgatcgacagtcataaataggtaaaaaaagaactaaatctattcgatcggctgaagttattaatgatatataatacttccgtcgatatatacttaaatcaagtgattgggatagatcggtcgccatgccgagacagtataaatcacttaaatcgaaatatatattaacgaggaaattataagcattcatagcatagccgatcaaatagatccagcatgtatcggctaatactccgatactactctatattaagatattaaagcaggcaaaatatatcaaacatgaagcttaatatacctatatgcgacaagatcttagcataaagggcggacttaacatgtcaatcaggcatataagatataaaatagttaaatcaggtaagatcggctggaactctaatgctaccctaatcggcaactcaaaagcaggccagagattaagattctaatcacgacttataaggtcaaactcaactgatgcagctataagtaggaaaagaaggacaatatctagacaatcaaggctttgaatgtttcatagggtggtggatatcctatataatctaagtcaacattgatattaaacctaatcggctgccttccaatgatggatgttggccgattgaaagttaaataacaatattgtcaaagtattataagatatatgataactcgatgaattacataaacaagattagagtatcataaagatgaaagcactaatcccgagaacgcaagccgccataacaagttttacctctagttgaagatcgaaaccgatgcaactcaacccgaaagtaagaactcgtcgaaagtaaacgaaagtaaaagggtggcgatgcgccgagattgtattgaacgtgtgttgtttgattacatgggttcgggtcatatttatacccgagatacaaaatatgtccttatcggacatgactcttatctctaaaaaaactctaaaataccataagtctttgcggcagacttttgcccaaacttatttctaaggaaattacataaaatatcctaactaatagatacaattgcctttttcaggacttaatccgtgcgtggcaatccatatgaagcacattaactcaacccgacaacgtgtaccgagtcacattgtcggaatcggctcaatcggctaaccttgtccgactcgaactctgccgattctggtcgcagctgattcggactttagccaattcttactctgtttccggaacgatctctatcttggattctgcttcagttttatctccatctccaatacttgaattaccaaatttggtcgctaacacccccgtcgacagagagtgtccaccatggccttcatcttgtggcaaatagtcggtgattgaaagatcgccttgatggaaggtgcggaattcagcttcaagcatgagggcgcgctgctcgctgttgcccaagaactggagttcgagagcatgctagacggaccgagtagtggtgacgtgggtcatcgccctcttggagaagatcggcagagatggaaccatagagccacccgaggacaacactatccacctggtgccaaacgatgtacccacctcagcttctaatcctggaagtccttcaaaatgactttgagtcttggatcatcactccatggaccgacctgttaagctcctttgataacctccaatgagcagtctcaattaccaactttgtaaatcctaactccgctgccccaatcctgctgcttgcttacacgcatggatttctatgacgtcgcatccccaattccactgtaaacatgagcagcagccgccataaagtctcccttctcatttctcatcgccacacctgctgcccctctattttcattttctaaaaagctccttccgcattcagtttcacccgtccctcttctggtttttcccaatgctgtgtcggatgcgctacagtgcccatcttattttcatggacgtttgaccattcctctagttgtgccacaattctcatagctactcctgttggattctctggcatctgagcatggcgtccatctttttgaacagcccataagttatgtagagtcacaaagactgcatgtattacatggtctgcttgatccataagtctgtcaacacccacaaggcaaacattttatagttgttgtattcctcatttggcaccaagaagttgacgcctagctttccttcccccttactccaaacccacctggagtaggggcattcccaaaacctatggacaacattttcttccctttgacagaacaaacatcttacccctgtcttgattttccttctctgcaactctaagccaagtgctagcccattttaaattaatcgctggccattcactttaattttatacggaataccagcactccataaacgctgccatcccctgcggggttatcccagtttccattccactgtatcattcgaaacttagaagtggataagtgcctagctagtggtcaatcatggcatacactagccatggatatctgcatatggccaattaattgcccgtcattttttgaaagtaagcatttgttggggcaactaccagggcatggatgattgatatacgacccagtgaagtatttcattgcgatgacactgaaaatatttttgagaaaaaaacccaataaaaattgttttagatctggacgattggtatttattttgttggattatttatttctggaaaaaaattgggttgcactccatttggatttttagaaatattagcatttaattagtgtcgttgtgtatgagttgcggaacacaatacatcaaaaagtacatcttcacgcactacacacaattcacccatatcaatataaaaataatatatattgcagaaagctactaataaagattaaataaaaaaagtgagagataaagcatgagcatatatacgatatatacaataacatggttgatttttttttaaaaaaacatctatttagatatacatgtataaataaatactcgttcatgtaggtgtatggctgcatgagtcatgacaaaattttcacgttacaataaaaatgtagttacagaaaacattatgctgtgtcaaaaaaattatgtcttttctattaataggaaaatcaaaccgttctatacaggaaggacacatctaataagggtttggtggtctaattatctaatattggaagaaaaccgtacatgtcataattgtagaacagaaacatcgatcgccagctccagatgtcctgcctatggtactctccttgtttggcagcggggaatgcgcgccattgatgagtctatttttctgtctgcccctccatttctgcccccacccccacacccacctgaccacctcctccccttcccacatccaggctcctcctcttggtggtacgtgcatgctcttctcttccaccactacatgattttctttccaattccttgtttgatcctggttcttcctatggacattagtaataattgtgttgctccggcattgtatgttctttatttaatgataaaatgtaagcatcagttatacatcttttcccatgtggactgaggataaagaggctctactttgttttctacctggttcaatacttgttgtgctccaatttcataagattgggaaaatctacatcggaggcagttgcttatttgtattttggattctttgggtggtcgccagggattgtcaaggggatctaggatttggtacattcttggttcattgtggttttttgggcctttataatttcttcatttgatttttgatggttctgattgtgttgcatgtcatgacttataatgggtgcaagaattattcaaattattccagatcataacacctatcttccacttagattacttttctgctatttttttagcgaaatttattctgttttgtgttattcaagcgttcttgtgaattttgggcttggctgtaaattaatgtgttgaatttgtgtcttcaagcacaatctcaggcacctgtaggtttttatcatctggtgtttcaacgttatcattaatttatatgtgtattttataaattttttgttaatccagaaaaggaacacatgttactaaacttataattatactgatggactatgatatataccatgagatgaggctaattagtgtctcacaggcccactgctcaagcattaaaaaattcccagcaaactgagaccttttgtcttattttacactgcatcgtactgccaagcaatactttaggtcatcaagatatttagaaaattattcgttttctcctttattatacattgagacatagcatgtgatataatcaaataataatgtgtataactgttcaggtccagatagagccgaacagtcatgacagaagtcctatcaagacctcttgaacaccgtctaagctctcgtaagtaaagcaaataattgtcacaaccattttcttattgtttaaagtggattattacaccctaataatgtgtatttttttattaaaaaatcattatattatcttctatctcaaagtataaacattattttcagataaagcgtatgcccttttcccaatggtattctcccgcttcactatcaaagaattaatttctaacttaactatttagaaaatatttagaatctggtatattggaatatacatgaccaactgacatacacgatgtgtcagcaaccttagatggtcactatgaagagaagaggaaatccaatgttgaatactcagaggatgagaagaaagccaaaatcatatcgctgaagaagaaggcaatgagtgcttcacaaaagttaaggcattcaatgaagaaggggaggaggagtagcaaggtcatatccatctcaattgcggatgaacgtgatcctgaggaggtgcaggctgtagatgccttccgtcagctccttgtacttgaagagttgctaccatctcaccatgatgactaccacatgatgctaaggtgtataatctgaaaatagcacatcatgttgttatttatagtttcttatgtgaaaaaagtattactaaaatttgagattacataggtttttgaaggcaagaaagtttgatgtggagaaggcaaagcaaatgtgggttgatatgctgcagtggagaaaggaattcgctgcagataccattcttgaggtaattgcttaagattaaaatatatttggactaatccttctatggttgacacatacccttgtttataagcagttgacacatttttcttcaaatcctatctcaggattttgaatttgaagaagctgacaaggtggcagaatgctatcctcaaggttaccatggggttgataaggaaggaaggcctgtctacattgaacgtcttgggcagatcaatgtcaataggctaatgcaggttaccacaatggatcgttttatcaagaaccatgtcagggagtttgagaagaactttgctgttaagttcccagcttgctcaattgctgccaagtgccacattgatcaaagcacaacaattcttgatgtgcaaggggtggtatgtatgtgcaaatatttggataattcattaaatgattgcacttttactatttataatctaagaaaaaaaatacatttttaggggatgaaacaattcagcaaagctgcaagagacctcattggtcagcttcaaaagattgatggtgataactaccctgaggtaatgccttggatgcacaatatattggttgtaattctgcagaaaattttgtgctggatttattaaagttctcgccgcatgtaattgtttttgcagacattgtgtcgaatgttcatcattaatgctgggccaggattccgacttctttggagcacagtgaagagtttccttgacccaaagaccacagcaaagattcatgttagtgttcttccaatactttgtctatgagtgctcaacttgaagattgattatcaataatctgtgcatttctttaggtgttgggcaacaagtaccagagcaagcttcttgaggtgatcgatgctaggtagaacacctgatgctctaagttaaccatcatattcgaagacaatgttcaccattttaattctattaatttatgttgtctagtgagctgccggagttttttggtggaacttgccaatgtgaaggtggttgcatgaaggctgacaagggcccctggaaggatgctgaaatattgaaggtgactgttccaatctgaacctttattatccttgaacaaattcttaaattacaattcataagggacaaggaactcaaaatttctatgctatattatgtttagatggttcaaagcggggctgggtggtgtggaaatcttagtttgaatcatctggatgctgaggagaaaatgatgatttgtgaagatgacaccatgcacaccaaggtagcaaagatgttacacgctctttgcactagcacattcatatttaagtatttctaaatgtattggatcatagtacttagacatctgttattttatttacgtaaaataaagaggcaggagtctttcaaatatgaaaggtgcactttgtcacgaaaaatatcctgtgcccgaattgaacatccttcattatcgcctg

SEQ ID NO: 49486 - DNA, 818 bp, Oryza sativa
atgccaaagaaggtacttggtgctacccttggggcacaaagtacatccaaaatccaagcacaacaactatccgagatatcagtggaggctgtgtcagtagctgaatatgtttcttctacagagcgtttgtccgatattgaggagaaggtcattgcgattctcaccaagcctgcagaaatgccagctgataaagaggagatgctaaagactgccgtcagccgtgttagtgcattggaggaggaacttgcagcgaccaagaaggtttgtctgttttcaccttaatgatgataagcacattcttattacattaatcccatagatctgtattattaaatgtattgagactaacaaattacatgttgttctactactcttactaaaccatttctaaaacacgcatattatatgtttttttcaggccttgcaggagactcttgagcggcaagaggagatcatggcatacattgagaagaaaaagaagaagaaaagcaaggtaaaaaagggaaattaaaaggcatccttttgctgctgtgttgtgaccctcaactacaagaagtaaagttttgcacttgtcgctgaccggtgtaccaaaatatatgagattctcaccaaataattagtgttgcttgttctctttatgaactcatctactatatacttatgctaaaaaaatgtttttccttcctaatcattgatttcataaatttaactttgccatttgaaatttcacttgcagcgcttgtttcgttggtaatatgcgaagaacaaataccatgggtttgatcaagaggtgatgttttcatcgttggcaaaagacg

SEQ ID NO: 49487 - DNA, 3680 bp, Oryza sativa
aattatgcaaagatagacttagcttcgcatgcatttgtattgtgcattcatattaagtcggtaacctaaacttagtttatcatgtatgatgcgtgctaactttcaggccattatcaatccttagttgctcccatcactaattatgtttaatctcatatccataggatgactcatcccagcactcgctctcaatcccatgatgctccggagggttcccgaagccgtggtgatgaaccgccaccttgtcctaccatggctgaggttcttatggtcgtggagtgcaaccgtgtggctcgaaacaccgtccttcagcaaatcacagcaagtgcagccgctaccgctgcccacattgcccaaggtgcaggcggtggtggacaccatgccgccgggggactcgctgaatttcatcatactcaacctccggtgttcactcgctccaatgatccacttgattgtcgcgcccggaaaaataccttttccagaacgctagtgtattaatccccgtcccaggaaaagctggggtacaccacacaaacatgatataaaagacacatctttattatatcgataatatttacattattacaaaggcacttcaggcctatggctccatcttcacaggcgctcaactggggtataagccatggctccacctaaacttcttctccaaagctttactgaagggggtgaaagatagagcaagaatgagtacaaccacagtactcagcaagtcacaccgggagatgcatgattaatgcaagggagtacaaagggtgataatatagggttaagttttacaataaacagcatttaagagtcacttagttgcccaaagctattttataaagatgatcctagagctacacagtattattaatcaaggccgtgagcccacacgaacctgccttaacccaaggccaacgataattcagaccgaactggcaacccgacttgggtcctagctcatcccaagccaacccaggccaaccattccacattttagttgttaagcaagttttaagaattaaaccactaacttgggtacattactaggcttgcccataaccgagggcgcggctattcgaatagattatgctctgattagaggtgtacatctttacccacaagacacatctttactctgcattcgacggccgtggaacccgtcataaaggatgtgacataacccctttacccatcctagccatgacaaaagcaccgacccaacctcgcctacagccagaatcccgagacaggtaggtacgattgagcccctagcagcaggacaccggccctgtgtcataacatctcgactaccgagccgcagcccgtgtagccttcatttgccctagagatgtccatcgagccccgacttcgtccatctccatccatgtactctttccaggactagactgagcaccgagttaagccttacccattagacatgtggttagtacggtagtgctttgcaacataggcccgaagaccggtccttatagtggccgaggtgctactagaaaaaccatgtacctcgagcccagcctaaaaccattttgggagttttgaatagaggggggaggtgtgtgttcaattccatcacaagccaaccattccacagtgtccaaatgatatgagaactcccaaagtctaaagttataaaaccacctagtgttgcctaattaatcagcgaagcatctacctaaattcatactagtggaaccgttaatagagtacccactagttggggttttgtttatcctagggtgaacaaggtaataataacaatagcaataataatgtcataacaaaggtaaataggcatggctaataaaacagtgataacgcgggaatttaagtaaagcggtaatgcaataatttaaatcaaaataattttataaactgggattcaatatgctcaagggtgatgcgacttgccttgcttacagagaacggccttccgaaccttcgacgacgaccgtgaaccacgcttcgggaacctccggaacgacagaagctacgtgaagcacacaagcaaaactacaagcctatgaagaagcaataacaatacataaaaagaaagcacgtggttctttaggttataacaaacattacgagacttgaacaggtcgattcagagctcgtatgaccaatatttggtcatcaagtttaatgttgtcacgtggagatttacggattattgtaattaggctttgcaactataaaacatgtgtaagcactagcctggaaaagacaggaaggctgcgccgttgacatgcggaccccacatgtcaacctaagggaccacggtggaccgggtacacagagacggtccacgggtcgacggaagcggaccccgtgtgtcaaccgaggcgagtggccggcaaacggactctaccagacaccacgcggctgcacacgtggaaaccacgcggctaccgagcaggcacacaaacacggtcaccacacgcacccacgaatgactacagacaccggtacacgggtaccggggtcgacaaccgcacaacgggcacggggcgacaccgaaaggacgaggatggggcagcgagaggaggcacccttaccaccacgcgaaaaggcgcggcacgacgacgacgaatgggcacggcggagacggctcggggacgatggaggcgaacgacttcggcggcgatccttggacgaaggcgagacgcggccagcacgaggcttgacgacgtggagccgaggacgaagacgacgacggggctgcagcagctcgcttgacgaaccactggcggcaaacgcaattggcttgacggagggacgaatgccacgacgaccgggaacgacgggaggacgacgaccggaaccggcgaggaggcgatgagggcagccggcagcagctacacggatgcgaggacggcgcggaacacgccgctgtgatgacgatgatggtggcggcgcagcaagacgatgagctgggtgaccgacgggacgtcgacgacgaggatgaacggagacgacgacgatggaccgcggaggggtttggatggaggggaggcgatgccaaggaagatgtcgccggctcgccgctgtgattccggaggtggtggtggcgcggccgacggtgcacgtgtggaggaagggccgaccggggaaattccggcgaggcggatggagaggccggcgtggcacggcggtgttccggcgaaattcgggcgacgtcgtggcctagccgaggaagaggacggagttccggtgccgggagaggtggtggcgacaacggccgacgcacaggagacgcggcagaggcggaacagtggcagcaacgccactgttgccggcgaggatgcacttccggaggtctccgcgggaaacggagagcatgccggggaaggggaggcgactgcgacgccgggggaggcgatggcacggccggccggctagctgacgcggcggcaggggcggttggagtcggccggtgctagggagtgagaaggaggcggcgtggaggtggctaaagactcggaagggaccaaaatgtaacgaggggaggatgaggacttcgttttatagggcaaggagggagtgccagtcacgggagaggtcaaagaagggggattaaatcccggcgattggggatgggattaaatggggaaagttagggtacctagagaggaagggatgtggattccatttct

SEQ ID NO: 49488 - DNA, 831 bp, Oryza sativa
aatttaatactaaagtaaacttatgcataaataagtaaggagcttatgacatgtgtaaggtaaactgtaattctatcatatcaatatcacctcaggttaatgagagtccaaatataacttttataaacatttacatgcatttaggaaagggaaacacatataagacataagtcttgcgaattatctaaaataattcgtgcaagataaaatcatgggaaaattcctgtaggctctactcaactcatacaactcactgtaattttggtataatttaataactaaatttggtacctcaaataaatcagtcaaactaataaaaactagattaaccgtagttcttaatcggctaaaaccatactttatctaaaagtgcatttaactgcataaaagtgtataagtaaaataatttattcaaatactaggtcatttatcatgaataaaaataatttttccagaatttatcttctctgtttaaattactaaagtgggagagagaaataatcctgaaaatcattcaaaacttttgttcacccacgtttctgcccaaccctctcaccctagcttagtttgccacgacctggacccacttggcagccactctggctcgtcctcaccttgtgcaaatcttccagccgaccagagacagccgagagagagagagagattggcgccggctgtgtacgacgcgtggccacaatgtgtcgacgccatcaaactcctattctagccttctcctcctcccagctgcatctccacacatcattctccacctctaagccgaagaaaccgagggaggaggctctcaacttctccgtcgccctcatccttgct

SEQ ID NO: 49489 - DNA, 1034 bp, Oryza sativa
acatttgataaagcagccccctacgcatgtctgtaaaaaaaaaagttaagtggggtttcatgcggccttccatgatccactagtcgttctcatgctagattagcccctttgtttgacattcatatggattttacaatctgttgggaatgcataatttttattcaacgaagaccttcagttataccacatttggctcgtacgttaaaccgatgctagcctagtgtctagggtcctccagtgtggtttgtaatatgagataccaaacctagtttgatgaacatctgcatgtgtctcttcatgatactcaaagtgacacatgcagatgtcctcgacctccctgccacacatgtagatgttcttttcccatatcatttttctaatctgccatcaaattcgcaaacaaaacaaagattgcattgctcatttttctcacgttggattggacacttttgtaagctgaaatttgtattatggagtttgttgttgttgttgcaaaagtcagctaaaggtaaacaactactccctccgtttaatattacaagacaatgatagaaagacttataatatgaaacggagaaagtaatcaaaaagcttctcctggtggagttgattgattgatgcctatttagatttcctccagtattctcaacgcagattccgcatagatgcgttgtctgaaaattgaaaaccacattacaggagcataaagttaaaacaaaatttagccaaaatttatagaattggagggagatagggaatgaaaggtttttctttcttggcgtacttctcttgggtgtgtctagggccagccggccagggcgattgtgtttcatgtatccatcccatggaaccttcttaaggccaacctgagcagcgatcatatccctcaccccatcaaagtattggaaaatgatgtgagccattgtatattttattcatttattttaaatgaagagccaattcaattgcggtctctcctggcataatttgctgagggtccaagaaccaaacatcacacacaacaccccatgatg

SEQ ID NO: 49490 - DNA, 1109 bp, Oryza sativa
tcgagtaaaagtaagattaccaaatataggattgctaaggatagcatttcttacttttcttccaccatgttgaagcagaaggagcggctgcttgtccttggcgttggcgcgggtgtgtggttgggtgatgacgatctgctagccattgtcaataataacgaaattagggccctcctgtgtgtctcctggtagaaggcatcccatgcgcaccacctgaagtagtcaacaatgcagggaacttcttgttagagtggagccagaaggtcttaaggtaggacttggatatgacaactttgccggtgatggcggtgaaggggtcgaactccacggtgtcgatgacgagcacgtggtcgaaagatgtggtgtgcgtgtccgcgccgccccagcgccgctatcaacacagagctggagcgtgccagcgctctgaaggctagatcagaacgtgccctcgtttagcaggaggaaaacgacatacgcgtcaccgccaccaccatccattaaattcgcaccttggaggagaatttgaaagacttgggccctcttcactgcaagctctccacgtggtgtgctaaatttggattgtcgcacccgaatgcttgccctttgtgcgattaagatggggagacaatgcaacacatcttcatatcttatcttgtgtctctgcccgtcaagtatggttctctagtcctagaaaatatcagattgacgatggcagcacctcaaccttaggcaacctgtttttttagtgggtgatccaaggtagtcgagcattatactaaggagacaaagaaatgattaagttccttaatcagcctagtggcacaagaaatttaaaagtactggaataattgtgtgttcattaatatcacaccaacggcacagttgtcttgcaagcattagcaatagagtgttcgtattggctgatgccacataggtcgctttcttttgatggttagctgctcatgggaggtttttgtgtgtcacgtgttttttaatgtctttttcctagagagttccttttttgtggaccactctattgtacaaatttctgcttcttgaagcacaagcctctcgcattttcttgaaagaaaaaagaaatgttctagggt

SEQ ID NO: 49491 - DNA, 1041 bp, Oryza sativa
tttagtactctttgctgttgtggtgttgtttttggggaaactacctcttaaatcatgtttaggagtttatttagcattcctatgtttctaacttttaaaatccataaataaataatgacaacacttatagctgtgaaataatttttcttaggagctgtgagtgatgtacattactctaaaaataatcattattagaaatcttggtttgaaatgcattttacttgtaatgtacaaaaggaaatgttaatatttgcagaactgccattttcagcacctgagagcttgtcattttcatatctcccaaactataagtgataatctggtgattatttcaactaaattcaagttaaaatatgatctacccactgtatttatttcataatttattgatcattttgcatgtgcatgtttatttggctcttattcgcatattgcttcttttcgatagattcggagattccggggagtaacgagccatatcccgaggaggatagtgactaccctcagcagcaaggcaagcacctaagcatatagaatctatgctttctctaaaaatgatttggttgcaatctatacgtatatatatgcatgcattgcctagatattaatattgtcggtttatggtgtatgggtagaacctatttatgcatttagttcttgtgatattgctgtccttataccctattaccactggttggaattacttgggatgtcttattcattaatgcttagccatgcttagtgctaatagaactatagggatggacaatgctattaattgtggtatatagacaacttgcatttttaggcataaaacttgagcacttacactaaataatggttgatgaaatatgttggacttggacgggtgatagggcgatgatgggaggttggtttcccctgatgcaagttgccccgtctaggtcgttaaggatcgaacattttgacatctaatcaagcatcctacgtattttccacatgccttatttgggatcggcttgttcttactagttctactgtgatcatttgatgaactactgt

SEQ ID NO: 49492 - DNA, 1048 bp, Oryza sativa
atgacgcatctgctttgtcaccttgtcaaagagattggtattctcaggcctgtgtacctacacaacatgtttcctttcgagaggtacatgggcgttctgaagaagtatgttcgtaaccgtgctcgtctagaggcaatcatcgccaaggggtatggaacagagaaggtcattgaattctgcgtagaatttattgaagaccttcgcccaatcggggtgcttgaatcacgccatgaaaggagactacgggaaaggggactctcggaaggaaatcaataatgacggtggacaacaatttattccgtaaagcccatttcatggttctgcaacaatcttcattggtggctccttacgtcgaggagcacttggctctagttcgcgccagaaacatcggtaagtccgatgcatggattacacggtatcacattgatactttccccgcgtggctgtgacaacatctcatgtgtaacgagacgattgaccaacaactggccttcctagcgaggggaccatctggctcgatcgcgacattctagggatataagatcaatgggtatacattctacacgagagcccaagacatgaagagcacgaaccagaatagtgttgttcgtatagatgccataggacacgatggtacaactggcatgtattacggtgccatcgaggacatatgggaacttgactatcgacctctcaaggtctctctgttccggtgccaatgggttaggttgactggtggaggcgtaacgattgatggcagtgggatgacaacgattgaccttaacaaggttgtcggactaaccttttgtccttgccaatgatgtaacgcaagttttttacatgaaggacatgtctagcaaaggaaagaagggcaaagggcctgacgagccaaagccccacgtggttctcccaggcaaaagaaaaatcgtcgaagtagaggacaagactgacgaggattacgatcagtttgatgggcaaccccctttcacggtgacaattgaccctagcatcctcctatcaaatgaagacaccccttactcacctagtg

SEQ ID NO: 49493 - DNA, 2412 bp, Oryza sativa
acctaaccgtgttaaaaaagaatttggaaatagcgggaaaagatcttttggcccggttggtgataacaaccgggactaaagatatctttagtccgactaaagatatctttagtcccggttcgtaagaacaaccgggactaaagatgttaagataagatctttagtcccggttgttgtcatgaatagggactaaagatatctttagtcccggttgttctcactaaccgggactaaagatcatggggtatatatatgcccaaggcgcactcgtcttctccaccaacacttagatgtttttctccgatctcagctgcatcaccttcgccgccgcgcctagggcatcccttgctccgacgccgcagtcatctcgctgtcgtcgtcgtcgccgtcgacgccgccgccgcattggggtgagaggctccgcgatctcaatctttctctctctctctctctaaaccggccgcctcgctcgtcgtcgtcgtcctcgcgccgctcccgacgccgccgccactctcgacgccgacgccaacgccgccgccgccgccaccgcgccacgccaccgctgatgccaacgcctacgccgacgccgccgccgccgccgcaccatgccaccgccgccgtgccaaagccactgccgatgccaacgccgacgacgccgctgtgccacgccaccagtgccgtgcaacgccaccacctttgccaccgccgcctttgccgacgccgtggccgccactgccgaacgcgaacgacacgtgaacgaactggaacgaacgggaacgaaacgtgtacgaacgggaatgaaatgcaaacgaatgtaaacgaaccttgaatgaacgggaatgaaacacgaacgaacgggaacgaaacacgaacgaatgtgaacggaccgcgaatgaacaagaacgaaacgtgaatgaacgcgaacgaatgtgaacgaaccgcgaacgaacgggaataaaacgcgaatgaacgcaaagttacatgtctcacaaattaatccatgaacctaaacttctactcccctccgtcctagtttaatcatgcagcgcactaatcaaaatatgttcctttgtgtttagactaacacatttttttccatgttgtaggaaagacgtcgtcgtcgtcccttaagccaaagtggtagctagccctagtaggaatttgcgcaggcaagtgatgtaattatatatgagtattagagtattaatatatgattattagaattttaatacaagagtattagagttttaatatatgattatttagacttagcatatatgactattagagttttaatatatgaaacttagacttagcatatatgattattagagttttaatatatgattattagagtattaatatatgattattacgaattttaatatatgattattagagtattaatatatgattattagagtattaatatatgattattagagttagcatatatgattattagagtattaatatatgattatttagacttagcatatatgattattagagttttaatattagaaacttagacttagcatatacggttattacactcagcatatatgattattatagttttcatataagattattagagttttaatatatgattaattattagacttagcatatatgattattcgacttagcatatatgattattagagttttcacataagattattagagttttaatatatgattaattattcgacttagcatatatgattattcgacttagcatatatgattattagagttagcatatatgaatattagacttagcatatatgattattagacttagcatgtattaatatttatcgttttaatataagattatcagagttagcatatatgattattagagtattaatatatgattatcagagttagcatatatgattattatagttttaatatatgattattagagttagcatatatgattattagacttagcatatatgattattagagttttaatatatgattattagagttctaatcaaatattatatacgtaaataacaaacggctgcaaatatttcttgtatgaacagatggctgatcgcgatgacaaacatatactatacgatacaatcgcagagggaagcagccagtactggaacgaagaagaggggaacgaggatccaaaccagtacctgaacgaggaggggaacgtggagagtgatgcagaggggactgaggaggggaacaaggaggcggaggctagtggaagtcaatcctccgctggacagaagagggcacgcggacaacgaggtgccgcgaagaagatagagggtcggcacatcataactgaggtggacgaagacgatcgacctagtgccccggctgaagcagccaagaattttgtacgacacagcggttgggttgtgaaggataacg

SEQ ID NO: 49494 - DNA, 1549 bp, Oryza sativa
aaataatgcataagttgaaatgaaacaatagctttaaatgggttcaacatgctcaaagggttatttgggatctttgtgacttgccttgcaataatcggtcttcaattagtcttcttgaatttttctgatgcactcatgactcttcgaaacgatggataacgacaagctaacacgcaaaacaaaaaaaactaataaaaaccaaataaataatacataaaaagtaaacaaacatgtagatcatgattttagatgaatttagcaacttgaaccacttaattccaacttcatatgaattaattatgaattttcgaagtttaatcagtttttcacctaatatagaaaaccattacgatttaaatttaagaatttatgatgtcatgatgacatcactaacaggcatggctctggaccacacaaccgccggcgatggaggactcggccgggccaactgagggcatctacgtcatgaggacgacgagaggaactcaccggtggtgacggcgacgacaatcgatgacggaaaacggccggcgacgagcttcaaaaggcggcgacctcgggtcatcgatggcggcggtgctccggcgggaaacggcagcaatagagggggggcgggcttcttctcgcttctgcgatcccatgggtggcgacggcgaacgaaggcggcgatggacggcgacgagcggcacggctgaagacgcggcgacggatgattgcctcgggttgacggcgacgatgaagctccgatggtttgcagcggcggagaaggggtggacggtcttcggcttggcgctgcgatgccgaagacggcctcggggtgaaccagcaacgaccgcaacagtgaggaggatcggctggagatcaaaccgaggcggcgaactcggccttcacggtgatagcggcttccggcgggatttggcggagggaaaccggtggccggggtagagatcaaccttgcggagcggagggaagcggcggcactgatcgggaacggccgacgtgacgggaaaaggcggctggagatggtggccggagttggagagagaaggcgagcgtgcggaggcggctagggttagggaaaacttcgggtaacagggggaaaccgaagaagaggccgaggggctgctatttatagccggaagagggagagatcggctcgggaacggatggattcgatgaaggaagttaggatttatcccgagttcacccggataaaaaacgggccgaaattcatgggatagataacgaatttgatggggttttcttgggattagatagaggagatcgagaggaatccatttttgcaatcaatttcggaagggtagcaatggatgcaccggatttgatggaggaggcggcgcggcaacgcatggcacgggatgagatcggccggctagaggaggaggaagacggcactgtgcagagtgggccccaggtgccggagagaaagaaggaggagggacacaaatcagacttcggccaagggagagattgggccaagagcgagtgaggacttttcccaattcagcccgaaaaggaaaaagggact

SEQ ID NO: 49495 - DNA, 4108 bp, Oryza sativa
ataatcagaccattcaatgactaatttaatatttaaataattgctaaaatgctatttgtattattaaaattaggagttgagctccgaaaaatccgagaaaattccagagagtataattaatcatggagaatttaataaaaattaaatccagccatgctttatatttaaaaaattttatttcccacatttaacttcacttgtaaattaattaatatttaatataaattctaagaataatttattaaataatttataaatcctgaaacgaaattcaggatgtgacacactggtgacagtgtcagtgcagtttagctctcggccaatcgtgttcagcatcaacgcacgaagcacgtcgaaatcgacttacactttgttcgcgagaggtcgccctttgtgatgttcgagtgttacatgttcccaccacttaccgctcccgcctgcgatttgacgccgccctcaggacccactgccaggtcgccgtcccctgtctcctcgccgtcgctccgtcctcaagatcggtgggagagcagcagacatgggggatctcgctcggtctcatcggcgcggggaagctcaccagcacgcagagcagagaagcttgccaatggggggagttgcaggtgtggaggtcctcgtcggtgggggtgtagtacgtgattcctgtgagaggtgagtagttgaacacaaaactcatcatgcagtccttgtcgctcttccacagagtacaacgtacgtggggtgctcgcgaacttccatgtccatctccacacctgtaatgccgagatcatgtgttctggagagtgcatatgaattctggattttagatccacacaacgacttgtacgtgtgccaagtcatggcgatcgttagtaatatgaaggtgtgtattcatcgaactattatgcatatgatctttaggtgataaaatattgattgaattgtctaccgttatctttcagaatccatactccagaaatcttacatatacacatatttgttgcatcaaacctaagctttcttttcatacatccctgaacaattcaacttcacaactgctctcgacataatctcattcagaatggtttttttttctcaaattagttggacatagcaaaatattgcttttcaagactgtaacacaaccaactagcagggatattcataaattttccccttctgttgggtgtttttttatagacatatataatgaaggcgtatataacaaagggagaagctgtttgagggtcttaaggacaatagctcaattgactaggaaattgatgtacaaatctctaccttgttttttgatttatagtttctttggtttcaaaaagtaaagtagctcatgacatgagaactttactagcagagaaatgggcttatatattattggaaagataaatttctccatcgatacttgctgccttgattgtgttgcgtgtgccagccctgtaggtggcaaatcattggagaatcagatgcagcttttagatgggcaaagtaaggccatggtcggtctgattaatctgtacagctttcaggcataggctcttgagataaaaaggtatcaaatttcaacttcttgatactcagtactcaagacatctgttaggagtagagctcagagaaaccctatttttagatcctgtaatcagtggcagagcttcgtggaggataaactgggttatggctcctccagcttcatgcaaatacactatattgagtatgttcatcttcatagacattgattaccatctttaacaggttagtttatgtagaaatcctacattatatttcatgttaatggccacttcttgttagtctatgaagctccgccattgtctgtaatgttgtttctgttaatggaaataggggtaatcttcaaaaaaagtctcatcttcgcactttcacattttttttgaaaaaaaaatatttctaaaataaattttttttaaaaaaaagaaatcctacattatatttcattgtataatatgctgatttagtgattttgagtagaatttcagggagtcaatgcaaaaacttgcatagtttggtcaacgccaccatcatgaagagttgcccaggcaagaagaactctggcaagctcatcatcacatgattcataattcgcactcaaaacatagaagttcaagacttcaggttattgtctcatctctacatctgattatcaaattagtttttttttcccatttttctatattttataaattccactacaaatgatcaatgaataacctcaggatttgacttctttttcaactgatctcttttttttttagcaaaacactgtagaggaagccccacagtaaacaatatattaaaaattaaaaaaaatatttacaacaagttcaaccaatgaatgaggactggtctctcaattacatttaactaggtgataccctgcgtgttgctgtgggatttgtaagaagtgatcatgatattttaagtgctgacaaatgctcaagcattacacaacaaagtaatcaattaggggtaggaacggtgcaaacaactctgaagaagggcaatataaatgttttgtacaaatatatacctgtagtctggtacgaataacgggagttcttcattgaaaaaagcagatctcagctcagcggtagtgcatttgtatatctagaagtagctatcaacttgtcaagtgtgaatgtgtgatttcctgaacatcttaatttcccacaattaatgaatctctaacaaaaaaaactgttgtatatttacctgttgtgcatttacctggttaagtggtgtgctgcttctgaactccttttaagtaccgttcaaaccctaatctagctaccaactggagtgattacttgattagtgaaggagcattgcggggttcataaaagtgtgagcagatagttacaaaccatggaggcaatggatattgtgtaattagcagatcatattcaagcctgaaattaaaaacatgtacaattgaggtccaacataagaatgtgacttagcctatgattgtacactgaaatgtcacttagcctatgattggacactttctcattagctgaacatgtagctgaatattaggcatcagagtttgtatgtgggtaaacaacaactaaagaatacatcataattgatgacatgatccaagaaagtcaccctgtagggtggtaataacagtacttaatgaaaataggcaaaacattatcaaaatgtagaagtgtgatgaaatagtaaagttcatttgcaaaacgtagaagtgttttgtatggttagtaaaagtcccatgtaaattggtagcaagatattcacttagaaaaattgatattgcaagatagacaatattaaatgcaggttagtgggacacatttatagaatagcagaatatgcctgatgctgtacgctgctgagaattgcgttcatttattctttgattaaaagtgcttggtatgattgccactggcataatattagaagtgcttgatatgattgccactggcataatatggtatagtccgataataagaattaaacagagaataacgtattgcagttctgaaaatttgataaatcacctttgcattagaaaaaaaatatctcatcaaagaaaataaaactgaaaactgaaggtgaaatttagaggcaagtactataaaatccacaggaaagtaggaatgcatgcaagatgtagcatgaaggacctaactgtacatcggacaaaggatgaacagtgcaaagcctatacagcggaagaactaattgggaaatagtggagcttgaacgaaaccaatgaaccaaatctgctgacgctctgcacgtataaacatgatttagctcaaacaataccaaaccgatgcaataagctgatcaatggggcttagataaaagtagaagaaaagaacttgagaaaaaggaaacatgaagataaacatctcaagtcatacccaaacactgtgagaagacatctacggccaggaaccggatgcaggtcgaagaaatcgatatatgagaaaactcaagtgtgttgatggaattgataattgatttaattgccacagttgatgccttgcagttacctgaatttggggagataaccaaaggttttaga

SEQ ID NO: 49496 - DNA, 1844 bp, Oryza sativa
aaatcccaaatccacgcgcaagcctgcccgccgcctgagcacttgtttgcctccagcagccatgatccacagccccgaggacggtcggccacccgtggaattcacacaactacttgaggtctcctaatcaaatgccgcccacgcagtcgtcgacggagtcgccgcacgcctccctgcgcattggcctcacggctgcctattgatgtaaaaacacgaggcatgtgagatctgcttaacttcagtgcatgtccaaaagcttgcctttaggttcgtgagtgtgccagttgatttgatcctgcaattaacaagagataaagacaaagaaccgcagttaaatccataaacaatagccgatcggctagttgccgatgacatatcatttatctttgagccgatgtcatatgtagatcgatcggcaatcatgaataagtaagaaaggactaaatctactcgatcggctatagatattaacaatatataatcgttatgtcgatatatatttaaatcaagtgattgggatagatcggtcgccatgcctagacaatatgaatcacttggattgaaatatatactaacaacaagactatatatgttcatagcatagctgatcagatagatctagtatgtatcagctaatactccgataccactctatattaagatatcacagcaagcaaaatataccaaacaaaagcctaatatacttaaatgcagcaagatcttaacataaagggcagatttaacatgtcaatcgagcatataagataaaagtggttaaatcagataagattggctgaaaccccgatgctaccctaatcagcaaccaaaagcaggctagaaattgagattctaatcacgactcataagatcaaactcaactgatgcagctataagtatgaaaagaaggataatatctagacaatcaagctgttggatgttttatagagtgatagatatcctatataatctaagtcaacgttagtatttaacctgatcggctgccttctggcaacagacgttagccaattgaaggttagatagcgatattgccaaagattacataagatatatgataactcaatgaattatataaacaagattagagtatcataaagatggaagcactaatcccgagaacgtaagtcgtcataacaagttttacctatagttgaagatcgaaaccgatgcagctcaactcgaaaacaagaactcgtcgaaagggtggcgatgcgccgagattgtattgaacgtgtgttagattgattccatggggctcggggtctatttatacccgagattacaaaatatgtccatgttggacacgactcttatctctaacaaactctaagataccataagtccttgcggcagacttttgcctaaacatatctctaagaaaattacatgaaatatcctaattaatagatacaattgtcttttcaggactctacccatgcatggcaatcttcatgaagcacattaactcaacccgacaacgtatgccgtgtcatattgttggatttggctcaatcggctaaccttgtccaactcggactctgccaatcctggtcgtagccgattcgtactttagccgatccttgctctgtttccggaacgatttccatcttgcatcctactccgctcctatcttcatctccgatactcagattaccaaatttggttgttaacaccgccgcacctccgtgcaagctggaccgcgaggacatcgtgccgccctgcacgccgggcccgcgaggccgccacgccgctacgcctcctgcgtgctagccagcgaggccgccgcctcgcctcctgcgctctggctggcgaggccgccgcgtcac

SEQ ID NO: 49497 - DNA, 1400 bp, Oryza sativa
tattggatattggattccttgcctcactgaaattcaaagaaccgttgttgctgctcgtcagtgtagtcagacttttttttttgagaatattgataaaggatttgaaggtatgttttcagaacattatttacttgcatgatttttcatgtagagatcaactgtggtccactgctgtagaaacaacatgtgttgattaccagtctgttaactctggatatatttggtgttattatcctggacatggacaatttggttagtacaatcaaacaataatttcgtatatttctatggtaagaaggctgaaatgatattatattcgctctttgttcatgtctatctgttatatattgctgcttgtactctattatatttgctcttgctgttttatacagcgtcacctaccaaacaacaacgtttctattagctattatttctaatccaataactgtactatatagaactctattagctactatataaaactctctggacttcgtgccatggttgcttcctatttcaaattcatatgttatctacgcaaatgaccaatatacttgttgagaataaataggccattttataacatgagatgtgttgtttcagggataacttatgtgctagcagaaccagttgttcagcactgttagatttagccaatgaaaaaacctggcaagcaattacaaagctgtttcattggcaagcaattacaaagcttctttagtgtgagagaatacctgttgtttcaggtcttgagtgtaccctggcatatcttgagggggagagagctgtaaaaaggaactgctttggaagctggagtgtcatcatagaagtgttgttgaatcgaaggcaaaagaggaagctgcaagggtcttgatttggatgaaggacatctgagatgcactttaaatccaacttgatggaaaatatacagttcctcaacaggagagattctggcttgacgccaaaggggtggacaggacataaaaagccattgcaaaatctccttgttcagctgtatgtgaaatgttgacactgcctatttgaaatataaaggaatggttttgttgacgaaatgagtctgcctagacttatgtttttctttaaaatgccttggcagttagtttctgaagttagaaagaagattaggatcaggatcattgttgatttgtatgttcaacaatctcaatgaacaattccacattgcaattaacttattcttgttgtattaaccactggataccattggacaatatgcagtaagatgtagcaatcaaagtgtttaaaccttgagtgggttagtatcgatttgctgcgtgagtttgtaaactttgagctttgttttctcataaaatatgtcattagtagcaataatataacagtgccaaagtactttcaaacat

SEQ ID NO: 49498 - DNA, 2133 bp, Oryza sativa
aaccatcctctcctcgctgttctgctagctcaagaatagtaaaagaaattgattttaatctgcatcttgggttcttagttctcacaggttcttgcactgacggagcagcttggaatcaagccggacattgtgtacaacgaacagaaacaaccatcggtgtgcggcggagatttgtgaagaggggacgacagataaaggttcaatgccaaggccaacaagttatggcggttcatatgtactgacatacaacccattcttgaacgccgctggcggtagcgccgcgcgcgacgcccagtccgggagggcgccgccgccgccgcttgctcgtcgtcgcaccacaggattgggagggggccgctcacgcccatcgacctcctcatccatcgctgctaccgctggcctccatcccctcgcactgctaccgtcagcctcttccctcgccaccgaccctgccgcgctgctgccgctggcctccgcccctaccgcactctccgcccaacttgtcaagctcttaccactaatacatacatgatagatttcctcctttttttaatatgcagtatataactggaaccgcacgaaaaaatggggggaccggcgcgaaactgtcgaccacacgggaaaatgcatttttccgtgcgaacgtcttaacccaaccacacgggataattctcattatcccgtgcggtcaacttaagaagatcacacggaaaaatcatttttcgcgtgcgggctttttaagtggaccgcacggaaaaatactctctcttttctctctcacccatttcaaatttttcacactctctcttcttttttcctttttattttctctccttctttactctcctcgatctcctcccctcccctctctctgcctccttttctcctccccacccctctctctcctctctctcctctctctctgtctctctgcgcgcgccgccggctccgtgttggcggcaattaaatgccgattctataccgccaaattctgcataaagtacggataataaaacatccaacatagtgataggtgcttaatctcacatattccacaagtgttggtatatatttgtatttagatgataaactcagatgctgggaggaaaatcagactaaagtgaggataaatgtgtatccctgcaaggatgggttgtgaacttcatcaaaacatcagtaaatcgacccaaaataccgaagaatgaatagagaaggatcaggggagaacatgggctgaaggccaggccaggagggcccagcccaggttcggccaaaccccctggttcggccgaaccaccaccaccaccgttggatgtggggtttggcgtggacgtcccagatgcatccctaatgacggttggagggcacttcggacatttccccttcgccaaccgtcatacctacccctatataaggacatcatctcactcacttcaacacacacttccaagcttgagcttaattataagaggctctattgtactatattgtatactagaataggaagagagtagagtagaagaagtcagaagaattccggagttgtcggtaatcttctcctattttcttttattccgtttattactctaaatttaatataatattcttcttaagtaatttagatttatcttgtgagaattatctcatggttagtttctaaatagcatacgggattattgtctactataatcaactaaaatatagtgattgctttggtgagttataaacactaaagtagatagtaattgcttagatatagtgttcagacagtctgttatccagtaattgctgcgtatcccacagtatgtttgaggtgggtgtagaggtggtgacagccctcgagatcagttaagtcctctctgtccgggtacatactagagcgacatctagcaacatcgggtcgccagtgcctgaagtattgcatctatgaacagcgggttcctagtgcctgaagtatcgcgttaggattaaattaagttttccctggttggtgtccttgtatgaactggaggaagatctgaccacacacgttcccttggattctatacccttagaatactccgtatggagaagtgctacatcggtatatccgtgcgcttgcggaaacacttcgcgtgcacgcgcggcgggcgc

SEQ ID NO: 49499 - DNA, 1838 bp, Oryza sativa
ggggccccacgcggctctcggtggcgggcttgatgatgacaggcggcgccgcggactccgcgtgcacgcggtagatctcaagcatctcctactctctttcttctccatggctgctacgacagcaaagtggtgtggttgtgatgttgaactactggttccagtctcttgatgatttctctcaagcttgagttgaatccccagccaaaccactggtggtggctgctattgctaatgttctggtagttgaagctgttgcgctactaatttctccatgccgatatagccagtgcttgagttcttgctctctcctttctttgatgtcactctctctctctctctgcgcgcgccgccggctccgcgtgcacgcgcggcagcggctgattttcctacggatggtttctatggctgtaactactaactagtactactgcagttgctgcttgtttcggtttctacgaccaaaatacggcggcgggcgccacgacgacgacgacgatgaggtggcgccgccggctccgcatgcacgtgcgccggccggctgttgctggtcgcggcggcgcccgcggcgatttttgcttttttttatttttgtttttttccgtgcggacggtataatttgactgcacggggtaatcgattatcccgtgcagtcaacttaacccgaccgtacgggaaaatgattatcccatgtggttgggccacccgcacgcgaaaatattgatttttccagacgtattgctgcatacgggcaagtcctccgcacggaaaaattattttgaccgcacggaaaaatgcttttcatagtagtgtgcgatcccctccaacagtgctgttgtcgccacgctctttgtgttgctgccaccgccgccgaccgccgcaggtggcctccatgccgtgggggtcgaggtgcgtcgccgccttgggagccttccccatccctctttcttccttgagctcggctcgccgctcgctgggcctgtgtcgtcgtcgttgttcgcttctgcccgactaccgcgtgctcaatcgccgcggtggaccactgcccctcctccgatggcaacgacacgtcagaattgaaaggggtagtggtgctgacaagtgagccccacatatttttatttttaccttttacgtgtaggatccacttttaccttccattcatttgacgactgagactaagtcaacctaccacatcagaataaatcacctccctaacaatcaatgagttcatttgcaccggtttttaaacttgaggaacacgattcgaccaagggcaagagttgaggtacgtgaaatagacttattccatcccatttcatcgcattctgaaacctgtgcccagcccagcccattgaagttcggcatagtcagcctgcaccgaatttttgtagagctcccttgctggctggagctggagaagtggagactggttgcggacctcaccctaaaccctagccatggcggcggccaaccttctctctcgcgcgctcctccctgctctaaaccctaacccaagcagccacagcaaccgcgtcagcccttcggccgtatctctccgctgccgccacggcctgacggcactccgttcgcgccctctctctccacggcagcgccgtccccgccgccgcggccggcggcggcggcggccgacggtcgggcgccgaagcgctgtttccggcgcggcgccgatgggcacctgtactgcgagggggtgagggtggaggacgcgatgggggcggcggagcggacccccttctacctctacagcaagcctcaggtggtgcggaacttcaccgcctaccgcgacgccctcgaggggctccgctccatcgttgggt

SEQ ID NO: 49500 - DNA, 801 bp, Oryza sativa
gcggggcgtgagggggaagtggtggaggacgtggagggggtcgtgcccgcgccgacagttgcgagcgcgggaggcgggagtggcggattttgcggcgacgtgggcggggtggttcggccggccatggtgatttggatggggaggccagaggtaggaggtgacaggtggggtccacgggtcccacctgtcggggagagagggagggagagttggaacggggaggaaagatggacttttgcaagggcggccgagggagagagaagctggccggagagagggaaagagagggcgcgggccgtgggaggggaaggggaattgggccggggcggcccaattacaaagaaagggaaagttaatttgtttttctttttatttaattggttaaatgatctttgtgactttaaaattagatattgagctccgaaaattcgcggaaaatttcagagtgttcattagggcacagagaatattacaaaatatttccggccaatgatttttaaaggaaaattttaattccctctataatttacttgattaaattgatttaacttttatttaatttctagaaaatgaattattgaatgatttttaatcccgaacaaaaatcggggcgttacattaatacaatgagcgtttgggaaaatggtagcatttttcccgacgtgacaatgtgtctgccacctatttagtttttgtgggtggatcttacaatgttttactccggtgaaaagttgcacgttatgtaaacatgttatgttttacttgatcaccagaaaggataaactaagagaataagaacaa

SEQ ID NO: 49501 - DNA, 741 bp, Oryza sativa
cttggtatgaatgtctccgagattttcttttgaagaatggttttaaaattggaaaggcggacactactctcttcactaaaaaatataagagtgatttattcatatgccaaatttaagtcgatgacataatatttggttctactaatgcctctttttgtgaagaatttagtagtatcatgactaaaaggttcgagagtctatgatgggcgagttgaccttcttcctcgggctacaagtgaagcaagcacaagagggcaccttcatctctcaaaccaagtatgtgaaagacatactcaagaagtttgggatggaggatgccaaacctatcaagacgcccatgcctactaatggccacctagaccacaacgataatggtaaatgtgtggaccaaaaggtatatcgctccatgataggatctttgctttacttatgtgcatctcgtcccgtgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaaga

SEQ ID NO: 49502 - DNA, 744 bp, Oryza sativa
  unsure (1)..(744): unsure at all n locations
atttttttgctacttgtgtgctacagttgtaacactgagtcaattttgcgtccatgtttcttatcccttcttagcacctggtaatcgtgatttatggtattgagaattttgatctggaacttaggtcttaatcatagtgggtagtagctattcattctattgtgactgttagttgtcatgctatgttgacatngtgataatgtctcgaagaaagaaatagtgcttttttaaccttgttagctgtggagatgtggagtagcatttgtttagaattttgcatttacaatgcggctgaggtttgcgccagcaagtgtgaccgcacctatgatttctgcgctaccttgaatcacggtgaacgcttggctgaggtcctgttcgcgaaaagaattttttgtcacatcggatctttgaccgaatatctaagatatcagaaggggtttttggacacgaataaaaaaaattaatctcataactcgtatggaaaccgcgagacgaatttatgttttagcctaattaagctgtcattagcacttgtgtgttactatagtatttatggctaatcatggactaattaggtttgaaagatttgtctcgtgatttccatacaaactgtgcaattaatttttatttttatctatatttaatgcttcaagcatgtatcaaagattcgatacgatgtttttgagaaaaaaaaatttatggctaatcatggactaattaggtttgaaagatttgtctcgtgat

SEQ ID NO: 49503 - DNA, 736 bp, Oryza sativa
tagccccattccatcgtcggaactccatctccaccataaaaccgagccactgccccttcaaccgcctccagctgcccgccaccgccactctagccactgccgcaccgcgccgatgccaccttcgggttcgccacgtcgtgccacgccccggccgccactccacccgtccattccatcgcctgaggactgtttccaccgtcgacccgagctccaccaccgcctgtgtcgcctcgagccaccgctcctcgccgcgtcagccatcgccacgcaaatccgccgccaccctcggcttcgccgcgctgccccgcacactagccgccactccagatccccaaaccatcaccggagccccggttccgctgccaacccgagccaccaccacctctatcgcctctggcggcctttccttgctgtcttcggtcgccgcgcgcggcctaacccctctctctctccttcctcgggccacgacgctccccggccgccccctcacttgccgggccggcgccgccatcgccgtggtcgtcgtcgtccttccctgtgccggtcatcgtcatctcggtgagcatctccctcctcctccccttcctttcttttcctctctttgccgcaccggccgccgcttgtgcgtcgccaccgtgcctcggcaccgctcgccaccgcagcccgcgtgcgccgccgcttcccgcgccggtggccgcgctgccgcatgccatcgctcgccggccggcctaagccg

SEQ ID NO: 49504 - DNA, 732 bp, Oryza sativa
tacagtagctcatcacaaccttctgttataataaccggaatgtcgagtagtgagcgcaagacataaccgtaagataggttgcgagtccactccgtcatatgcccgtcaaccactcgaaggtggcgaccaaaagcataccccagtgactcgatccaaagcactatccccgattatctcaagcgatcaaaacccattactcatgcttagctagtccccaggtatgcgactagcctcacactttcatctcaagcaattaataaacatagcaagtaccataatagggttaaagtgcaacgaggtacatgacacataatagggtccgaggtcccaacatacaacacataaatatagcagcggaagtctcaaatagagttcataagcaaaagataaaaccggtggtgccacaaccccagtagggcaaaccaaccgggcaagagccaagctgcaagagatcactcattgccctcgccgccctcggcagagcaatgaccacataagaagcataactcataatcggaatcctctcctgaaattgcagacaccgggttaagtacaagattgtactcgcaagtcttacccaaaattatatatacataaggaagagagaagtatgcaagcttttttagcctatagtgggtctctaggttgaacatttgtataaagctaattttattgagcaattaatgagtaaaataagcaaggacaagtaaatctagcatcatattaatttat

SEQ ID NO: 49505 - DNA, 712 bp, Oryza sativa
caagggcaagcgatgatggacagaaacaaagaaaatgccgccaagaagtaccatcacctcttggggtcggatggctatagcgtcacaatgctgaagtgggaggagatggaggccggcttgattgagaggggtgtcgaaccggccaccgctaaatggctggatcgatcgaagttctggtactatgctcacggtggaacgcttaaccctgttgacggctccctggtgttcagcgatcagatacgcgaggctgccagtcgactaacggatgtagtggaagcctcttgtcagggcacgttctgacccaacagagataaggacgagctgtcactcgccctgcagactcccgagcatcctggacgaacacgagggaaaggcgtggttccttggaagattggattcaaggaggacatccacacgtacaagagtcggatgaggagcaagagagataccgaggcgaagattgcagatcttgagtacagggtatcgagctacgagctcagcatgcaagaggaggtggcaaggaaggtggatgaacgcatggccgcacatcggtgccatgatgcccagccatacattcctcctgtaatggtcagcccctcaggcaatcgtagcagctgcgcctcaacggggcaggtaggatcacagagcatggacgccgtgcaaactcaggacgaaaccacttgccccattgatgagatcacgcagcggacac

SEQ ID NO: 49506 - DNA, 724 bp, Oryza sativa
tatatatccaatttttctatgcgtgcttacaaagtaattaatgtatgatgaagcaacatatagttgtgaaattgttttacaattttgtacggtaatttggattatatgcaaagtgtaatagtgtggtccctagataaattactcctttagccagtgagtttataaattcttatcctaataccgtcgatctaatttcgctatgaaattttgtggaatcactgatttaagattacataatacatgttcatttattttaatgttgagtaaattgcattggtggtacacaaacttgttaggtgggtgcaatttagtatataaacttataaaatgctcgtttcagtacacgaacttgtctggttcgtgcgaatgaggaccaaaataacttggcaatgtcaattttatgaagttgacgttgattaggatgcgacgtgtatacctgtagcaagtatgcataggacatgcaatatttataaatttagtctctactttatccttcatcattgaaatgatgaattttatatgtttctaacccttatatcagtgctcgatattttaaatctttttctactatcacttagtgcctgaagtattgcgttaggattaaaattaagttttccctggttggtgtccttggatgaactggaggaagatctgaccacacacgttcccttggattcgatacccttagaatactccgtatggagaagtgctacatcggtatatc

SEQ ID NO: 49507 - DNA, 1165 bp, Oryza sativa
  unsure (1)..(1165): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcttcaccttgtcgaacacagcgatcgtcctggttccttcctccaattccttgggtctcacctcgaacgccctcgtctcttgattatagacgctgacatactcggcgaactcgccttcctccggtggatcatcggcgaagattttctcccagacatgtgcccgccacagcctccgctcctcctgcagccgctgcgtctcctcgaactcgtcgacgtcgtactccacctcgacgaagccgttgctgccgtactcgacgcggaacttggcccaggatttgcccaggtggccttgaggatgccgttgacgtgcaccagcagcgcctccggctcgtcgtcgtagtagatctccgggaggtggtcctcgtcggcgtcggcgtcggggacgaatgggaatatgggatgtatctctcgatgtccggggcgtcgtcggtgcagagctctgtacggtcgaggacccactcgatcggcgttctcctgcgatagccgcatcgtcgccaccctcctcctcaccgccgccgccgccgtaccgtcggagttagggcacgcctcctgctggccatgctgctcgaccgccgccgccgccgcggccgccatgatttccccggctcgccgcggcgatacatttctgaacgaactcttagagccgtggcttatgtaaaataaaatgggccggtccgtacggttttcgggttaccggaaaccgaactagagttatcgctgcggccccctatccgtgtcactgcacgagcacgacgggggaactattctaatccctcgaggggatattccctcgtttactcaaaaaccatctaaacag

SEQ ID NO: 49508 - DNA, 4578 bp, Oryza sativa
ggactagtaggtataattatactctacattgtcaattttttttagaatttttgacaactatttgcatcgaatttagaagaaaaaggtatatgaggggatatcccctcgagggattagaatccactcccgcacgacggcctcacgttggcatcttaaccgtcctcggccgatcggacggctccgcacacagggtcgctggataagaaaatagccgaaattttgacaaatgaccctttcaagaaacttaattaaagataaatcgtaccaaaaactaatttagaaaatgataaaccgtgacctcgacgtgctttaacgtctcgacgctgctataacgttcatgctgagatcttgttcgacgaggcacaaattcgtcggaggagctcgcattcaccttctgtacaatctgaaatcacgcccagtagcgttcccggtcgtaggcaagcgagggcgcaaaactgatcgccctgagagagcgagggcgatcgctcgcccagtagcattcccggtcgtaggcaagtcactcagtatcattccatcgtatcctctttttttttcttttttttttactttaatgcatataaaaccaaatgagaccaataaatacatgcagcttggtgattgcagcacacagcaatatggaatggacgcagcagtggtatgcgccactatacgccattggcaacactgtgcctccaccgtatctattcatccttaccaatgatccccactagattgagccatctcacctaggtctgagctttagcataaggcaaagttcaaaggcaatatatagcacttgagagttgggagattggtattatagggggctgctataggcaaatgaacacaagaaagtttgcaatttttcatggtacgaattgaacagcattgaaacctaacaagtgcatgcactgttaacaagagatgaaaaaatatgcaaaactttgtaatttcacagcgttcaggcactacataatttcacctatctttccttcaattaaatagctaaacttgtgatttttaaagagaaaaaaaaaacagaaaggactaaagaaagttcacttataattagctaattaaaacatctcatattgcatagatgggccagcagtactcaagattgatcgccgattaagatccaaaaagataatcccacaataacaagaaaacaatgacatacgcttgcataaggaaagagatttgcagaatgcattgaattatcattaatcttctaaaccatcattatctaacttataacaagtgacaagtaccaacatcgcaatacataagtctgcttcagcaaatgggaaacctattaggcactcgttgattcagttcttcttcacgaagacaaaacgcttcttctccttatcgaacacaggaaccccaatattaccttccacttccttcatgacaaacttcctcctcttctcatcgtacacttcgatgtaatcgccgaactcgccgtcctcgatcgtgggaagaatatcagccatctcctccgcgagcatctccgcccacaacgccctccgctcctccctcctatgctgcctctgctcgaagtggttgtggtcgtactccacctcgacgaaccccttctcctcgtgcttggcgcgcacccacttctcgaagtccctgaacttgtcgaactcgtccatgaggagactgtcgatgtaccgcatcagggccttggggttatcgtagtaggactccggcaggggatcctccgcgccggggacgccggaggggctctggaggaggaaggggatgtacctcgagatgtcgggcgcgtcgtcgccgcacagctccttccgggcgaggatccagtcgacgttttcctgcgacagccgcagcttcgccgtcgccgtcgccggaacctcctcgtgggaaccagttgccgccgcagccatatatacttgttctgactcgccggcggcacgcagagggaagtttcgatgcttggattgccacaaaagggaatctcgtcgtctcgttaacctaagcaagccctctcgattttggagattgtgggggggaggaggcggtgcggcgtgcaggtttatactggtggaccgctccgcccgcgtccgactcgaagttcatcgttgaaaccgaaccggatactgaaaaccgatcgataggtgaagtccgcgtccgtcaggtcatgggcctcacgggtttaacagaccaaacggagcgcataccattttccggacaacgaaacaaatacgatcggacacaaataggaaaatattttttttttcggaacgtaaaaaccaactcaacttttaaaaacaaatatcatcatatataattagctcattttatataaaatataatataatatataactttttaaaagtttaaatattattaatagtgtggactagcgttaacagatggactactattaaaatctaaaaaggtatattgaaggtcatatagttataaagaaatacggtatgtcttatggcttttttgatatccgaattattattcatatctaaggaaaccccgatatcttattcgtattgtatatgggagaaaatatatgtttttttatcagtatccgaactatccgagaattatccgtttcgaaagatatatgtattcgtttttattcggaacggacaaaactatccactccactttcatccctagctattgacaatgtacagtggcatgcctaaaactaacggtgatattgacaatgtacagtggcttgctatatttctacatctctatctctaactctactttttatcttccatcttctatcttctactattataaaaattaaaaatgtttttgctagtattttgatacgtcatcattgtttgagtcaactttttaagttctacaaatccatgtttgagttcgtttttaagttcgttcgcttttaaaaatacaaaagtagtcgtacaagaaatttctttaaaaaaaactcgcatgctaacttgagacgaaagttggactcctaactgcagctaatgattttctaaaaaaattatccaagtgaattctcatagtgaatttcaccctaactaaaccgtataacaataataaaattaaaatagccttcaccgttgcaacgcacatgtatttttttctatttaaaaaaatgacaacatttcatggcaactcgcatatatccttttggtccctaaagtttggccttaaggtcaatatggtcctcgatattttattttgtccgatcagatccttaaactttgtcatatggtccaatatgaaccttaggctcaccagaaatgccatgtagacatgctatgtcatcattttattaaaagtggattgtgaaatttttaatctgtatatttgtatttgtatgtgataataaatactataactaattaatcttatataattagataatttaatctaatcccaggaattgatatatacactaggtcttgttcgtttctccaacaagatggagatgaaattttggatactcgtgatatgcttttcaaactactaaacgttacgtttcgtgcgaaaacttcctatatgaaagttgctctaaaatgtcagattaatccattttccaagtttttaataattaaaactcaattaatcacacgttattatcacatcgttttacgtgaaacacttaatctttatctccatcttcatcttcaggagattcaaacaccaaatagattatgttacaagatggcatggcaacgtgattttttttttccaaggaccatagtagactgaaagataaactctgaggactagttcgaacaaaatgaaatatcaaggatcatattgacctcaaagcgaaagtttaacgactaaattggcgccccccccccaaaaaaaaaaataataataaaggggagggggatgagcgggtgtttgtacgtacctacatatgtacgtttgatggtgtatgtacataagtaaatgtggcccatgaccttatttattagaatgccagatggtaatttaggagtgtttataggaattacacaaggcagcacagggatgatttggctctgcccgtttcatccttctcaccgcattatccgattattggttatttagggaatatatgtcacgccccgaaatagtcccgaccggaactagcccgtgacgtttcaaattaacctgttaatcgataccagtcccaggaaacagtgctggtatcacagggagacagaatatcacagcaacagaggtctctttattatagagtaggagtacagtcatgttgggctacggacagatcccgagctcacaactgcattacaaaaggaaagcggaagccaggacttggaccaatcatcacaggcgcgacttgggaactaggccgaaaccctaaaactcatcgtagccggcttgctcctggaagaactcctcatcagcaggatccgcttcatcttcttcagcaactgggggggattatttatacagagcaagggtgagtacgggggtactcagcaagccaggggaaataagtgtttaatgcaggcttcaaggagaggctgttgtttttgcaattgattttatttgaactccttttttctaaaaacgactaagtgagtgcttctc

SEQ ID NO: 49509 - DNA, 761 bp, Oryza sativa
cttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggt

SEQ ID NO: 49510 - DNA, 9913 bp, Oryza sativa
agtaattttcagggcaacatattggcttcggttgtgggctcaactacaaaagtgtgaggaagatggagttttcctgaatgttgcatgtcgtactcttgagtcaacggttatgcaactttttgccaaccatggatggagattttctaataggctggaataatgttttccttgtcatgttaggtctttcttttaattttggttggtttgatagtttcatctcgaattaagattttataagtgtgttactttttgtaataattggctgtagctctttggagtaaaggccgggatgtttcattccattatctaaaaaaacaaattttcagcttattattttttataatcatatattgtagcgcccgttccgtcgtggcgcctagcgggaaaattatctcttaaaaaccctaattgcgaaatttgtttctttgtttgttgtctagtgtccgtgccatctcaagatctcaatccccgatcaatcgtcgagttcaattccgaatccaaatccctccaaatcaatttcctccgcaaaagtctagtttgcctcccccgggttcgatgggccgaatccagctcggcccatctctctcccgggcgctctctctctctctctctctctctctccccccggcgcgctctttcctttcccccgctcagcctcgcccgcacgctgctcgcgcatgcgcgggagtcgcccgcgctgagcgccccctcccctcgcgcgagctccccgctcgcaaagccgcttcccgcgcgccgtgttcgcgtgcgcgcgcccgcgcggacgccgcctgttgcaagccgcgcgcgcgagccgagtggccgaccgcccggtcgccgccgccgtcagcctctgcgcgcgccagtcgccggtgtcgccgccccgctccaagccgcccccccgtcatcaccgtcgtcatcgcccggcccccgccactccgcgcgcaagccgccaagggacggagccgcgcccctcctccctctgccggcacgagcaaggacgcggaagaggactccggccgcaccctctccttcctcttccccggcccgaggccggagagattactcccgcgccgtcggcctctcatcacagcgcccctcctcttctcggtgatgtctctctccgttcttcctcctcgctccatctccttcccctagctttcggtagtagcttgagtagcttcccgtagttagccggcgccgccccgaccgttgccgtcgctcgccgcgtgctcgccgccgtcgccgcccgagctccgtagcacccgcttgtcgccggcctcgcttggcgtagttccgcccaatccgacgctagcatcgagttcccgaagccgcgtagatgctctcaccgccgggaatcgacctctcgtggcctcgtcgccgtttccctcttctcccgccgccggttgccgccgccgcaatccgccgccgtcgagcaacccccggcaaatccgagccgttggttcgtctcccctcgtctcgtgtaaccgcccggtgtgctcgcttttgcccgtatcaccgtggttcgctccgccgctcgccgccgccgcccgccgtccattcgcggccggatcgtcgtctaccacccgccggcccgcgtggcggccatgtaggcgccacgtcggcgccagctcagcccagaccgggtcgggccgaccccggtcggtccctccgcgtgcgcgcgttccaccgcaagccgtgaggctgcgcatgggcccgccgcacctgcgtccgccgcggaccgcgcgcgtgcaccgcgttcctccccgcccgcgcacgtgcgccgcgtgctccctccgcacggtgagccgagccgctgacaagcgggtcccacccggggccacgcgtggtgagcccggtccaccggactctctctcctccctcccgcgcgcgcgcgcgcttgggccgtcttgggccggccggcccgttaagctcggccgagccgccccaaatctcttgggccgcaccctagccgcccgagaaaagtctatattccctccctcccttcttttctttttcttttccaaaaaggatttaattaaatcctttttcctttagaccaaaaatccaataatcttagaaattcaatatcttcccaaccgtgactccgtttgactccgttcaacttccaaaattcatcaaatctcgagatctatctaatggcacgcttagaggtcattaatagggctttattttcgccgtttgttgagtcgttccgtttcgcgtgtagattcagagcccgaagacccgcagtgcgaggatttcgaggatcaagctccagatctcgagcaaggcaagccacctttgaacatcttgagcctatcattgaaatttaattatattgcttgaaaaatattatgcattgataggaccgcacttaatcttttgtcccatctacaaggcagattggtggacctacctgacttgttgcatttgatccttccattgttaattgccataccatgtccccttgtaaccacccagttgcgcctcgatattcgtgcactctgtgcgagtatcgacggtcgccttcaaacttaaaatctgagtaacaacctaggtaaaactggagttttacaaaagacttggaaaacccgacacctgggtcggtgcttgtgaactaaatggatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgccatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactaccgcttgtgaatttgctgttgagaaaatgggttcgatgtttgaaaaatcagcagctgacgggatcagctaggcccgggtggccgtttgaaaagttgttggcccgggtggccgtttgaaaagctgttggccgggtgccaatcttgtttcaaatctaaagactgatacattgcacatactccgaccggacaagacgcactgtctcatccgtgtcgtttgagaagcactcacttagtcgtttttagaaaaaaggagttcaaataaaatcaattgcaaaaacaacagcctctccttgaagcctgcattaaacacttatttcccctggcttgctgagtacccccatactcacccttgctctgtataaataatcccccccagttgctgaagaagatgaagcggatcctgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgtagcccaacatgactgtactcctactctataataaagagacctctgttgctgtgatattctgtctccctgtgataccagcactgtttcctaggactggtatcgattaacaggttaatttgaaacgtcacgggctagttccggtcgggactatttcggggcgtgacaagagatggtatcagagcacaggcttggccctagggcgaaacccgacgcttaggacgaccctaaggatactaagttcaaaactacttgcgaaaagctaaggtttcttttgttttctttattttcaatagtttgtttctaaaatggttactgatctttctccctctttcaaaattgtagatggaagtgaacgccagcttcagttcccacggttttggtgagggtcaccacgtcgcccagcttcgtgacctcgcccgtttccttggcttctcgtgtcccgagtacacggggtactccgtggaccgtgttccccctcactgtgagctctctgtgtacctttaccctcgtggaggtatacacggagctggccttcgcccccaccacttcactgtggccaggcccactctccagatcgcgtaccaggacctctcctggaatgcgcttcgtcgcctggcccacgactacagccaccgtctcggaggttccgccttccggcagcttccacgccttccttctggccactcagacgccaggtacccttgtccgtacagcgagtctcagccagtgctgactcgcatggtcgagctttcggaggctcaggccactcagcacgacctactccttgaggcttaccgctcccttgcccgccgctacgccactttggaggcccgtctggccgaggagggtgtcacctcagttgacactatctcttgggactcaggccgcctctgccacgccagccacctgtcctcccatagctcccgcggctctgctcgcactcccagtggcccgcgctcccccagctcgcgtgcgccgtactcaccagtgtactccccctacccacacccagttagcccttcctacacccccggacacactccagttgcttcctcccgccgtggcccacgctttatccgcactgcacggaagcgtgttgttggttcttccaccgtgttccgtttccgccacccagctcccccaccgccagcggcccgtgctgctgccggccctcgacaggttccgccggtcccttcgcgccagccgatcgacgtttcttcgactgaggagccgactacagggggcagccaggccgacgaggagtagaggaggcagtcttcagcagccgtccgtgtgttaggcccttttgttccgccgccaactcttttggagtcgtggcgaggtagcgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagttgtgcctagtgtgtgctatctgagttgctatttgctttgctccttgccctcctaagtgcttatctgactcttaccccgcccttttctgggagtttagatggctagccgcccccgccgtgcagctcgtgcaccagcccgctttggttttgaagatggtagagttgaagcagaagcaaatcatgaatcagctaatgagcagtctcaccgcagcaaccgttcgcaccgtactgtttcccgcaacgcagaggttgagcaaccccgccgcagcagccgctcgcatcgcacagtttcccgtgatgcagagatggagcagtctcacctctctcactgcactgtcagtcacaattctggagaagaacgcctcccttccccacctcatgtggaaaacaacatgcaacacataatggcagttcagacacaaatcttgcaaggactaaccacagccatagccagttttcagcataatgtgcatggccaccctcacgtgggcaacaatagatccaagctgacagactttctgaggtcacgtccgccagagttctctcagaccgtcgagcccgtcgaggctgacgattggttgaaagatgttgatagaaaactcaacttagtgcagtgtactcctgttgagaagacgctctacgcctctcaccagctaagaggacctgccgcagattggtgggaaaattactgcaatgcacatcctgaacccaataacattgcttgggatgagtttgctacggctttccgtgcagctcatgtgcctgaaagcactattgacatgaagaaagaagaattcaacagacttaagcaaggcaacaacagtgtcaatgagtacctaagtcagttcaacaagttggctcggtacgcccctgaggaagtagacaccgataagaagaagatcaggaaattcttgaagggaatcgcagttggaatgagactccagttgcttgctcatgacttccccacttttcaacatatgatcaacaaggcacttctgcttgaggatgccagaaaagaggctaccgaagaatacaagaaacgcaagtctaaccatcagggaaattcttcccgaggcgcacctcgccctcgctacggtcaacccatgcaataccaccagtcgatcactcaaactaaccgccagccaggctacgcccctcgtcctcagataaaccgtccggcacctccgccacagcagcgtgcccctagtggcaatactgcgccaaacagtgttacctctttcaagtcaccacagggaccgtcagcagttcagtgtttccggtgcaaccagatgggtcactatgctagacagtgtcctcagaatcctgccaacaccaactcagggcatgctaatggcagcaccgccagaactcctactccagcggcagctcagtctcgtcctagctctcaggcaagtggacaaggttctcgtgcttccaaccactttggtcgaggacgtgtgaatcacattcaagctgaaaccgctcaggatgctccagacgttgtgatgggtatgttctctgtcaactccgtacccgcaatagttctatttgattcaggagcttcccattctttcatatcacaagcttttgtgaaaagaaacggttggaaaacccaaaatttgcgtgtaccaatgatagtacattcccctgggaggaatataagggcaattcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtcagtgaatatcctgacgtatttccagaagaattaacgagtatgccaccagaccgagagattgagttcgccatagaactggtaccaggcacaactccaattgcataaataccctaccgaatggcagctaatgagttagcagaagtcaaaagacaaatcgaagagttggagagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagtcttctcaaaaattgacttgaggtcaggttaccaccaattgaaaatcagatctgaagatattccgaagaccgctttctcaacgcgttatggtctatacgagttcacagtaatgtccttcggactcaccaatgctccagcgttcttcatgaacttaatgaacaaaatcttcatggaatacctggaccagtttgtcgtggtgttcatcgatgacatcctgatatactccaagaacgaggaagaacatgctgaacacctgaggctgataatggaaaagctcagagatcatcaactattcgctaaattctagaaatgcgaattctggttggaccgagtagcatttcttggacacgtgatttcctccaacggtgtcgaagtagatcccagcaaggttgaagctgtacttgcttggaacccgcccaagaacgtgtcagagatccgcagcttccttggcttagcgggatattatcgaagattcattgaaggattctctaagctagccagacctatgaccgagctgttaaagaaagaaaagaaatttcaatggtctgcagcctgtgaagacagctttcaagaaatgaagaaaaggttgaccactgcaccagttctcaccttgccagatatccgaaaagatttcgagatcttctgtgacgcatcaagacaaggcttaggatgtgtcctaatgcaagaacgaaaggttgtggcctacgcatccaggcagctcaggcctcatgaagtcaattatcccacccatgatctcgagttggcagccatggttcatgctcttaagatctggaggcattatttaatcgggaacagatgtgaagtatacaccgatcacaaaagtcttaagtatatcttcacacagaccgagttaaatatgagacagagaagatggttggaactaatcaaggattaccatctgggaattcattatcatcccggtaaagctaacgtggtcgctgatgcgttaagtcgcaaggcctattgcaatgtagcccaaacacggcctaaccaagatcacctgtgcagagaattggagaagttaaggctgaccgtggtacagtcaggtgtccctgccagcttgacagtacagcctaccctagaatcacaaatccgggaggcccagaaagatgacgaagggataaaagagttaataaaaagaatacgggagaagaaagacaccaatttctccatagacgaacaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagacgtcgcagaatacgtagccttgtgtgacatttgccaaagagtcaaggcagagcaccagaggccagctggtctgctacaacccctaccaattcccgagtggaaatgggaagagatcggaatggatttcatcaccggtttgccaagaaccccctgcgggtatgactccatttgggtaatcgtggaccgactcacgaaatcagctcatttcgtgccagtgaaaaccacctatgatggaaagaaactggcagaactctacatgactcatgtcgtatgtagatttggctgtcccaagaaaattgtgtcggaccgaggcactcagttcacctcaaggttctggaagcagttgcatgaaactctcggaactgatctaaattttagtacggcctaccatccacagaccgatggtcagacagaaagggtaaaccaaatcctagaagacatgctgcgtgcgtgtgccttggatttcgaaggcacttgggatcgttgtttgccgtatgctgagttctcatacaacaacagttaccaggctagtattcagatgtcgccaaatgaggcaatgttcggaagaaagtgccgcacccccttgtgctggaatgaggtgggcgaagccctggtattcggtcctgacatactcaagtcagcagaagaacaagttaagctgatccgagaacgcttgaagacagcgcagaaccgtcagaaaaattacgctgacaatcggagacgtgaccttgagttcaaaaaaggagatcatgtgtacctgcgggtgtcacccctccgaggtatgagaaggtttgggatgtccggcaagttagcaccccgctacatcggcccctacctcatagccgccagacgtggcgaagtggcttatcagcttgagctacctgaaggtctcgcagatgtgcacaacgtgttccacgtatcccagttaaagaaatgtcttcgagttccagaagagcaagttcccctgggtagtatcgagctggaaaagaatctgacctacaaggaaagaccgatcaaggttcttgaagaggcagaacgtcagactcgaaggaagaccatcaagttctacaaagtccaatggagcaatcattctgaagatgaggcaaccaggg

SEQ ID NO: 49511 - DNA, 753 bp, Oryza sativa
aactaaacacgaggctgcgtcgaggagatcaagattgatccttcgacgacaaaccatgacgacgacatgacgccaagagatcaatctctccagggcagacgaacaatgacaatgagagaaaaatcgatgaccaagaaaaaagacgctggccgcccccgggagatcgctactcccggggtagcggcggcggaagcttttgagcggagctagatcgtctgctctgataccatattgaatagtgcagggagagagatactacgaattttaaacatgttgtattgagcctcggggaccaatatatataggagtatatgaggaggaggtaagaaaggattgcagatatgaaagaagtccacataattcaatcatatcctaatataactttaactaccatatactctaacacggtcatggggggagagagagagagctcgagaggctcggcttgtgtggagaaaaggggagggctcgtcggctatttataggcggtgagaagcggtggatcaagtcggttgcggaggaggagagcaaggggtacacgacgacggtggcgtggaggagatggggtcagcaccggcttcgttctcccattggatgacaatagcggcgcgcgtacgtggcggctgcagtatggttgggcggcggaggaggaggagcacagcacagcgacggcagctcggtgaaaccgcggcagtggcggcgcccatggcatgtggtggcggtgacccgctcccatgcgccatgcgcgcccac

SEQ ID NO: 49512 - DNA, 12050 bp, Oryza sativa
atttcaaaagatcttctaatttatttgactgcaatatttttggaggtggaatataatggaatttatttgatgcactcaaaatgggagagagggatatatattagcatgaatagtatgattcctaaaattgaatatattattgggaatgtgggaggaaaataaataggattttagccccaaaatatatggcatggattttagagaattatttgaggataataggaaatttggattttggatgagaaggataaaatctattttcttagcacaagagcaattattctaagaatattattcttgtgccaaggttggagtaaagccatagaaattaaattggagactagatagaaatttgaccattggaatagatatagaaggatttataaaatatttggatagaggagaattagagataggtctagatcaaaggttttggtcaaggattaattccaatgaaattggaattatggtggtttaggttcaagggcaatattggaggttttcttggaccataatttataaaaggttttcaaataatttgaataaaagatttttagtcgaaagaaagtttaatattcaaaaatagaattcaatcaagaaatacctcaatttaacaaaatatatttttaaatgaaaaccacaaaagaaattaaataccaaagagggattttatgcaagttagttttaggaagttacctctaattgtatttcctaggttttggaggttattaaaaacataagaatcggcatgacgcaggattagaaaatagttaattttcagatgttacacacgcgcacacgtctctcctactaaattacattacatgtgttgtctctcctactaaattacattacatgtgttttatatgtatgttcattagattatacttaatcaacttacatacataattttcggacttacattgtaaatacatatgtaatttacggacttacactgtattaaatacatgttgactattttttcacgaaaaatatgacggcatatatatgggtggtctctgtttgtttacgggtagtacatatatatgtacattcttctcgatccatatgcattgaatccatttatcagagattagaatgaaggattttaatagatttaatctaatggtcaaaaataacggatccaccaattaagtgaaaatttgttttgcttttttttctcaaaacttgtaggagattttaatagatttaatataatggtccaaaataaagggttcaccaatttaagtgaaaatcaatggttatatgtttgctttttttcttaaaatttgtagaatttgttttaatttattagaatgtcatgtgatggtttgatagcatttgtataaagtttgacggaattttagtatatataatagatatagatagatgtaataatagcccgtgcaaacatgtggtttggcactagtagtattaattcacgtttattgcatatagttccatgcatatagtttctttttcacaagtactcatatatacatgacagcactttctcctgatgtgcacgaatctcggcgcatatcgatccaatggccatgcacataagagtacatgaccttaaggactgattttacttttccaactctatttcactactagaaaacttattttcgacgtcgtaagggttaaattttcgcaggcgggtgtagacccccgtttttataacaggaatcaatcgtgtaaacggtaccatttccctggatcaagtagtttggtacacacgaattcatagctggaatatatagtgcacatacacgagtgtttaatacgaattattacatcataggcccgcccgcaggcatagtcttaaatcatcggaccgagaggtccggaatacatccaaaaacagaaatagataaggcagcggaattcaggcagcggcatgccattgccacaggcaacgactgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttcacaagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcctctcaggaagtggctccaacagcataaaattcatcatgcaatatcccctcccacacaagttaagaatttagagtctagccaagtgtaacacatgtcccggtgctcaatcaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatacactctaggcgtacacggtttctagcagtgagaggagttctggcgcacccgggaaggaaagactcacacatgcattaagttataattatgtttaaattctcacatggtagtcctactgatggcgacaccactgtagacacccgcctcgcggttctaccaatggctgccccaccgtagagcccctaccttacacatcaagaaaccactatgcatggatactgcctccgctcagctatctattccgctaggtctatacccatacgagaaatgcggttgtacgggggtcgtttcatgcttaacttcatggctcggtccttaattgaccagggacggcactagccttttccggacaccacccaagtcctccagccgccccagtcgaaaacagttgttttactttatttttctttcacaaatcatgtcatcaacatcatggcaatgtggcgctcatgtctccacatgccgcatctcaattaccttctcaaaggtaattgccccaagcatatagcatttgataaatatgagtatgcatgattcaagaatagcatttctaagcaattgtcatagttgactagggactcatacgtaaatatggttacaaagatttaaggattaacaataatcaaggcatggcataatcacaaataggatgttcatcattgcatgcaattttatttgtaaacaaaacaatttcgcaattaggatcaacatgttcaaggaatagtgatgacttgccttgctcgaggtcttgcgggtcttggccttcacctggatccgcggcttcctcgatctctatagttacgtgcgaaaattgatctgaattcggttagaattcaaataaaaatccaagtaaatccaaatggaagtcgaacgcgaaagtcgattcctttttattaattttactatccgcgaactatggcaaaccccaattttggtttaaattattttgcggttacaatattttgttgtcgtatgtttttaatttaatctaccctagcattatatccatatatattaggttagaaatttcttatcgcgagctaaatgtcggacggaatcctaaaattatcttataatattatacgacttaatttagtctatgattaaatataatacacggctaacaccctagtaattaaatccgaatcgctaccgttgatcgattatttatagagattacccagaaataatccacaataatttatgagaattcatacatttgtttaattattaattacatctaaattaataccgcgaattgatttcttatggagggtactaaaagttatctataatctataggaatttatccaattatattttccttaatcctacatttaaatgctagtattttaggtatttaattagtaagagtttatctaaccatattttcattaatcctacaattaaattctaatatttgtaaatattttaaatttccccctaaatttttcctttttctttttctctttttctctcttttccttttcttttctttctcttctttttctctcttcctctctttctttttcttttgtccttctctctccctcccggtttctctcgtccttccttctcttttccctccctcggttctccctctctctctcggctctccctcctacccgagcggcgcggcgacaaaagaaagaggggggggggggggaacagcggctcaccgacggcggcggcggcgacgacggtggcggcgacgacggcgcacggcggcacgagaacggcggcgcgggggcacgggaacggtggcgcggcggcacaggaacggcggcgcggcggcactacggcggcggcgcggcgaaaagggaggagatggaggggaatgggtgtgggggagaagagatgggttgggggttttatagggtgtgagagggggagaaagagggggcggtgaggggatgcgatggcggcgctgcagcgcgcggagcgcgaggcggcgggcacgcggcgcgaggcgacgagacggcgcgcggcgccgcagcggcgacgggacgcgtgcgacgacggggcgcggcgatgggacagcggcgcggcgcggtagcagcggtggtacgggctcgggcgggacgcgacgggtggcgacgcgacgggtggcgacgagcgggcgagcggcgacggtgactacgcgacagcggcgacgcgacgggcgggcagcggcggcgcgcggcgcgaggtgcgggtgcgggcgcggcagtggtgcgcggcgtgaggcggcgatgggacgcgcgcggcgacgggacgcgcgcggcgatgggacggcgcggcgcgacggcgatggcgacggcggtgtagggctcgtggcggcgacggcaacggcacgggcgacggcgacggcgacggctcggcagtggcgacgtgacggtgcgcggcgcgatgggacagcgacgcggtggcgacgggcgacgcgacggcgacggctcacagcagcggcgcggggcgcgaggcggcaggctcgcgtcgcggcgatggaacgggcgagcggcgcgcgggcgcgaggcgcgaggcgacgcgacgtcggtgcggcgcggcagcggcgatggtgacggcggtgcgacggcacggggctcggggcggccgggcgcgcggcgcgcggggcagaggagggggctgggctaggggagaggtgggagagaaggggaaaatgctagggaccacatcgaacaccttgcgggcaatcaatagtgcactttcctaatattcccgattttaggttattttcaaaataaatttgatttcataatttctaaatcttgtttaaatgaagtacatcccacatttgtgttatcctaactaaaatcctccttaatttaatatcactcatattctgtttatataatttattttaattagggttattccatcgtactaaaatttaattattgctaatatggttgcgatatttatttccaaacccacctaacctttattttaatttatattttaattatttatttagtcaactagatttattttatggtttgttcctagctagttattcattattcgcgattaatagactccgacatcaaaatccaatgaaacaggcgaataaagtcggcatgatgcaattggtttaaaaagtttttgaaagtccgcatttttagagttttgatttcgttggtcgaattttcagggtgttacaaacctaccccccttaaataaatctcgtcccgagattttcttaccagttgccgaatagatgcgggtactccgtcctcaagaattcttcgccttcccaggtggcttcgtcctcagtgtgattactccattgtaccttgtacatacgccacactttgctcctagtcctctaatctgcttcatccaatatccggatcgggtgttctggatatgtgagatcattgctaatgtgaatctcttccagcggagcttgttcttccggcactcgtaagcatttctttaattgggacacatggaagactgggtgcacatcggcgatatattctggtagctgtaactgatatgcgacttctcctcgcctggcaatgatctggaatggccccacatatcttggtgccagttttcctttaaccttaaacctttttgttcctctcatcggagaaacctttagataaacgtaatctccttccttaaattccaggtttcttcttcgagtgtcggcgtaactcttttgtcgtgattgtgctacttttagacgatcacggatcaagcgaaccttttcttctgcttcttgaataatgtcaggcccaaataccgcccgttctccagtctcggaccacattagcggggttcgacatcatcgaccaaacaatgcctcgttgggtgatatctttaggcttgcttgaaagctgttgttgtaggagaattcggcgtagggcaaacatctctcccagtccttgctaaaatccagagcacaagccctcagcatgtcctccaggacctggttggttctctccgtctggccatctgtctgtggatgataagcggtgctaaatgcgaggtaacttcccagggcttcatggactttctcccagaaatgtgaggtaaattgtgtgcctcgatcagatataatcttcttaggtataccatgaagacacactatcctggtcatgtacaactcggcgagttttgcactgctatagtttgtcttgacggggatgaatcttgccgtcttgttgagtcgatccacgatcacccaaatggaatcatatcctgttgcggttttgggcaatccaacaataaaatccatgcctatctcatcccatttccattcgggaatcctgagaggttgcaacaaacctgccggcctctggtgttcagccttcaccttttggcatacgtcgcaaagtgctacgtattcggccacatctctcttcatgttgggccaccagtagccctccttcaaatcctggtacattttggtacttccggggtgtaatgagtatgccgactcgtgagcttcctttaaaattaatcccctcagtccaccctgttcgggtacgtaaattctctttttataccatagaacgtcttttccgtcggttgaaaattcttttgcacgtcctgcagctaagcgttccttcacctctcggacctcctcgttgtccttctgggcttcttctatttgggttctcaaaagaggttgaatgtccagggtgtttatccgtccatgaggcactatatgtaggttcagctgagctatttcctccctaagctcagggaccatcccttccattctcagatgattgtaatggctcttacgactcagagcgtcggccacaacgtttgctttgcctgggtgatagtgaacctctaaatcatagtccttgattaattctaaccatcgtctttgcctcaagttgagatctgactgggtgaagatatactttagactcttgtggtcagtgtagatatcgcaatggtttccaattaggtaatgtctccaaatctttagcgcatgaaccacagctgcgagttctaggtcatgggtagggtagttttcctcatgtggtcgtaattgtcgcgacgcataggccacaacttttccgtcctgcatcagtactcctcctagtccttgccttgacgcatcacaatatataacaaagtctttcctgatgtcgggaagaactaaaataggtgccgaggtcagcttttctttaagctgttcaaagctttcctgacattgttctgaccatacaaacttcttttccttcttgagtagttgtgtcatcggtcgggctatcttagagaacccttcaatgaaccttcggtagtatccagccaagcctagaaaactccgaatttcagtcacagatttgggtgctttccattccgtgacagcctccactttagcagggtccactgctactccaccggctgagattacgtgacccagaaaagcgacttccttcaaccaaaattcgcacttgctgaattttttgtataacttgtgctttcggagtttctggagaaccaatcttaagtgttccgcatgttcttcttcatctttggagtagatcagaatgtcatcgatgaataccaccacaaacttatccaagtaatccatgaatactttgttcataagattcatgaagtatgccggggcattggttagaccaaacgacattactgtgaattcatacaacccatagcgtgttgaaaacgcggttttggggatatcctcggtcctaatcttcagttggtggtatcctgatcgaaggtctatcgttgaaaacaccttagctcccttaagttggtcgaagaggtcatcaatccgtggtagtggatacttgtttttgatagttacttcgttcagtgatcggtagtctacacatattctcatgctaccgtctttctttttaacaaacaacactggggctccccaaggtgacgaactggggcgtacaaatcccttctcttgcaactccctgatttgctttttaagttcttctaactcattgaccggcatccgatatggtctcttggatatgggggtagttccgggtatcaggtcgataatgaactctatgtcacgatctggtggcatcccaggtaaatcttctgggaacacatcaggaaatcgctgcactacgggcattccctttaggggtagcatggtaaatatacctccggcacgttcggttagcctaggatcttgatccatggttgctcgcatatccgatccccagggtgtggtcagggtaacttctctacgtctacagtcaattactcctgtatgctttgctaaccaatccatacccaaaatgacatcaagagtttggggtattagcaccataagattggagggaaataccacatccctaaggagaattggtacgtctatgcaagcatgactcacagttatctcgcccccaggtgagtgtactatcataggctttctaagtcccacgagggtcaagttgtgcttttgactagccttcagagatataaatgaatgcgatgcaccagaatcgaagagaactttaaccggggtggaattgatagagaacatacccattagtacgccctgatcttcctgggcctcttcagctcggacatggttcacttgtccgcgcccaaatccagtggtggtcctgttcgattgcggagtcttgaataggcctcgcccgacagtaggggtagtagtgccgcgaacagtcattgcattcgcgccagttcggacaggggttttgcgtggatgagggcagttgttagcgtagtgcccgtattccccacagttgaagcagtccacattcttcttggctccaggggcagccaaagttggtgtaggggtgcggttctgaagtgcaactggcctgttgaagttgctaggtgcagcgggacggttggtcaccacgacagggggcttccatccggacggagtggctcccttgagtcgctgaggcactgtctgaggtgggcgactcatagcaagcctcctcttgcggttgtgttccccgtcctttgatcgttctctagcctgacgaccttgttgatcaggctctggaaactctcgtgatcctgcccgatcataggtccacgcaattcatcattcagcccttctatgaacttgtcgatcttttcttcttcatctgccaggtctccaattgcgtagcgggccaactgagtgaacttgttcagatactcctgcactgttgtattcccttgccgcagtcttctaaactcgttcttcttcatgcgcatcactgcagcaggtacgaagttctcgcgaaatgctgcagtgaactcctcccaggtgggttctccagcaccgtcttctcgggcttccttgtaggtatcccaccagtctccggctggtccttccaattggtttgccgcaaagatcactttatcggcctcacgtactcgaacaagagttagctttttctcaatgaccctcaaacaatcttcagcatccataggttcttcagctgtggcgaatgtgggtggcttggtcctcatgaactctccaaagcttgaccctccgcggttgccttagttgttcgcgatagcttgcagaagttgagtttgggtggccataactccggccagagtggttaggtcaggtgtctgagtttcgtcgttgctggttgttgcccgacgacggcttgccatctgtgtagggtgatggggtaagtatcctaattttctaactagctcctatggctttatcctattaagggagttgtgttgatatgaactttgttttgcaagcatggtggaataaactcatttataacacaacaacaatggataccataaataacatcacagagtttcacaaatgatacatgaatcatgatgcaatcgactgcatacatacgcagtccaaataaagttcatccagaagatacaacgaactaatcatcaaactactcgacaatctaggtaagggagggggtgtctcgcatactatccaaaaaccatctgatacgagagcgaagctgcaaggagtccgtcagtctagtcctccagccatccgcaagatcctggggcaggtagagggtggtcgctggcacgcgcaaacctgagtccccacggctcagaagtagtggcctctggatctggcttgggcctcttgcccggaggtcgtgtgctcttgcgagcagtgctgagggtgcgagggcctccaaggaaggtgatgcggggaacaggagcctcatcctctgaaggatcagtgatgtctggctcgatctccggctcggtgtcggtctcctctgtctccgagtcgatctggatcggagtctccaaaccggaacccagctgcggggaaggtgtagggaccagtggagtgtgcaccaactccggaacaggtggctgtgctgctgtagggtccactaggtagggtgctgactcggtagctagcatactagcctctcccaggagagcgtggaacgctggtgggtacggcggggtgaggaagaagtagcggtcacggcctgctgctgtggaagtagaagcccctgtagtgctgatcttggctgctcgaagctgctcctccaactggctgacgtgctcctgactctctctcagctgctcctcaagagtatccatcatcccgcggcgatcgttgtactggtcagacaactgctggtactggtcgccgtggacctggagctgtgccttcagtgagtctatctcactgccccaagcctggtgctcctcctccaactgaagctgctgcgctgtgaggtcggtcacctcagtctctaactctcccatacgtctctggtggtcgtcaatctccaacagagcctcctcgtagtagtcatctactgcctcagcccatcgtgacaaccgagtcactatcgggttgtagcagcagggcgtgttctgaactgtgcaaactgagttgccctcctcccggaacgggtggtgagcaaactcggtactcactaactcggctcggtggatagagctgagtcggaggaaggcctcccgggcggcatcctgcatcgcggtctctggcaggtctcggtggtgacgtgtctgaaagctgtagtccaactcggaagggactcgggggtgaatctcgacccgagcctcccaaactgggccacactgcctcactcggtatgacggaaaaccagggtatcgcagacgcctcaacatctggtgcagcacaatgacatacccctccgattggggtaagctcaactcccaggtagcgggtgaatccgaatctgccatctaattttaagaaaaacccaaagtcagttgagagtaaaacttgttttgtaaagaaaatagttaagagtaagatgaaaattgtgccgagttttgtaaacatagcgtttttatttttgaaagtattactagatgggaatttctcccttggccaacttagaaaaagggtggggcgccttttggtcttttcctacagtcgtatggctctgataccagctctgtagacccccgtttttataacaggaatcaatcgtgtaaacggtaccatttccctggatcaag

SEQ ID NO: 49513 - DNA, 1588 bp, Oryza sativa
gcgcggtagcagcggtggtacgggctcgggcgggacgcgacgggtggcgacgcgacgggtggcgacgagcgggcgagcggcgacggtgactgcgcgacagcggcgacgcgacgggcgggcagcggcggcgcgcggcgcgaggtgcgggtgcgggcgcggcagtggtgcgcggcgcgaggcggcgatgggacgcgcgcggcgacggctcacagcagcggcgcggggcgcgaggcggcaggctcgcgtcgcggcgatagaacgggcgagcggcgcgcgggcgcgaggcgcgaggcgacgcgacgtcggtgcggcgcggcagcggcgatggtgacggcggtgcgacggcacggggctcggggcggccgggcgcgcggcgcgcggggcagaggagggggctgggctaggggagaggtaggagagaaggggaaaatgctagggaccacatcgaacaccttgcgggcaatcaatagtgcactttcctaatattcccgattttaggttattttcaaaataaatttgatttcataatttctaaatcttgtataaatgaagtacatcccacatttgtgttatcctaactaaaatcctccttaatttaatatcactcatattctgtttatataatttattttaattagggttattccatcgtactaaaatttaattattgctaatatggttgcgatatttatttccaaacccacctaacctttattttaatttatattttaattatttatttagtcaactagatttattttatggtttgttcctagctagttattcattattcgcgattaatagactccgacatcaaaatccaatgaaacaggcgaataaagtcggcatgatgcaattggtttaaaaagtttttgaaagtccgcatttttagagttttgatttcgttggtcgaattttcagggtgttacagcgggtatggtcttcgaagccaaaatcccaccggcgaagacgatacccagggtggagggggcggtccgcctgcgaagatcaatctttgcaggcggaccatataagcgacgcttgcgaagatctatcttcgcaggcggcaggcgacgtgcgcctgcgaagatcgattttcgcagccgccgcttatatggcccgcttgcaaagatgcccctatatagtcttcttcctcctcgaggagccctgttcattctccccaaagtttctctctcctaaagtgacttaaatatgggggggaggttttgaacttttagacctcaatttgtgatggatttatgcatgcaaaattgtgaaggaaaaggtccatgttttttaatttactttcttttgatatgttgatgttagatgtatgtgtaatacttgatgtctcttgttgtagtggtttaatgtggtaacataaattctcattttttttattttgctatcacatccacctcctagttctagatatagatctagatcttgtctagggctgggcaaaaaaacaccgaaaaccaaaaaccgatccgaaccgcattgaaccgaactgaatttttcggtttttcggtaattcggttcggtttcggttcaaagattagcataaaccgcataattcggatcggct

SEQ ID NO: 49514 - DNA, 24776 bp, Oryza sativa
cctctctctcacgcatcccctccgccctctcccctcgccggcatcgccgccctctctcacgcatcccacgccgccgccgcgccctctcccctcgccgccctctctcacgcatcccctcgccgccgccgcgccctctcccctcgccgccctctctctcacagtctcacgcatcccatgccgtcgccgccgacaccccgccatctcgcgcgacgccgccgacaccccccctatcctcactgcgccgtcctccctctgtcccccatcctcgccggctcgccgcgtcgtcctccctctgtcccccatcctatgcgctgcctctggtgttgcctatacgacggcagcaacaaccgaggagtcctccaatgtaagctgcctctgctgttgcctgctgctggctcaattttggattgtaatttgtaaatattttttttagatggaggacactgaagagatagtggagagggaagttgctgcatggttagaggagcacaaggatgaagaggagcaggagcaagcagccacggagaatgaacatgcagccgcggaggaagaggaaaagaagagaaaggctattgttccaagatctgatgtatggggcagcttcagcaaggtaaaaatttccaatggagaggagagagctaagtgtaaatactgtcaaaagttgtttcgttgtgaccctaggacaaatggtacatcatctttgaaaaatcacttgaaaatctgcaaaaagaatcctaacaagccagtaattgataaccaacgcactttgcaaattactcctggaagtggtggtagtagtgttggtacttgttccacatggaaatttgatattgaagacttgaggaatagttttgctgaaatgataattgaagatgaacaaccttttgtcttaagtgaacgtccaggtcttaggaagtttttggctaaagcatgtccacggtttactttgccatctagaagaactaccactagagcatgtgtcaaagtgtatgatgtgcaaagattgaagcttaagaaatttttgaagaaaattgtgagagggttagcctcacaacagacacatggactgctaacaccaaccaaaactacatgtgtgtcactgcacattttattgacaatgattggaagctccataaaaaaatcataggcttcttcctagtaaaggggcatagaggggaggatattgggaaatctttagacaattgcttatctgagtggagaattgatatagttttgtcaataacggttgacaatgctagtgctaacaataatgcaattaaatacatgaagagggtattgaatgaatcaaaaggatgcattgctgaaggggagttccttcatatgagatgtgttgcacatattatcaacttgatagtggctgatggtttaaaagaaatcaataaatccatttgccgtgttcgtgctgctattaagtttgtcaaggccggaccagctaggttggcaaaatttaagaaatgtgctgagttggcaaaagtacaaaccaaagcatttttgacactagatgtttgcactatgtggaactcaacctaccatatgcttaatattgcccagcaatatgagaaggcatttgaaaggtacagtgatgaagacccatattacaagctagatttagaaggtcatgatgggccaggagttcctgaaaaatcagattgggataaagctaggaagatggctgaatttcttgaacatttctatgaactgactcttcgtgtttcagcaacaagtcgtccaacatctcacacattcttccatgaaattgctggtgtagttgttttgctgagacagtggtgcaacagtgaggatttgttgtgtgcagagatgggtaagagaatgctactgaagtaccaaaaatattggggagagatagggccgggggttcaaaatctgaatttaattgttttcttctgtgtagcattggatccaaggtataaacttaatagttacattaagatggcaactatggtcatgtttggtgatgaaataggagagcaattgtggacaacagtggtcaattcctttcattccctatttcatgaatacaaagaaatatatactcctaatgagccggtagcagcacctaatgatattcagggatcactatcaacaagcaagaggctcatgaggtctatagttgcacaacaaatgagcaacaatggagcttcaaggagcattgccaaatctgaactagacaagtacttttcagaagacaatgaggaggatacaaaaggatttgacatccttaagtattggaaggacaactcaactaggcttccattgctatctcgtatggcccgtgatctcctagcaatccccatctcatccgtcgcttctgagtcagcctttagtgcaggtggaagaacactagatgactttaggagctcactaacaccaacaatggttgagcgcctaatttgtgcaaatgactggcttcgtggttgcaactctattagtgttgaagaaaatgccaaagatttgtccaagcttgaagaaggtgaaacattttaagatgcaattagtttacttcttatgttagtttattatttatattaactgtgtttcttcttatgcatagaacttgttggccaagacattacagaggacactaatgctaccaaggcctaaaattgttagtttatttcttagttgaaagaagcagcagtatgcaaggtatatataattctcctcctaaccaaatgattgagtatatatactagcagctgagtatttcttcttctccactccaggcagcagcaaagcaagcagcacacatggcatggcagccagcactattgggtgaagcaaggagccctaagcagcatgcagccggcaccatttttgtgaatgtttatggctatggatgtgtggtgaatgttcgtttgtatggtaaattgcagcatcaggactatgtagtatgtactatgtttttactttgtttgtttctatgtactatggtaaaatattgttctggtcttctggatgtgttttttactgagctgtgtagagatcggttttgttggtaaaaaccgaaaaccgaaccaaaaaaaccgaacccgaatttagcggtttccagtatttacgaaaaccaattggttcttgttctttcgaaaaccgaactccatgtaaccgagccgaaccgaaccgaatcctcggtttaaaccgaatgcccagcccttcttgtcatatatatatatatgagagagaataaaattttcaatgtctatttatttggtgcaatcaaaaaataattatattagtttgtaatatgtcgatgataagattttgttagcttttcctaatatattaatttggcatgtctgtgtaaaaaaaataaaataaactttttttattaatttacaattaaccttcagttagttttgaatagcgatatgtttttttcaataaaccctgcaaatttggtattaatagtgcaaatattttatgttcattttttttagagatatggaaagtcgggaatggatgtatcattggccgaggtttttgtctccatatcgagacatctactcagaagaccgtgaagccttacatgcgcacggacagtgtgggcaaaaatgttaaagggtaatgattgttgagtggcatgtaagcatctacgaaattattagttatgtaatggtgatatgtaaggggatatgtgtgctcatattgcaaattgatgaacaattgtactcaatattttgcatattagtttgtactaatttttatgtgcaattaccatttgtagggtaaaatttacagttttttatattttaatagtttttttaaaagaggtttcaaaatttagtagcaattttttatgtgcacttaccattgtttgaaaattttttaaaaaatttaaagtagtcatattaatgtttcaaacatttaagtaagatttacatttgaaaagtaataatattaaggtttgtatatttgtatgtacaattatcatttttattacaactactgtagacattttcaaattacaaaaataaattaaaaaatattttgaaataaatatattcacctctgtaacaatcttcgcaggcagaccgtccgcctacgaagataataaaaacgatcttcgcaggcggacggcccgcctacgaagatcatctttgcaggcggatcgcccgcctgcgaagatcgtttccctatataagggcccacccacggcgccaaaatttctaagtccaggcgggaaccctagaaattttggcgccgtcaggccgccaaattttttcgccgccacacgcctccgccgtcatccggcctcgcccgcctgcgaccatcgccctccgaccgtcgtcctccgccgctgccgaccgtcgtcctccgcgcgccgccaaccttcgagctcgcgccggccgctccaccgcgccaaaatcgatccagctacaccatcggccgctccaccgccgccagccgcatcgccgccgcgttatgcaggcactgaaggtgatcgataaaatgcttgctcgatggaacgacggcacggaggtcacaactaggagttcagcggttgtggaggggcaatgacgttggatttgccagtgcagaaggccccaggttagtgcctgctcccacatggtttgtaaattgtaattcggattccaggcaatccattgagttgtgcaacggcatttcactcttccatttgcaattgacattgttatctagattttttagcttttcgtaaaactcatccagctcgcttgagttgtgctgctaggcaagcttcctgaatcttaagagaattttgcgcatgtattgaacttccaggtaatttgaaaatctccactgtgccaaaaatgcagcacctaccttggttcatcttcatttctctcaccaatgttgcagttcagcatgcatagacacaatgcaggtccctattcagctcaaattgacattctggacattggacctccttgcctcgcgctgcaacatcaccaccgttatcgctacgtacagactgctgcattctcctttctgttggattggagctggagggggaacattgatttgttctttcaaaattcagtaaataggcatttgtacgtgtggcatctgatggttatatgctatggtcatttttcattaaacgttgactcaactttgtggtatgttttcagtttcatttagccattaaactctggagggtgctctagcgacaagtgacgaattcaagaatctttgggagtggaacactgctatgccataatgtaactagatggtatatttgaagtcacaatataaaaaaatattataatatatatattttggtaacacttttgagttatgcaatatatgtaaatttcttagtaccaaatgtttgataatcttccaatatatgtacataataatctacctgcaagaatttctattaacgggtaaattattattaaatttacgggcaaattattattaaatttcaaaaatttctacctatcttcacaggcggatttttttttttgcaggtggcagcttcatattttcgcaggcggaccggactagccaacgtccacctgcgaaaattatcttcgtaggcggacggccgccccgcctgcgaagatcggcgatcttcacagtcgttttcttacaggcggacggccgccccgcccgcgaagaccgttttcggccgcttgcgataatgcttttcctagtagtgtttctatatgtataacaactcacataaatggaggcattattataccttccagaggactcttcataagaaaaggcaatcgtataacgaagaggagcatcttggcttgtgtgaggaactctccaccagtggtgagatgcttgacatggaaggtagctccacaattaagtgccatgtagcatagaatctccgtccacaccgcagcaatcagctcccatcgatctcttgcttctgggatattgagcaactccacacagaccttgcgagctgtggtaagtgcaggtctactccgatgacgtacgatcatatccggagagttatattgcctatcaccatcacggagttcctggatgaagccatcttcgtgaagctcatcgagaaaatcaagcatttgcgaagatgcctgcacctccattcggcttctagcaatcacgatgtgtccattgctatcaaccatcatcccatgcttagccacaaggtacatgatgtaactggacaagtccttgctagggtttgtgagctcgccagggccatcgccgggcagcaagcatatggtcgtaaccaagtgccaagcaacaacggtggacacgaaatccagctcttggatcttgctagccgaaagtgccctgtgagctgggcctagagcagcaggatcactgtctccgccgttgactctgttggccacccacagagcccactggccttggaacctactgaagtcccagcggttgttgtctacatcggtcgctatttcaagcactttgttcagaagcagcttctttacctcaagagagacaacgacgtgtggttgtggtgtctcgctgtcgcatggtgccaggatccagcggattagcttccctacggcgccactagctgctgtctgtcgtcgtctctccctctcctggacgcatgcatcaaccatgttgtattgtgccagcttccctgaccactcccctacatggagatgaagatgcttgaccacagcgatgcctgcccagcatgatgtggtgagtgcaatgaagatggaggatatctccattgcaatggcgcccacgagcagtatgtaagatatgagaacatcaggtctactatatttgaacttactactagtagtgttaccggccatggccctagcgaacaacacaagagccacagaggttaggccaagagagacaagccattggagcgccgccgccatggttggatttgattttgattttgatattgggaaggtttggaatcgaactgtgccgaatttggtgtacaggtagtcatagatcaaagagacctgcatctcagccagcttgtatgccatcccgtatccattctttgaagacttgatctccaccaacgcattcttgatcctatggtacctcgagtaggaaccgcttacatttgaagggctcacgtccatgaaaaagtccaagcttgcttggaactccatggaggcctccttcaggatgctctcgatacttaccttgtcttgtgaactaatactaaccatgcttctataatgggccatcacaccacgccctgattccggcagcacatcagcaaggctagtaatgaaactagcaatattgctgtaggtgcgagcagcaaggctagcaatggaactacttccgggtgcccgtgcggcggctgacctgagcgcccatattctctcgccgtacttgactgctcccaacacgaacacgagcaccatgggagccaccagcaatctatcccctttccactgcttgcccaccacgtacacggacatcgtcacctgggctgccaggtccagcagccgccgcatccacagcgtgttgtcctccatggagaaggccgtgatcgtctcctgcccacccaagtggagcagcaggaacggcgcccagaacagcgccaactgatgccgcgtgtcaccggctgcggccaacaggaatgacagacggcctaggacataggtcgccacgtagtcggccatcaggtacgccacccatagcgagccattcagcagcctggagccgtggcgcctgcgaaatggtgccgacaggaggaggaacacctgcagggagaagctcgccatcactaggcactggatctcccacttgttccacgcttcttgaacacgagtagccaatgagctgctgagcatgcaatgcataaacccacatattactacctagttagcagtttaattatcattaagtaaataatctagtacctccattctcttataatctagtttaactgaccatttgtagtaatcatcaatttactgcaactttatttagacatttcagacaactgcaacattaatatatactgtacgagattttattagaaagctataactttattgcttgataattggacccactggttagttaattgtatcctaatggttcacttgttttgcgtattttttcgatcttcttaatcctttacttccgtggtggagtagggcgcctcggcttgtaccgggaggtgcccgggctccgtaccacacaacaacacattgctccatggcataaacatcatttactacttaatttgaacctaattaccttgcttcctggttctagtggatgttaattatatgttttgccaacaaacaagcaaagcaaggacaaaatcattacgtttgtaaccatgaggccaaagcaaagagttgcagccctatagtctaactcactgacgataaacagccatcatctcattgataaattatcgctgggcactaattaacttaacttacatatatgataaatagtacaattttctatatatagtttttctcttattaggtttgcccaggctcaaaattattggctccgacactgctttaatcttaaacactctcttagtcttgacatagtttaagtttgaccaaagtcaaaactacttataagcttaaacgaagggagtagtagatagggtaagtctcagatggataacaacgtgaaaatcgttaatgtaggtaatattagcgcggcgtaggtctagatggattacgacgtggagaccgttatgatgtctatactacttccatcattgacttatgggctcttgttgtcagtgactgattttgtagcctgtatgcctcccaaattcaactacctagattcaacatcagtttcttttggaatgcagtaatactataatgacatttttttcaccaccttgaggcaatcaaagtatacacatatgattgaaccactataatcattggcaaggcaaagagcttctaaacttgctgcaacagatctactttgtcaagtgttacgctcagcgacaaaatatatatgttttcttgagaaatatttacccatcttgttcgatattttcatatattttatgaaaatctgttgtaatgcacagacatttcgttagtatatataaatagatttgggcggctagctgctattgtaaataacacttgtttcatcgaataattgtttgaataatgcatattagggaaagacgtacgtgtagtgttagtacctacagtttggtcaaatacgttgtttgaattacctgtattgagcagagccatcttgataatctctcagcggcctcatgtcgatgacacgcctagagcacaagaaaggattgaaatgaatatatgtctatcgatgcatgcagtttgaatactatagtctatatctcggccgttgttaatttatagatgatcgcccatgcgtacgtaaatagccgtacgtgctccctttttttgcctggacacgctgaagcctgctcatatgcttagtgctttgctttgcttcctagctctcagtgcaggagatgccagattcctaacttcaatcaagtctagctttgcttgacgacagaaatatgctctagtactttgcaaagatttaagagagaatccattagtctatattacttagtttatttatttctgttcaacgatttaccattctataccacttagttttttcagtttaacaaattaccattaacattgtccatttctataatatacaaacaaaattatcaatttttctataatatgttattgatctggatttttttaagatactccatacatggttaacaattgatttattctgatagaaacttttaaagatatgattttttttatgtagcatcgtcgcacaacatgaaagtttgtatataagtttcaaatcttttggtatatttattttttaaaaaaacatatttttgtgtggtatatgatatatctagaaattgcttatggaaaaaaaataatggcacaaaaatattttgtgtagcatataaaagatgaattacgttaaaaacatcaacacaaaattattccatgtaacatataacagataaattatattttataagaaaaatagaaatgcaaaagtctcgaaacatgtacacaaaattttacattgtgtaaaaaggctaatgaaatcatgattgttttgaaacacatgataggaaaaatcaattgttaactttgtatgtttacaagggtattttaggtatttttggaaacaaggtttagccaaatgctatattgtaaaataattaataaatttaccggtatattatagaaaagacaatgtcaatggaattgaaaatcattaaactgggacaaactcagtggcatatatagcatagattctctcttggtttaagttctaaacactaaaacttaatttggttcatactttatctatctacttaataatgtgctataccataatcaaatggctgattaattgttagcagcagcagaattttcttcggcaaaaaaaaaaaggtttgcagcagcagaactaaggatgagatttgctgcacttcgtgtacacggacacattgccggatcgagatggccatgccgccgcggcggctgaaaaaagttggtctgaattaagttgggctgtgtttagatctaaaatttggatccaaacttcgatcctttttcatcacattaacctgtcatacacataactttccagtcacatcatctccaattttaaccaaaatttaaactttgaatcaaactaggtctattagaataagttcagcaggcgcgttgacacgagcatgaagatgacagcgatggctggtttgtccaccggtgaaaatcctcgtgtgaagagccagggcgttatcggaatcttcctaactctaactctagagctcaacgttacaatttacaattttttttccattatgttttaatttttaatttcaatagatatttatgtttaatttatgaacatataatgatttaatttattccataaataaatcataacattgcatatttaaactagcataaacgcatcataagatctacatatgtaaacttatcgaatatgcgtaatatgctaaacacgtaccgagggtactggaagaacggttgcccagcaggaagtactcgtggttccgggctttgacggtagcgcgcagcacacgagcgaaaaggaagacgagtcgttgtggtcgaacagggagcagtggtgtaaagcgcttcccaaaaaccttattaccgttttctcctggtgcaggacgtcgaaagcgaaggttccggagaccttttcttccgatcgccgctgcacaccggcgaatgggatagagtagactacgagcgacagcgcggtgcagaggaggaggcaaaccctagattgatttcgcgtgtgttgcgtgtaggcggcggcttaacttatatagagatgttatgacgcttgatcaggacgcctgcacgatctaaccgaactggataagtcgtgcgcaacttatccagactctacgccatttcacgcaccggattattccgagtatttccaaaacaaacaaatctgaatttctcgcagcaaaacaaaacttcgctccgcataaccgaaccggataagtcacgcgtaacttattcggactccacgccgtttcatgcaccagattattcgaaccggataagtcgcgcgtaacttatccggactccacgccgtttcacgagtgaggaaccaattttgggactccacgccgtttcacgcaccgaattatcaaatttgaatttcccgcagcaaaaagaggctggcatgtgcgcaagagtgagaaaccaattttttggcagaacgcgcgccgccatgccaagcgaggcaagcaagcgcgtgttccccctcttctctccaccttacatgcctcaagtggctagtagagcacatcctctcttataaggaggtctccctctcctaaaataggtaagatggtactaaactactcatgcatcatatcccatgaggtggcttttgtgattttgcaaaaaataatctttgaatagagcagactgtagccctaagcccctaactgccctaagctcctaactaccctacttctagcgagagagatggtctagctgcaggaggcggaggagccgtggtggatccttgcctcccacgactacgagcacgagcccttcttgtgtccagcgtttattatttggtttgaaatttttgggaaattaaaaaattttgaacctcccaacatgaaactatttcacctaaatttttaatcttcaattttttatatgaaatttatccaaatcttaaaaatgtgaagttctgaaatattccgaaaattcgatccctttgatatatttgtggatattaaaatagctagtaaaccctaccagccccacaacatgcccggggttgaatcctagttatactagatttggaggcctttttgtcctaccaaattcccttgaattaatcatacaaaccaaacgagccacacaagaattattcctttttggactgaattcatctatcgtccttgttttgttggaggtgcaggcggcaagcagtaggtgcacttgcatccgtcaggcgtacagttgccatcagcgtttgggggaacctggattttacagtaagttttgcacgacgatggaaaacacggccctggattgacgatagatccgcacgacgaatcttgggggttcgtcgatgagggttcttcatctgccattatcaccttcctcgccatatctacaacagaaaataaaaaaatttaacagagcacttgtttagtttcaaactttttcttcaaacttccaacttttccatcacatcaaaacttttctacacacacaaacttctaactttaccatcacatcattccaatttcaaccaaatttctaattttagcgtgaactaaacacacccagaaagaagcctacttctaacacttggttgtttgaaaaacaattaatagggtcctctgtgaaacttcatgttcctttttaagggatggaactatggatgaatgcaaatgctttttgatatgacttgctgtaatcatatctttcgttctaaacaatacatacaaaaaaaaatctaaaatttagaatccataaaaaatccttcaaacttcattcggttcaacggaacaggaaatgggagaaatgctcaggggtcttccggctagctccataaggtggtgggctagacgacctagattcgaagcctcatcctttctaattatttgatattaggtcattccttaatatacatattaggtcattccctaatatttccgttttggagtaggaaatggaaaaaaaaatacatacctgagcactgcaccacaagggcaagggacaacaatagaacaccgaattgtaacttcatcctagctagtttaatgtggaaattctgagagcgattgcaagctaaaatgattgggtgtactctctaggctaatgtcgttggccgaagcgttgatcttttataaatggacattgctgctactcatatgtggaataatgcgatctgtattaaacgaaaaagattacagctcataatggacatcgctgcgaattcattattggagatatggtctgcattaaacgaaaaagattacagataaaattgtaatcaataaggcttagatagcaatatgtcatagtatataatgttttctatatatatatatatggtcagcaggataagcataaatacttagaaattatttacattgtaagaatatacttcctccgtttcatattataggactttcgagtattacccatatttacatagatgttaataaatcttgacacacatgtatcggtacttataatcaaattgaaatagacttattggagggaaagagctcgctgaaaaatactatctcttgcgttgtacaatggccggggctttattgttgacggacgattgagatgctctgatgcaatgccggagccacaggggtggcgagcagaggcctggtctcctccaacaaaattatttttttaagtaccagctaattaattaaccacatgattattatctcaggcatcgacatgattatctcaggcattagtacattaggtcccatcctgtactagtaaatcacgtatgagtatgacagccatgctttggtatttggagtctacgccattttagcctggtgtttgctcagggtgcatgtgtaacagtatgtaaacacaccaaattgtgaaggtttcgactgctccaaactccgacagtagacaggttcactctaattttgtgaaataattataagatcgaacacaggtaacaaagcctaccagagaagggtgaatggtagattacatcagcggaaatcaaataatcgaatatacgtttgatggtctatttgacctactagggtcggttgaccaaaactcggccggtctgcaggtcactcgatcctataataatggttacgaggtagaaattttgctagaacgacagttttgctagccaaattgtaatttctttgtttaccaacttatgtaggccttaatttgttagttttaagccgatcaaataaaatcaacaatatttacgatatagttagtaaccgtaagttaaatttgatcaacaaatgttatgttatttttttaattttcttatgtattcttttgctaggggtaacatgataaacctaaaaattattcaattgataacaatagtcaaaacatataatatactaccgtgtcctaaaatataaaaaaatagtacagaatgggacacatcgtaatattacaaatagagtactttattatcaataggggtttgaagccaaacctttttgtacttaaactattttttttctattacttagcccgttgttctggccccctcatgttataataatggcttcagtactattctaatactccatccattttaaaatataaggcagaaccacccttaacctaaagaccaataaacaattattatcatctcttagtttgaatcaccctaataaatgtaatacatgcatccaatagaattagagatcttgagagtggaggattttaaaaagtaataatttaatgaagaagaagtattaattaattgtatgcatgcatgccttatattatggaacatccaaaatgtagttgtgccttatattatggaatggagggagtataaagttagaggcacgtggtcaccgatatgtgagacccgccctccacgtcgttacatgtgtacattaaaaatcatatactagacattggccctgtttggagacattggccctgtttggagaagtagccgagagttattttgagagctattttttagctcaaggaatagccctccaatgaaatagcccttgagctgtttggatgcaagagctatttaacctttagtacactttcccaatcataactaccccctttactctctttttccactggatctgttgtgcatgtgtcttggtgtggccggttccatggagaagaaaacaaatctagcagcggggagccggtggggggaggcgcgctggtggggggaggaggcggcactggaggtggggcggcggcggcgctggtggggggaggcggtggcgctggtgggggccggcgaggagtggaggaggcggcggcgaggagtgaaggaggtggcggcgaaaatgctacgcgcctgcgcgcgcggtcgtgcggagagagaggatgcgcgaccttttttctgatcccgtgcgactgtgggagagataaaagctgtgggccccacccaaaatagctccaattagcaccccttgggtgggatagtttttttgggtgggctatttccaaatagtcctcaaatagctcacccttttggatcttttggggctatttgggctatttgagagagggctaaaaattatcgcttggattcaaacagggccattgtcatgccagaagtatgcaatgtgacttctctcctatcaattgtaaaataactcatgttctatgtttctaataatattttcctgtttttttttaaaaaaaaccattatctaacttataacaaattaagcgacagataatcaacagcaaagggtaccgtttggatatagctaaacagcatcagatcaacctacacgttcagtttgatcatgtcgatgtgcgttacatcaatctccacgaaagcatgctacagcaattgatttccacataaataagaaaaaaagactcgcttattatattgattcagttcttcacgaagacaaaacacttcttctccttaatagctgggtagcttcctgacggtggtgaggtcgctgtccccgaaggtgatggtgctgacggacaggagaggcaaaccacaagaacggtgcgttacagaagcagttcgcgacgaggtgctcaacactatggatggccatatggactaaggcccgcggcccggcctaagacacaccattttggcccgacccaagtatggtacggcccgactagggtagtgcccatgccggtccggtccgacagccggatcgtgcctagattgtaccctcagcacggtgggccaacccggcacggcaagatcgaacaaaaaaaaaatatagggatgcaaaatagactcagataactgtataaagcaaggcccaaagaagataggaatacggatagacttattctccaaccatttgaacatagcccacagagttgaggaatgaaaaatagactttttctgtggaaaagcacgatgggggatcgtgccttcgagctggcccggcacgacccgagtcgtattgggccgtgcttgcgctgtgtatgccgcccgtgggctggcacggcacggcccggcgtgtcgatcgggccgtgccggcctgactaattacctcggcccaggcacgactgggcttgggccgtgttgtgccgggtagcccagttggccatctatactcaacactactacgcgcgtcgctgttcaaaaaggagaagtatggacccccaccgttttttattttttactccttgtcacttacatgtgggacccattctattttcaaatcctttaaagattgggttgccacgtcagcgtatcagggctaagtcaacctgcaacatcagcaatactgctatcaaaaccatcaaagttaatttgcactagtttttgaacttgagagagccgagagatacgattctacaatggacaagacacgagggaggcaaaatagacttatttccaatttttaccacaaaccgctagaccaccaactcccaacgagagaagtccactttatgccccttaagtatgggtccaattttattggtgtctctcaaccgtaaatccaaacacataacgtcacccagatatcaaaatcagtataaatctaatccctcaatggttttgttctacgtaacgtcaatctcacatgctggatttggtattcccctcccaacccatgtgatgtttacgtgacactaaaagaaaaaaacaaaaatagaaaaaaaaactcaataggacctacatgacagccagatataataataatactccctccatattttaatatatgacgccgttgactttttaacaagcgtttgacattttgtcttattcaaaaaatttatgtaattataatttattttattgtgacttgatttatcatcaaatattctttaagcatggcataagtatttttatatttgtataaaaattttaaataagacgagtggtcaaacgcttgttaaaaaatatggcgtcatacattataatacggagggagtaataaattagtaggtcctcacgtcagtcagcccctctccctctcttcacccgtgtcgctccttcccgtcgtgttctcgactacgttcttgttcgacgagtccagccacacgagtgacaagacattgctcctcgccatgcacatgctaccgatctcccccacggcacgtatgtaagatgacattcacgcatccatggaaaaatgagaacagcccatggtcttccggctagcttcataaggtgattggctagacgatttggctttaaaagctcacccccttctaattatacttaatattagatcattttctaatatttacgtatttttcatccatggtaaaataattcttgcacaaatttgtagatcgtcatgcaagttcttctcatctagatgtgtgtataatttgtctttgggaaacagaaatcgatgccacgaacaaagctgctctgccttggcctcaccgaacggctcacgcatgcagtggcaccaacagctgccgttcaaggacacgtattagggctttggagagaagatacagaaaaatcaaatgttttagagtttattgtgaccatagaggcatttccttttattatggatgatgtgactcaatgcatgctgagtaacagagacggatctatagtgtaagcaggtgtcagctgacacccatgatttcttactaatcactttgctaacacactctagaaacaaggattactgtattgacacaccaccatatttgagtagtgaccctagctactctattttctagatccacccctgccgagtagtcggttctaattatataggaataggcatatatatatatatatatatatatatatatatatatatatatatatattgacggaacgtgtggctcctcaccgggagaccgcgtaggcccccctttgccggttcggccgggggccctgggtgaggttctaagctctcggtctgtggaaagttcgcgagaatgaaaacacacaagacacgggcgatgtatacaggttcgggccgctgagaagcgtaataccctactcctgtgttttggtggatctgtgtatgaagaagctacaaagagctggagagccagagaactctaactctctccctttctggttccgaatcccagtctcggatcgttctccatccctttttcctctctctctaagtgggcaaggtcctccttttatatctcaaggggataccacatgcaccatctctctcttttgtgtggggacttatcctctcttttctccaacttgacttgccttctcttcataaatggacggagatttgtatggttgccgtccgaatgatcttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcgatctccatgttcgcccttcttcatacaatatcttgcttgtaatggttaggatgaagcctggcatatatctgaccgggaccaacgtgccatctccaggaggtaacacgccggctccggctagggacgagtgcttggaggctctcatcctgacgggatggggcgaggcgtgcgtcagaccgcctgtcgccacctaacccacgatctgatcggtctgtgaccagtcacagaccggataaacgagcacgctgcactgcgttacatgcagcgtgacgcgctcgtccaaaccgcaataaatgcggttaggtgagccccgctctgcgctcacctaacccatacacgcggcgcaaaatccacaaggggtcggggcgcctcagtcctcggggccgaaacgggagcggtccgacccctcggggagacaaagagggaggcggccacatcaccctcgggcccgacccccccccccccgagggggtcaggcctcgtgggtgattgctcctgcccaagcctctagtcatgatactcccggtcccatgtcaccgacagtagcccccggcgttatgccagggcgatcgccctcctcgagggaagcggtcgggcgtgacgccacttcctaaggcctggtgacaggtgggaccggtctccacagttgggcagaaacccaacggtcgcaaatcacgcacatcggcaatggtaactcggctgccaataatgagcggtctcttcaagactgccacattactcgagtagcacacgaatcgggacgagccggttcgttttaccttgagatatggtgatggcgcttcggtcggcgagcgtaatcaacgcgcgcacgatatgttccatctcgactgccacagccgcatatccacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattctccttgtcttcaccgcttgcgccctaactccttgtttcctgtgccctaccctcgccacacgcgctcgctctcaaacatctcttcttccggcgtcatggcacggggctccgctctgctcgatggtagcgtgctgccgccttcccgcatcgtgagcgagaggcaggccgggctgccgcgccgcttcatgccggaatctgccaccggccgggagatagtcacgctgggcgagggacgcccggcgccatgctacccggggcggtccgtcttcttcctcccttttgcaatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagtcggtgtcgccgccgtcggtggttggtggctgctacttccagccgcgggggccggtgctgaaccgctacatcccctgcgtcctccgcaagaagtgggatgactggaagagcaactggttctacacccccctcgctgacgaagcgcgcctccgacttccgagccagcccccggcgcaggcctccagctggcggacgccggtagatctgggagatggctatgacgccgtcctcgaccgcctggcgggcctgcgatcccaggggctcataggggccatggtgtacggcgactaccttcgtcgccggattgcgccgctccagcggcgcgcccggggcgcctgggagtacaccgggtccgaagactacatgaggacccaccagagggtcagatgggactgggctcctgaggacttcaagatagtggtccaacgggtgctgaatctcagctccgtggaggcatcactcattccccaaggagtcctccccctctgcagcgatccagaccgcgcctccatcctgaccatcatgcaggcggtcggggcgtcggaggagcgggctcctcgaggccacgatggcgcgggcgggagccgcaggggggaacaatctaccccgggagggggtcgtgcttctgggccccgcgacgggggcccggggagcagccgccctgccgatgcccgggggaagaggaagcaggaaggaacccctcccccatctcctccccgagggggcggggcggcgcgtgccagcagcaggcgcccggagggtgccgtgccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggctgtattcattctctcaacgcgagttttcactcacccattttgtttgtcttctggtctttcttctgtttcagcgagatcccgtcgcgtccctcccgccattccaagtccggccagtctgaggccgaggatccggcgaccgcagaggcccggaggcgggaatctgaccggcgagaagccgcggatcgcctacgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcggatcgccttcgggaagccgaggaagctacccaggtggccgtccgagctcgccaagctgaagaaaccgctcgggaggaggcaagacttcgccaggccgaggcgatgacgacttccgaggcagctcgcgacgaggccgcgggcgcatcgcttgggcccactccctcgtgcgacgctcaggacaaaccaggtccgggggacatccccgagtccggcacgtccatcggcggaccgagccgcgcggcatcctctccgaggcggctcttccccacgtcttccgttgccccactgagcgcagagccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcatgcctcagagctcgaagcccgtcggaaggtgctgggggagattgccaaggaggtggaggaggagcggggggctgccctcatcgccactaccgtgatgaacgagacgcaggacaccctccgccttcaatacgggagctaggaggcggagctggggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgtcgtggagagggacctggcggaccgcgaggccgccgttgccatccgggaggcaacgctggcggcgcacgaggccgcctgcgccgaagaggagtccggactccgcctccgcgaggacgcgctcaccgagcgggagcgagctctcgaggaggccgaggccgcggcgcagcggctggcggacagcctgtccctccgcgaggcagcgcgggaggagcaggcgcgccgtaatctggaaggtgcccgcgccgagagggccgcactgaaccagcgggccgctgagctctaggcgcgggtgaaggagctggacgcgagggcacgcagcggcggggcggccgcgggcgaaagcgacttaaccgcccgcctcgcagctgccgaacacaccatcgcggatctgcagggcgcgccagactcgtccgccagggaggtcgaggccctccgcttggcaggcgaggtagggcccggcatgcttcgggacgccgtgtcccgtttagaccgcgccgggcggcaggcgggtctctggggcgggcggactgcgaagtacgccaccaaccaggggggcctcgcccagcgcctctcggagatggccgggactctccaacggctccccgaggagctcgagaggacgattaagtcatcctcgagggacctcgcccgaggagcggtggagctcgtactggcgagttaccaggccagggaccccgacttctccccatggacggcgctggacgagttcctcccgggaccgaggacggcgcgcgcgcgcaggtccgggacgccgccgaccacatcgtccacagcttcgagggttcggcccctcagctcgcgttctccctcaactccgacgaggaggacgatgacggcggagtgggcgacagtggcgacgaggctggcgatccgggtgcatcggagtgagcccccaggcccccgccaattttaaatagtttcttctttcttcttcgaaggccttcgggcctcctttttgtatagattcacttaatctgcaatcaaaataaagaaatttctgtgtcaattttattttgctatgtgtatgcgatgaggatgatctgtgccgtggtccttttgtgtcttagcttgactaagggctcgtgcccaggtcccagtcctcaaaaggcgcgggtcggggctagtgcctggggagatccacgtgtcgagactggccaggccgggagcgtggtgaccgagggttatgggtgacccgattgtgggtttttgccgattcccccccggagttcaccacgccccggggcatggcttggttctgggccccttttggcgattttagccgacccgagcccccgagggcaagattgagcacgagtgacctatttcaagtcaagattcttcaaaagaaaataacagcacagatacagcctttaggaaattgaaaatgcttttattgaaatacagatataagagaaaaaagaatatgcatatgtggtagcccccggccaaccctgcacgcccgaggggggtgcggggttggcccgagcccgaaacctgacacctgatcccccttaggggtagaagcgacgaaggtgttcgatgttccacgggttaggcagctctgtgccgtcgcccgtggctagccgaacggagcccagccgggggacgccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgaacagcctcgcagtacatggtggcccgaggggacctcagggtgagctcggatgggagaacctgtcgcgtcccaaaacgactctaaaatacatcctcgaaattgtgcatagaataattaaaatccatgtgaaagcttccaacaattaaaatgtgcaaatttaaaagtcaaataaggcttggaggatttttgtatatttcctaaaagcctaaaatgcgtaaataaattttagtggaattttcagagcacaaataataactgagaagaaataaacaaagttaaaaaggttttataaa

SEQ ID NO: 49515 - DNA, 14488 bp, Oryza sativa
ttaatattgtatagttctagaatcgtgtttacaaaatggctttgagcaactaaatatctttaaatgttgtttaatgcaaaccctaacccctttatagtataattcctttgtactcccttgcatttattctgcacttgtgggtgtgccttgttgagtacggtggttgtactcagtcttgctcaatttttcccaagcccagaagaggagttccttgaagatgaaggctttggtgcctagctcgtgcctgccgtcaagcgcctgtggtcgtcgccctagtcttccgcggtttcccgtttgtctttgtgtgtgctgggccttcgctgcccatgtaataagttatctatttacgcttccgcttgttaaactctgaattgtatcaacttttggtgtaccttgcctcctgggacaaggattaatgcacgcacgtcaggaacgcccgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaaactgacctttaaaatgttgtttttctttttgtttttgtttgtagatggccggcagcgtcacccgtcgtggtttggacatgactggcttcgtcttggagctgcggggcatgtgcgttgtcctggggtatccacatggagtggactaccaagccaggccgcttccggagcaggagggtgacgatgcagagccccacgctggttgggaggtcactgcagtgatcctctctggctctcccgagcggacttcgctggcagtcaccgcgggtggagattccttccccgccgcttgccagaacgccgctctcctcgccatcggcactcttcaccagcgctacccggacgagttgcagcactcgccctaccgctaccaccctcgtcgcggaggagcccgcgactacaccaccttccgggatgctagctcggaggatgacgctaccatcgtgcacctggcgcgcatggtggaggcgtacgacgcggctcgtatcgacttccatcagatggtgcgccgcgggatggtcgagaacaacttgaagatcctggagctgcgtcaggagaacctgcagctcaagaaggacctagatgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggcatggacttgcttcgtcgagacccctcgtgctgagcccgcgcccgtggttccccaggagggggaagcctccggcgttggtagcacggaggatgcgttgttgctcaccttccgtcctggcccgtcgcagcggtagacgagcagttagtaggcttgcgcgtgtgttcttcctcgtttgtcttcctgttgggtcgtgtggggcatggttatgccggtgtgtggtataactatgtcggagcctgtctttactttatttgcctaagcaacttgaactttaatgaacccatttaatagcagtaataaattcaagaattatagtagtcgtgggtggttagttttaattgttagctctctctgtttgctggttctgtgtggggttttcagatggtgacgaccaggagaaatgctgccaccggtgaaggcaaccaacctgaaggcagcccatcccgatctcttcgccagttcttccgaatctcggggtcgagattccgtttaaggggggtaggtttgtcgcgtcccaaaacgactctaaaatacatcctcgaaattgtgcatagaataattaaaatccatgtgaaagcctccaacaattaaaatgtgcaaatttaaaagtcaaataaggcttggaggatttttgtatatttcctaaaagcctaaaatgcgtaaataaattttagtggaattttcagagcacaaataataactgagaagaaataaacaaagttaaaaaggttttataaaaagaaaaaccctaaaaagtcttctttcccccccttcccttcttaggccggctcggcccagtcccctccctctctctcctctcccccgcggcccatcggcccttccccgcgcgcgcgccgctgatggccggcccgcccgccaccctcgctgacgggtggggcccacccgttatccccaacctcgcgccgctcccgccgcccgcccgtgccctagcgccgccgccgccgccgaatccgccgcatcccgccgttcccgcgcgccataaagagggggaaatcactccccgtgattccctccctcttttccccctctttcccctctctctctccctcggattcgtccggattcactcccgcgatcttcgccggcgcatcaatggcggccgagatttccgcggccgattccttcccctccggccgctctctctcactcccgacgctatataaacgttccccgtgcctccctcctccgtttccgccactcgccactctctctccccgttggattcgagcccgcgtcgtcgcaccttctctccgccgtcgccgccgagctccggttcgccgccgtcgtcgccccggacctcctcccgcttcggcatcgcctccttcggcttcgccgcgttctcgtcgacctcgtccacccctccgtttcgcccgccgaccgacggaacgccgccgtcctcgtcgacccgagccgcgccgccgccttcctccgctccggtcgtcgtttccgccgtcctcgtcgacccggggtgagccgtggaccgctcctttcgcttcccccttccccttctctctcgggcgccgctccgccgcgtcggtggtcgccggcggcgaccatcggggcgcgggcgcgccgcctcccgtcggccgtgccggcgaggccgcttccgggcgcgccccgcggctgccaggtgggcccggccgtcagccgcccgcgcccgcgggtgcggctgacgcgtgggacccatggcaccggccggcgtcagccgcgtgcacccggtccaccgtggaccgtgaggctgccgcgtgggccccactcccgtggacccggtctgcgcgccctctctcccggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttctgctttgtttctgctgttgtatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacccttgttatgaccttattattattgttattgttattattaccttgttcaccctaggataaacaaacctcaactagtggacactctactcatggcaccactagtttacttttaggtagatgcttcgcaatttaattaggtaacactaggtggttttccaactatagactttgggaaatattcatatcacctggatgctttggaatggtctggttattgtggaattggattcacaccgctccttctattcaaaatccccaaaatggttttaggctgggttcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggaaggagatggatgaagtcgggggtcgatggacattctccagggcaaatgaaggctacacgagctgcggcccggtagtcgagatgtcatggcacagggttggtgccctgctgtaggggctcagtcctgcctgcctgtcccggaggttccggccgtaggcgggattgggtcggtactcttgtctatggctaggatgggttggaaactatgtcacgtcttccgtctgtataccgtggtggtatgtggcacgtggttgcacgtgaggaaaatgtgtcttgtgggtaaagttgtacacctctgatcagagtataatctattcgaatagccgcgccctcggttatgggcaagccgagcaatgtacccaagttagtgttttaattcttaaaacctgcttatcaactaaaatgtggaatggttggcctgggttggcttgggacgagctgggacccagggtcgggttgccagttcggtctgaatcatcgtaggccttgggttaaggcaggttcgtgtgggttcatggccttgataattaatattgtatagttctagaatcgtgtttacaaaatggctttgagcaactaaatatctttaaatgttgtttaatgcaaaccctaacccctttatagtataattcctttgtactcccttgcatttattctgcacttgtgggtgtgccttgttgagtacggtggttgtactcagtcttgctcaatttttcccaagcccagaagaggagttccttgaagatgaaggctttggtgcctagctcgtgcctgccgtcaagcgcctgtggtcgtcgccctagtcttccacggtttcccgtttgtctttgtgtgtgctgggccttcgctgcccatgtaataagttatctatttacgcttccgcttgttaaactctgaattgtatcaacttttggtgtaccttgcctcctgggacaaggattaatgcacgcacgtcaggaacgcccgttgggttatttccggtcgtgacagaaccgcttctgcgccgtagacgaggaagaaaggcgtttccccggttgctcggcttggtgtggttcggttcgcccagagcaccgctggcaactcctcgatccatgaatcgccgtgcttcttgaggatattgaaggtcttggttttaaggcctcttaggatttccgcattggcgcgctccacttggccattgcttctggggtgggcgggtgaggcgaagcagagcttgatgcccatgtcttcgcagtagtcaccgaaaagctcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgtgacatacagatactcaaacccgcccggggcccgcctaaacggtcccaggatatcgagcccccagacagcaaatggccatgaaagtggtatgatctgcagggcctgggccggctgatgaatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccattagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggccgatcaggcgcgtccgtctcccctaaggggtcgggtcgcgccgacggctgggcaagcctttcttcaaaggcgcccggtggggtctgggctcgcgaggaagcgagccgtgaaagttcgtcggcaaccgtgttatcccgtctgggcacgtgccgaagctctatcccatcaaaatggcgctccatacgccttacctggcgcacgtaagcgtccatctgcgggtcagagcaccggtactccttacagacctggttaacgactagctgggagtcgcctaacaccaggaggcggcggatccccagtccagctgccaccctgagtcccgcaaggagtccctcgtactctgccatattattggtcgcccgaaagtcaaggcgaaccaggtatctgaggacgtctccgctcggcgaggtcaacgtgacccccgcaccggcgccctgaagagacagggagccgtcgaactgcatcacccagtgggcggtgtgaggcagctgcgaggggcccgagctggcctcggggactgagacgggctcgggagccggggtccactctgccacaaaatcggcgagggcctggctcttgatagcgtggcgtggctcaaagtgcaaatcgaactcagaaagttcgattgcccatttcaccacccgtccagtaccctctcgattatgcaagatttggccgagggggtaagacgtaaccaccgtgacccgatgcgcctggaaataatggtgcagtttcctcgaagtcatcagaatagcgtaaagcatcttctgggcctgagggtatcgggtcttgacgtcccggagggcctcgctaacaaagtagacgggccgctgcacctttcggtggggccgatcctcttcgctaggggccgcatccctagggcgctcttcgtccaagcggcctcgcggggcgcactcatcttctgtgccgacgacctcggggtcggagaacgacaggggcggccttcccacagtggcctcggggccgtcctgggggttgggggctcctggcgtcgtcggacaagcaggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggccagctccggtcgtcgggggccttgggccaccgttcggctcgggggcctctcctccctgctctctcccgggccaagccagcgcagggtggggatgcgcggaatgaggattgtcctcatcgcgctccacaaccaacgccgcactaaccacttgcggggtcgccgctaagtagagtagcaagggttcatttggctccggggcgaccagaactgggggagagctgagatacgccttcaactgagcgagggcatgttcagcttcctccgtccaggtaaacggtccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggcctcgatgcctcgggcagagaccaagaacccgagaagcttgcccgcaggtacgccgaacacgcacttatcggggttcagctttatgcgggcggagcggagactctcaaaagtttctgctagatccgagagtaaggtctcttggttgcacgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgcagttttttcctcatcctccctagccatgcgaatctgatggtaaccagagcatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgcactttctgccggaccggccttgcgcccggccgcacggtgagacggtgctcaatcacctccctggggaccccgggcatatccgccggtctccatgcgaagacgtcagcgtttgcccgcaggaaggagacgagcgcgtcttcctatttgccatccagaagaccaccgatccgtgtggtcttggacgggccgtcgcccagggcaacctccttgaccgggacctcgtcgcatgtgactatccgctgcctcggggcggcggggacggaggtgccaagcctctcgtcgccaccctcgggcttggacgcggcggcgaggtggtccgcgcgctgctccatacaagcgagcgcgactttgaggtcaccatggacagagatggggccactggggcccggcatcttcatctggaggtaggcgtagtggaccgccgccatgaacttcaccaacgcgggcctccctaggaccgcgttgtagggcagactgaggtccgccacatcaaagttcacccgctccgtgcggaaattggcggatccaccgaaggtgaccgggaggtcgatatgaccttgcggccaagtgtgccccggcgtcacaccgataatcggctgggacggccgaagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgtacggtgggtggtcggtctggtcaaaggtgagggcaacctccgaccaccgcgcccggcgtgtcgcctcatgagtaggggccgcggccagaagctctcgcttcatggtcttgaggctccggcgagaaacgtgagcacacgctcccccatcgacagtggcaatggtggccccatgctcttggaaacctaggtcatcatcgccgtcatcgatgtccttggcgggggccttctgcttggcctcacttcgccgattgccggaaggaaccgccggggacttgccctctcggcgctcctgcctcatctcctcctcccacttcctcgtccgctcagccaaacttttgactgcgcggcagtccgcgaggtcgtgaagggaggtgttatggacggtacaccacttgccagttgggcgctccctgctgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtacgagcgaagtgactcatcatcccttcgctgtactgcgtgtaagtccgcttcttcacctgggcgcggatatgtgccttgaaagttcatggtgaactgttggcacaaatcctcccaggagtggaccgacgcgggtggcaagttcattagccaaccccgcgcctgtcccttcagggccatgggaaagaaattcgccatgaccctgtcatcacccccggcggcctcgatcccggtcgtgtagaccaggagaaactcggcggggttgacgctcccgtcatatttttcggcgatggtgtgtcacgtcctgataaattcatcccgaattaaaaatcatttgctaaaaggaataatagaattaattaaaattcgaaaagaaattggcaaacactaaaatacgtacaagaaaaattcaaatgtggcccggagaatttttgttaaattttccttggtctaaaaggagccctcaaattttagtggaattttcagagcacaaataataattattaagaaaaaaacaaagttaaaatgattttataaaaagaaaaaccctaaaaagtctttttccccccctccccctcttgggccggctcggcccatctccttccctctctctcctcctccccgcggcccactcggcctctccccgcacgcgcgccgctgacgggcgggcccgcccgccaccctcgctgacgggtggggcccacctgtcatccctatcctcccgccgctcccgccgccccgcccgcgccctagcgcggccgccgccgcgaatcccgccgcctcccgcagtccccgcgcgcattaaagtggggggaattattccccgtgatcccctctctctttccccacatttttccctctctctcccgcgttcaaacgggcggatttgcccccgcaaatctcgccggcgccattgatggcggccgacctcccgcgccggtttcctcccttccccggccaccctctctcgccccggctctatttaaaccctccccgcacctcctccgtccggttccgcctctcgccgcccttcctcctcgccggatttgagctcgcgacgtcgctctctctctccgtcgtcgccgccgagctccggcccgccgccgtcgtcaccccggaccgcctcccacctcggcgccgcctccttcggcttcgccgcgtcctcgccgacctcgtccactcctccgtttcgcccgccgaccgccggaacgccgccgtcctcgtcgacccgagctgcgccgccgcctccctccgctccggccgcctcctccgtcgccgccgtcgccccggggtgagccgtggaccgtcgcctcctttcccccttccctcccttctctcggccgccgctccgccgcgccggtggtcgccggcggcgaccatcgggacgcgggcgcgccgcctcccgccggccgcgctggcgaggccgccttcgggcgcgccccgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccacgcgcccctcccctcggctgacgcaataaatccaattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttgtatggagtttattagagtaaaagccttttcttttccggtggtcgtgtagacgctgccgcttcggaagatccgctcttcgtggaagttgaagccgacgtttgggaaagcgagcaaggcaagtcacatcatccttgaacatattgaatcccagtttataaaattattttgatttaaactattgcattatcgctttatttaaattcccgcgttatcactgttttatttagccatgcctatctacctttgttatgaccttattattattgttattgatattaataccttgttcaccctagattaaacaaaaccccaactagtggacactctattcttagtaccactagtataaattttaggtagatgcttcgctgattaattaggtaacattaggtggttttacaactctagactttgggatattcatatcacctggacactttggaattgttggtttattgtggaattggattcacaccgccccctctattcaaaatccccaaaatggttttaggctgggctcggggtgtatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtctatggccaggatgggttggaaactatgtcatgtcttccatccatatgccatggtggtatgtggcacgtggttacacgtgaggaagatgtgtcttgtgggtaaagatatacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttaggttaaggcaggttcgtgtgggttcacggccttgattaataatactgtgtagctctaggatcgtctttataaaatggctttgggcaactaagtgacttttaaatgctgttaactgcaaaacttaacccctatatcattaccccttgtacccccttacattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacgggcattaatacactagcgttcgggaaaatgcaattttctcggtcgcgacatggtgggccggaaccttgagggccaacggacgttccaaacgctcgccacaaaggctctacagccgacaccaccaaccgggggcacggagggctgatccccgcgtccgagttgaggtgacactccggacgaggaggcgccctccgttgcgtgggcagcacgtcgaccattacgccggtgctcgataccgatgcgggcatctggccccccacactgatcttcccgggtcggaggtgctgacgagggagtggcagccgaatggcgagcaacagccgccgctcgccgcgccctccgccttgacgacacggagccggtggtagcagcgccagaggtcttggtggcggaggagcgcccaccagcacctaggcgttgccgtgccgtcatgaccaagttggccatgtcgtccagccaacgttgggctggagactccgggtcagggacgacgggcgggtgacgtaggagcgcgcccgcagcttggagcgcgccctggggcgtgctgccatcgccgtagacgaggaggcgacgctccccatctcggcgcccttctccatcacccgtggatgtcgcagtcgcggatccttcgaccctctcgagcgcctcctcccgtctaggactttggcgtggagggggcggtggagtacgagctcgacggcgtgggttcggctccccgtcgtcaccgctaacactcggagagaggttgtgcgcctttgcttgttcggccattgggctgaacaggaaaagcttggcgcacacgaaagaatgcgagagcttggaaaaacacacgcagagccccctacctggcgcgccagatgacggaacgtgtggctcctcaccgggagaccgcgcaggcccccctttgccggttcggccgggggccctgggtgaggttctaagctctcggtctgtggaaagttcgcgagaatggaaacacacaagacacgggcgatgtatacaagttcgggccgctgagaagcgtaataccctactcctgtgttttggtggatctgtgtatgaagaagctacaaagagctggagagccagagaactctaactctctccctttctggttccgaatcccagtctcggatcgttctccatccctttttcctctctctctaagtgggcaaggtcctccttttatatctcaaggggataccacatgcaccatctctctcttttgtgtggggacttatcctctcttttctccaacttgacttgccttctcttcataaatggacggagatttgtatggttgcccgtccgaatgaccttctgatgggacgggccat

SEQ ID NO: 49516 - DNA, 3310 bp, Oryza sativa
ggcatatatctgaccgggaccaacgtgccatctccaggaggtaacacgccggctccggctagggacgagtgcttggaggctctcatcctgacgggatggggcgaggcgtgcgtcagaccgcctgtcgccacctaacccacgatctgatcggtctgtgaccagtcacagaccggataaacgagcacgctgcactgcgttacatgcggcgtgacgcgctcgtccaaaccgcaataaatgcggttaggtgagccccgctgcgctcacctaacccatacacgcggcgcaaaatccacaaggggtcggggcgcctcagtcgtcggggccgaaacgggagcggtccgacccctcggggagacaaagagggaggcggccacatcaccctcgggcccgacccccccccccccccccccgagggggtcaggcctcgtaggtgattgctcctgcccaagcctctagtcatgatactcccggtcccatgtcaccgacatatatatatatatatatatatacagtctttcgtttcagagttatgcaagaattcggttcctgccactataaaaatatcatatagtactataatttggtaattgtagaaaaaaacctgtgttaattaatatactccctccgtcccaaattataagacctatatattttttacacagtcttcaataacatactttaactagtattttattctattttatgatctcgataaatatgaaattagcattatatgaaagtattttaaaatataaatctagtgatataatatgtaatacttagtatagatatagttagtatggttattactcaaaaggtaccgagtttaatttttcttaaaaagaggcaccttataatttgggacggaaggagtagttaattcgagctcaaattactacaaaattcttctcaaatactataattaatgtgtgacgcatatcgggctggctgggcggccagtcacgaaggtttcaaatcatcgtgattcagtttccaaaaaggaaaatcgtttgacatgtttgcgccggggtgtttacatttacaggtgtaaagttttggcttgtcacatcgtgtataccaccacacatttgaagtattaaacgtagactaataaaaaaataaattacagattccgcatgtaaactgtgagacaaatttattaagtataattaatctattattagcaaatgtttactgtagcacaatattgccaaatcatggactaattaggcttaaaaattcatctcgcaatttacacgcaatctgtgtaattagttttttctatatttaatagtcatgcatgtgtcaaacattccatgtgagatggtataaagtttggtgtgggaactaaatacccccttatggtgggggtagcaatgcatggctggccattgcgagatgattataaaatataaaaaacacaggaataattaaatatttgatttgatcgtaagaaaaaacataacgatttaagggaagataaagattcaaaggaaacttttcattaatttctatctcatacttcctcagtttcatattataagactttctagcattgcccacattcatatatttgttaatgaatataaatacatatatatgtctagattcattaacatttatattaatgtgagcaatgctagaaagtcttataacctgaaatgaagtgagtattacatttcctccggaaactagtatagaatgagatatctcatgaacgcaatgcaatgcgacaaacactcaggttacgactaaaggcaactgctagtgagccggtgttggtggtagggcaaagcaaggcgaatgagctctaagccgaacctatttagaaataagttcatcttagatcccttaacttatagcgagtttgattttcgtcattgaaccacaataccagaaacaacagatttctcaaatattaaaaccggtgcagataaggtcgctcgacggtttggatggcggttttggcttatgtagcacttacgtggttggtttgatttgtcctcgtcctacgtgacagtgatgtggcactggaagtaaaatatgaaattaaaaattaaaacaaaaaatatggagcccacatgttagtaagacaaaagattaaaaaaagtgggatattactgccatgggacctcctttgaatggtttgagtaagtttaggggtagatatttttggttttgtggttaaggtaccaaaaaaatctcgctcttaagttaagggacctgcagtgaacttagtccttaaataaaattttatttcggcccacacttccgtcaccggcctataaaattggcccggtttccccccttccgcttcaacctccgttcccccttccccttcaacctccgccactatacctggccaaatgggccgtgccaagctgggccggcccgagcacggcagtactgtagccggcccaggcccggcacggcacgccagcctgtgggccgtgccagcacggcccgttatcccgtgccgtgtttgggccgacgcctcagcccgtgggccggcacggcacggcacgtttactgtagcgtgccggcacggcacggcccaggcatggcacggcccaccggcccatttatttttcctacgattttctaatttttcccatatatttctcatattttttagttttttccacattttatcctatttgtaccatatattttatgatatatttcctaaattttcctcacatttatcatatatttataatgttttcctttatattatattttttctgccttttttcttttttttcccctcaaatttcaatttttatgggccacatgtactagtgggccggctaccagcccacggtccactacagtagccgtgccggcccggcacggcccagcacctccttgggccgtgcttgggccgaggccttggcacgtgggccggcacggcacggcccgctacaggagtcgtgcctaacgggccgtgccctagtgggccgtgccgtcagtgtgccgtgccgtgctgggccgggccgcccgtttggcctgctatatccgccacactccggagtacgagctgacgaaaatggctgtcgccgacgccgatgacgaggagaaggggcgagcgggagtcgccaatggcgtcctcctcgcgttcctcgcaccagaggaagcgctcgcgctcgggggcgaccacaatgaagcgctccacggcgagctgcgcgtgcgccagggacacgaggtcgacgcgggcggggacgacgatgacaaagcgtggcgcggcgaggtgcgcgctccccagggccgcgcgtacgacgacgacgcggccgaggacgaaaaggggctg

SEQ ID NO: 49517 - DNA, 3730 bp, Oryza sativa
cgctccccaggcccgcgtgtaggacgaccactcggcggagtactaggaggggtggagcttcctctccgcccgcgcgctcgacgagaaggtgcggggcgtgctcccgctccgcgaccgcgcactgcgcctccgccgcgaccgcatgggttacgataacgagggggatgtccttcgcctccaggcccgcggtgacgcggaggacgacgaggggctgctccgccgccgcgcgcacggcgaggggctcccccttcccgcattcggtgtcagcggcgagaggcgcccgctcggcggccgcgcgcgcctctactacgacgccaacgacgactaccaggggctccgcggccgcgcgcgctacggcgtggagacgcgcggcttctgcgcggaggacgtcggcgacgaggggcgccgcggccgcgctcacgacgacgggcacgagcgacaccgaggacgcgggcgcgtgggcggcgagaggcagagcagctgcgcgaacgacgacgaccaaggcctccgcggcggcgcgcacgacgatcctgacgagccgcgccgtggccgcgtgcttctcacgctccgtgcccgcctcaaggacgacgacgacgaggaattgatgcgtgaccaggagggcgccctcggggacgaggtccaccggggcgcgaacggctaccgcgagggccatcgctccgcgcacgacgacggcgagggacccccgttcgccgcgctcgacgacggcgaggagcgcccgctcggcggccttgtcgaggagctgttcgtttgccgcctcggggacgacgacgaggtccgcgtcggtgcgaaccacaacggcgaggggcgccgactccgcggcccccgtcccgatggcgaggaggcgcgcgtgcgctgcggccgcgcgtaccagctcgcgccccgcgcccacgcgcaggaggagccgcgcgtacgccgcgaccgcgcgcaggaggacgaagaggagccgcccgttcgccgcggccgcgcccgttcgccccttcgcctccaggcccgcggtgacgcggaggatggcgaggggctcccgttccgcctccgcgcgcacggcgaggggctcccgctgcccggactcggtgtcggtggtcgcgcgcgcctctacggcgaggggctcggtcgggaggacgacgccgagcggctcgaggtcgcggtggacgacgccgagggtggcgtggaccttggcgccctcgagctccaggatgaagagcctgccggcggcaagaaggtcgccgtcagcgccgccgttgcggctgcgcgcgccgttaagaatgccgccggaaagaaagccgtaagttcctgtgcttatgaattcaacatttggattttgggcgataattcttttttctaacgattgtcatgcaggctaaggaagctatggtccggtggggacagagaaaccccaacaagaacacccccaagaaaggatcaggtactgccaattgctcgatctataaagaaccagttgaagttggagctttccagtccaatcagaagatttatgagccagacaagagatttatgacgggaaatgaagtcactgacagcgaatacattgagctagtcgggctttacaataaaatgaacaatctccaattagagaccaaggacatgatcaaggggaatgctatgaggagtgacatcttggacaactgcttactgatgaggaacttagttcggaagatgcgatcacttcgtgcgatgatcaaaagaaaagtcgaaggtgaacctcctataatacctcccaatctattagaaattccagatatctcttagtggtgcttggtggtactgcatttgcattcttctgagcctagaagtgcttcttttagtggtacagcatttgccgccttctgtctagagagcctagaggtgcttctgttagtgctacagcatttgcgttcttctgtccgaaagtgggcagtaaatttgtactccttgcagattgactctcatagtattgattgattggctgtagtactgtagctttgaacaacagaagttatttttttctgtgccattgctgccatgttctgctagagcggtgcaggggtggtggtgttatgtcatttttttttcccaggcaaatgattcacatgaattctttttgaggcatgccaacttagaattctgggtgcaaatgattcacatatggtggctggggcaatgtcctaatagggactttgggtgtgtttagttcacgccaaaattgaaagtttggttgaaattggaacgatgtgatagaaaagttgaaagtttatgtgtgtagaaaaattttgatgtgatggaaaagttagaaatttgaagaaaaagtttgattggttcagttgtttgatggaaatggacttgcaccagggaatacaatgcagaaatccgtgtatttcgaacttgaaatgaacttgaaatggctaataggtcgcaggttgcaactaaggagaaattcgctaagaaggcggccaaacttcccattgcaccagaaaaacagagggatgaactggtttcttcagatctagactggtgctagtcacatactccctcgtttcaaaatgttcgacaccgttgactttttaagtacatgtttgaccattcgtcttattcaaaaaatttgagtaattatttattcttttcatattatttgattcattgttaaatatactttcatgtacacatatagttttacatatttcacaattttttttaataagacgaccggttaaacatgtgctaaaaagtcaatggtgtattttgaaacggagggagtattagagagaaggaaggagttcattcactccgattccaatgaccctaacagcatttcgtggataccttcatatagtgcaatcaacaaaacctcacccacagcatttcgtcgaagcattgtgcagcggtagagttctccggagcagctgccggtcagctctgcttctcaatccgcacgtcagggaaagaaactaagagccaaccttgcaaagcttcctactcgaccagcgctatgtcaaaaaatcatgctgacgggaaaatccttcccatcgggcccccgcgcctcccacgcctcgcgtgccacccccaccacgtgtactgttgcaacaaatcacccgcatattacggaaacgttctattaggaggatccatttcattattttgttccaccaacaatatctcagctagtgtactcgtgatgtttcactgtgtatgtaccaaatgtcgtaggggattttttatattgttttaataattttatcttgaaggacacgtggtttgtttatgtatacaaggtttaagtgttgtaatggtttaaaatagtttgttgcatatgttgaaccaaattgtttcatttagtgactgaccgtgtttcactttttttaagaactgtaacattctttcgctatttactgaatattgttttaagagaaaatttgattcatggaacaaaaaaaaaattggtaccaaataatagcacaaaatttttccccaataaactagaagcacatgcctctgttttttcttcgatttgtagcactcccgtcacatttgccattcatttgggtggaaaaagactaatttgcccttcttctattccatatttcccttctcttcctcccgtcgatctcgccagcacatcggtgggtggctatggtgcaacacggctaagcgcctccgacggtgatggcgactgcgcgtggcgagttcacgggcatggcgactgtgcgtggtaagt

SEQ ID NO: 49518 - DNA, 2961 bp, Oryza sativa
agaataaagggtaatttcgtcttttgatgctcctaatcatggctaaccaatggacttggacggaaaatgtgacggaagtgctacaaatcgaagaaaaattagtgacgtgtgtttctggttgaaagaggaaattttttgtgcttttttttaccgttttttttccctgtgctattgatcgaattttctcttgtttttatatagggtgaaacaacgcccgatttttgtggaaaccgttgtttgataagttgttgcaaaatgtttcatgagatagtttggttgtcttctagttttttaaaagaatgaaatattttcgatttacttggtgaaacagcgtccgatttttaaaaatcggcgcccgatttgtatgctcctcaatgctgatgctgttatgtactactgatactggccgattttgtggatataaacaaacagaatttgtgcccagttcatttgtgtcaagaattagactttctgttagatgaacatatttaatattcacgacttgggagaccaacagcatcattcatcgtgaccacaaaacgtcatcgcaagtttgcagcgacaaatgtcaaagtaccataaattaggaaagattgctcatgtagtcaagaatcacataattaagacttagactgatcgtgaatcatgaataatgtattctcccctcaaaaaaataatcgtgaatcattattcccttacatgttttttttttcataatttctcgtatccatattacttcagagatcaccatctgactctgattcctgatcatgtggttcatcttcctcttcatcttcgtgttggtgttcgtcatcagaaacagcttcatcatcgcggtccccaaactccccgtctttgttctcccggagcatctgagcgaactctctcccgcaattctcccagacgagagctcggttctcctcctgccgatcgaagtagccgtcgtccacctcgacgaacccgttggcctcgaactcggcgcgcacccgcgccgccatctcgcagaacctggcccagctcgccttcctcctctcgacgaacccccgctgcagcgccagcaggtcgtcgaaccacccgctccgcaccagctcgtggtcgtcggtgtagagctccctgcgcgccgcggccttgtcggcctcgtcgaacgacggctccctccggtgaaggatccagctgatgtgctcctgcggcatccggagctgcttcgacctcgccgccgccgctgccatggtttcgaattcgattcaccaagttgggagaagcgtcggcgatttatagcgggccgtgtatgtgtcctagtaagagtaggaatcggagaggcagaaattggctccaaattcgttcacggtttggccgaattccagcaccggattcggaatctgtggtggaaaaacacgagcaaaggcacatttctcaaacacatacgtaccaaccaacaacaaaagcggcggcgctggggggtcgcgccggcgagctccgccgacgggaaggcaggggaaagaggggcgaaacggagagagcggcacggggaacccatttcctccactcgatttgggagatgtgcaatggcgccgacggatttcgcgattttgaaacgcgcggggggacgaaaccctagaaatttgataggtgttcaccgagggacgcgaccgtctactcgatcggtgagtaataacacccttttccacctttgcattgctgaattcttaactggtgatgacgtttactgggatgtaaagaaacacagtgcttaataaaatgttgagatagccatttctcattatttaatcttgcaattaatgcaactaaatgtattgacaacagcctaatagcatcgggcattcaacgtcaaaattatacacaattacatccagacagacattagtgatgtgatattggcatgactccacccataactataagagttcaaatcctgatgcccagaaatattacccatatacatatatgctttcaatagaattttaataagaccatggatacatcgtttgtttccgtttattaaagtgtgtgcgagtgtagtgttaagtgtatagtagtgtatgcgcgtgtctacggtgaatctcacactacatgggggaatgaagagcatgcagttcaataaaaaaaaagacggggggggggggggtttcaagggttcgattcctggcctcctaccatcaaataattgcttttatggtgttcctctcccttagcctttgcttacgtttcttttaaaattttaaatataagaacataaattattcaatattaatcttgaaagccttttggcttagtaactataaatttcacatatgttcacttttattccttccaagttcaaaaatgtaaattataattattgagctaagtatttttgctaagactaataacattataatttaagttcgtaaatttgtccatttcaaattaatgtacatcaaataaatttacaaacaaaatatgtggtcgttttggaaaaaaaatatagcaaagcattcacggcgaatatgtaagaaaaaagctgaaaaaaagatgcactgatgggttcaaaaccagaaattaacctgcaactaaaaaaaaaagcctaaccactgggctagatttccttacagtagctcggcgtgattttagattgtacataaggtcaacgcgagctccttcgatgaatttgtgccacgtcgaacaagatctcagcaccaacgttatagcacgccaaggtcatgcttcatcattctttacaacaaacccttctttaaattagttttcgttcaattaagttttctagaaggtccgtttgtcaaaatttcggatgttttcttatccagtgacccccgtgtgcggagccgtacgatcggcagaagacagttgagatgcgaacgtgccgccatctgccgtgacacgggcaggggcggcagtgattactccggttcggtttcggcaatactaaaacggaaacggacc

SEQ ID NO: 49519 - DNA, 1922 bp, Oryza sativa
ttccccgagtatgtcagcgtatatgatcaagagacgagggcattcgtgatgagaccgaaggaattggaggtaggtacaagaccgattgctgttttcgacaaggtcaagatgaagcttgtgttgaagaaactagatcagtgatctagtattataaaaacttttgtcaaatagtcgtatatggtgggaaactattctgatccctcgaggggacgtcccctcattggttatgaaaaaaagtggagaatatgtattaacatgtgatatacttcgtatcactccataaatatgcaagttcaaattcaacttctacatctcgcaactagatagttaaggtatattcacagtcaaatttgtttttttcgttgtgagatgtataagttgaatttaaactcgcatgtttgtggagtgatatatcatgttaatacatattcttagattttttttcaaattttttcatacctatttcagtaacatgcaaacaacgaggaggcatctccttaagggatcaaaatccactcccgtgtatgatttatcttcagttagcgcaacgcgttgacgatgcatgtggtgttcatttgttatcatcgggattcaaccatgcatgtcaatggtctgatgctcatgcatagagttgatttgcgatgtttcaatcttgctttgatatttattgaaatttttaatcctttttacttatgtcatgtactataatgtttgtttatggcatttatgctggtctcattgtataagctttgtaacctactggcaatatatatcataattattttgtttcagcatgcccctaaatataccccctttgttttatattataaaatgttttgcgaatcctaaaaaacttctctctcgcgtcgccctcccctgggcggcatgagaggcgacgcctcaccgccaccttcctccccccgcttcctcctcctcttccctcgttgttgcctgagcgggcgccggcaaagccacgcagacgcaaggatggcggcagtggggcctcgtctcgcccaccccgcgctcggcggccgggggaggctatccagggtggcggtagcagtggtggccagattcgggccgagtctggcatgatctggccggtgggtggctggcggcgggggctgacggtggcggcggcgacacctggtagcgaagatggcggcgacggtggcggagccccatccagatccacgccaccctgatcgaatctggtcgggtggcagctagcgacgtgtaagatctcatttttgctcccgtttaaaatcttattttaaatacaaaattattttcaaaaatttggttcttatttgaattctgggttgtgccattaacgatctcaaaatccaatcatctgaagtcctatctaccaacaaattcctaaacctattattagagtccacagtccctttacaatctttgaacacaaatttcactctaattccacgtacaaagtccccacaaaattatagtcccaatgtccatttacagttccatcaaatactctccaaaagtccatctctgaaattccctagaaaaattaagaaagatccctattcctttggaccacctttcctttcccgtagtccaactccctcggaataagatcactttaggtccctctatttgtcgcccagtccgactttcgtccctgaaccccaaaaccgggtacgacccgtcccccaacttatgaaaaccgggcacataagctcctaaggcggtttggatagcggttttggttgacatggcgcctacgtggctggtttgactaggtctccgttccacgtggtattgacgtggtgcttacgtggcaattatatctcgaaaaaataataaaaatcatgggcccacatgtcagctaaaaaaaattcaaaacgatggggcccacatgtcagccacacaacaaaataaatatggtgggg

SEQ ID NO: 49520 - DNA, 19041 bp, Oryza sativa
cacggagaaggccggagcggtggccagcggcggcacgcgaagccggtggggtgatggcggccggtgcggcggcacgatggcagccggagcagcggcggagagcccgcgggagtcgacgggagacaggagaggagggagcggcggccagagctacacgacctcgccccgccgccgctgactcctcctgctacgccgccacatcgatttgcgccgccaactcccccttcgcatgtcgccgtctccgcctccgcctccctctccgccggcttcgcgcgccgtcaccgccgcactcacacgacgcgcatgggagctccccccgccgccgcctccatccctctccctcgcgttgccgcgtggcggtcggtgaggaggaaggggaggtggaggcggtggcggggggggccgacgagagcgctgcgcggccccgacgccacactcgccctcccctcccgcctctgcgtcgctcccgtcccgcctccgccgccgccgtcgattgaggagaagaagccgctgctgttcacgccgccgctgcctccgaggaagaaggcgttgctgtttccgccaccactgcctgccgctgaagaagaaaccgctaccaccacctctgccgccgctgccggagaaggagaacacctcgttcccgccgctgcttctacctgcaaagaagaagccgatttcgccgccgtcactgacggcggcagcaaagagtccatcgagctctaggcggcagcgccgccgcctttcgtgccccagccggtatggcccctgctggccgacggtgggaagcgcaaaaagctgtcggaccgtggtggccgcatccccgccctggcgccctcaatacgttgacaccgccgtcgaactccgtctccgtctcgagcgcggcggcgatggaggacgacggcttcttggcgcgtactgtgggcctgtggcgacgatggggaagagaaaaggagagagagctgagaggggatagggaatgacatgtggggcccatgtgggccccaccatatttattttgttgggtagctgacatgtgggcccatggttttcattatttttctgagttataattgtcacgtaagcgccacgtcaatgccacctgggacggagacctagtcaaacccgccacgtaggcaccacgttagccaaaaccactatccaaaccgccataagaccttatgtgtccggttcttgtaagttgagggacggctcatacccggttttggggttcagggacgaaagtcggactaggtgacaaatagagggacctaaagtgaacttattccaactccctctcctctgtcttttcctccttgggccagcccgccctttccctcacccaggccggcccactccctctcccccttgaagtcagccggccggccgcacgtgcccgccacctgctcgacgaaatgtcgagccgggcgagcagcatgccgagacgcccccacaccctccgcacagtcccgtgtgccgccccgagccgtgccgcactgctccgctccacaccacgatgaaatccggtcgcgttccctcctccttgccctagaagcttccgcccacagtggcaaaacgtcgtcgacaccgtccttcacacgccgtggcaacgccgctgctcccagtccacaccgtcgcctcctcgcgctcgagctcccgcagccgtgcgtccacgccaaaagcatgcgccgggctcatgctcctccacgacgccgccgccctgtgcctggctgctccgagttcaccgccttcgcgtgctcgcgctccgtcgcccacagccgcgcgtccacaccgaacgtgtgcgccgcgttcacgccgttcggcgccgcccagaccaccgccccctcgctcctcttcctctgtttctctcaccatggccgccgccagtgcacccagtccactgagccaatcgacgcgccacgagagcccgtgtctgtcgtccacaccgaaagcaaacaccgagctcacgccgccacaccaattccgcaccgaaaccaccgtcgccgccgtcttcatctctctcccggccgatgtcacgccgcgtcgagcacgcctcgcgcactcgggccagcgcgtcgctcggtcgaacgccgccgccgccgtcgcgccatcctccctcccggttcctgctctccaccagcgcctccaccccacgtcgccgcctctgccttcgcccggccgaaccgccgccgcggtcgccgcctcgccgagccgagcgtggctcgcgtggccgccgctgccgcgccgggattcgtcaggcccgcggcgccctcttccatctcgccgccttcccccaccgccgcggcagccgcggtcgctgtcgccgcgccggccgcgcctcgctttctcctgctcgggcgcgcgcgcgtgggaaagagaaggggaatcggagagaacgaggaagaaatcgagagaaacagaagaaaagaagagagacactgtcaggtgggacctacgtctacgtttgtttaccatgtacgcaggctctgttggttctcaaggtttgtttaaaaatatcatattgatcctttatttaaaaaaaattagctaatacttaattaatcacgtgctaatggtctgttccgtttttcctattgaagggttgtgttcccaaccatgaggaaagaacacagcaattagcttgcacatcaatatttcagatggactgaaggattctcagtagcaaaaggaagggctcgccctgccaacaagacgatgattgtcaacatgacaacggataagatcaggtgtagacctttcagaggtataaaatattactccctccgtttttaaatatttgacaccattaactttttaatatatatttgaccgtttgtcttattcaaaaacttttgtgaaatatgtaaaattatatgtatacttataagtatatttaataatgaatcaaacgatacgaaaagaattaataattacttaaatttttttgaataagatgaacggtccaacatactttaaaaagtcaacggcgtcaaatatgcaatttgtggctcaaataggaattggtaggtttgagttatgtagtgggaatgggcatggggatgtgaatgaatgtgcgaaccctttatttggcccgtgctatttaaaattaccaaattcattctctacaagataaacacaggtggagcttcgatgcacaactgcatgtgcacatttctgcaatcttgcttatataattccaatgtttgttaatggggggctattgaatcacatctgcttcaatactagatagaaagatacggatgatttaatggtgtaagataactaagtttgctttgagaacctccaaattttctaaaacagaagcacgtactaaacaaaatcctgagatataattatgcggggtattcatttatctggcctattcattctatattctttctgcaaaaatctagatgcactgctgtacagagcatacatgtttttttccggctctttgctgcttttataaaatcatattgtgtagtataaccacatgattttcatgagcgcatggaaatcatacttgttggttgcacatacctatttcaatatttgcttgtcattactaatgactgtctgggaaaatacttctgcaatatttcatataaagctcccatttcccagtccacatatatacggacataccacagctgcatacctgatgccagtgtacttatctcttctgctgtatgtgatgcagcacatctcataattccagtgctattgtcctcgcattgctttgcatgcaggacattaaattgttgttgcattcattccttaatgccactccaagatgctccttgcatcacattcatttctacaatcttggagattctatccctagcttaattatcttcagaaggagtactccgatgcgataagagtgcattttgtgatgatgagattgcgagaaatctaatcagcaaaattaaccacattttacaaaatcactcaattcattggcgcaaagaaactagacttcacaaggctgtcacaccagggattgaagaactcgcgcgccctgatactgcctgcgtataaacatcaacgtggaatacagcttttcatgcttccatacacggaaaacggagcggtccattaacacataattaattaggtattagctaattttttttaaaaatggatcaatatgattttttaaataacttttgtatataattttttttaaaaaaaacacaccgtttagcaatttaaaaagtgtgtacgcagaaaacgagaggggagtgttgggaacttacctcttgcaaacatgtacaccagtatcttcatctctctcacagtgccatccaccccattgtttccatgcataccctttttgtgaatggatgcaaaatgatgaaggtggtagagagttacgcttcaaacatcactacctttgagttcgacaaaaaaatacatcactacacacttgacttctcgtgtcatacagtaggaatgttgggtttactgcaacatccataaaaggttggatttaccgcaacatcccaaatgttgaaaaacatggaataccatcatagaaactctgaagcattacataattatagagtaccccctccgtttcataatgtaagtcattctagcattgcccacattcatatagatgtcaatgctagaatgacttacattataaaacagaggaagtagcaatgtacataaaacagtacacatcccataaaaatacgttgaaaatatcttaaaatcttcttcaaaattgagtttgaaaaatcaaatttcggttttggatttggttttggcttattagtgtactacaatgaggttgtatctcttaataggtcctcaaactttgattatctttctcttgtttcttttcttgatgcctcttgttcactctattaaaatgtaatttttgtgacacaaatggtgtattggtaaagcaactcattcttttgatcttgcgttatcttacctgttgttctttgtatccagtactttatatatgtatgtacagtgcactgagttggaattgtcttgggtttgggataatctatgtattaaatatgttccccctggattcacatcctcattataggcacttacttgtagggtagtaggagggtagaactcacataccagtgattacaataatgacattatggtagaggatgtgacttagtaacattatgcctaccctcgtcaccgtcgtcacggcctcctcgtcttcctccccatctccttcctcctgagccaccgtatctctacttcccctgccttttcctatccccaattcacctatggatggttaggggtggaatatgttggaaatttggtcataattcggcatattttaatccaaaataacaagataataaacatgatatttacaataggatttgatccagtgatagtggtgaatgtaatcaacatgagcatgcttaacgttgaataagcatcaacaatcacataatgacacaatgttgacattgcgatgaacatttacagtaaaacttctaattgaaataatgtaataaggttataccccaagaatggtcctccgctggagtttgaggcagtattgcctccgttggtgttgacaggagtctccttctccttgtctccagtgttcgacacgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaatcaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttgaaatttatttgatttaattgatttaaatagattaattacccaattaaatctaacagaatacacgccatccttcctgcgcacctccccaacatcatcctcgtcggcgtcatttgaggtctgggaggactaaatctggtaattgcagcatttgaaccgacggccacggcaacgacgacgtgcactcctattgctcctctccataaccagctagcggatgctaatttctctcacgttttcaggtcatgtgcgattattcagcatgagaactctacagtttgattcaaaggtaaattgtcaaaactgacacaaaaatctatttaaatggggatattatactgcatatgttctgatgattggtcttaacattttgcagttaatcaaaaatgttgctccattagatggattttacatagaaatttttacaatgctgatgaagataaaatgatgagcagttactgtaagctactacataatttgccaagtaaattaatgaaattggtaccggatgcctaaaattactgattaataagaaacatgatgtcaaaatagttgtcattgagtaaaaatcagatcgacacatgacgtatatgtacctattttgatatactcaatacattcctaggcatttgatgtgttcaacaaaagttcagatggcaaatatcacagcaagcataataaattgtcttatattaacgttgtatcatatcatatcatggtagaactgtcttatattattatacaaaaagggtagaactgtttgatagatatattaggcagcgttaatattgccaagttcacagacatacaggttgactaatattaacgctgaccatgatacgatttttttttttggataataacaacgcttttcagataatgaccagtatatttgtaatcaccttagcttactatgtacaatgagtcatcagattgcctcattagcccaaggaaactaagagcatgtatcaagtacaatctaccaaggaatttgaaattgataatttttttccaacggtgaggcagttgccgaagttttatataaagaagaagatgtctcattttaaacagaaaacaagatcaaaccttacaatttgaaactgatatcaggaatgtactgcaggtgatagctacagtagagacccaaggattactgcttctcacagaaatattttatggctacccaagacaagccccggcccccacctcttccatgaactgtgaagctggtggcagtgctcctgcaatgctacatgactgccgcgaatagcatgcagtaccgtaaggtgatcaaatccttctaataaacatttttactgtatgttgctattaccactcgctatgaccaaatttaggtaacgaagaatgcaagattggttcacaatttcctcaaatctatggtcgcactgccctgtttctgaatttgatattttgattaaaatgacctgccgttagcccattaacctcaagaatttatgagcgtgaaaagacaccacctcttctaattagttggaatgtgcatatttaaatgtttctttcacaaccatggattttaatacgagaatgatagctaccgggcgaccggcgcgggggagccggatcggacgctccccctcctgatgcgcattgtctccctcctggccccaccatgtatctccaccatatactccattgcaacaaatcacacacatattttggaaaccctctattaagggaatttggtttattttttgttccacaaaaaatgtttcatctagtgcactcacaatgtttcactatgtatagatctaatgttgcagtgaactgaaatactccattgcaacaaatcacccacatattttggaaaccctctattaagcgaatttggtttattttttgttccacaaaaaatgtttcatctagtgcactcacaatgtttcactatgtatagatctaatgttgcagtgaactgaaatactccattgcaacaaatcacccacatattttggaaaccatctattaagggaattcattttatttttttccaccaaaaatgtttcacctagtgtacttataatgtttcactatgtatagatttaatattgcagtgaactgcaacattttttcgcctatttgctgaaacattgtttttatataaggtgaaacaacacccgatttaaatgagtgaaacattttcgatctacttagtgaaacaattccgatatatctggtggaacatcgtgcaacatttaaaaataattcaatagtaggctaatttttttttcgtcggaatatatccatgtgtagtcttgttttgaagatttaattgcaacaaatttagtggtgcaatcgaatcatgatttggataagtaatttaagagaaaaatcagtttaaaatagttttgcacgcatgcgtggcgctgacgtcatgctggcatcaacgcccgattttaaccccctctcgtcagacgcccgagccggagtcgcttccattttaataactgagactggtattggaaaatatatacatggaatggtcattgaagagtgaatcatggaaagtcttaatagccattacgtatgattcatctgagattgtatatgatgtactggtgtttttaagctgaactgcgtacatctttatcttagattaatcaagatcttcagacagcatcagcggcatgcatgaactgcatcatcctcagattaatcaagatattcagacagcatcagtggcatgctgaactgcttgctgcaagcgtcacattgccacatatatatttgttgttccatgtgaatggagaaatggaatatatgatagttgaaactttggatgcctgatgaacagaagtacaaggtgcaatataatcctttctcatttccctgtttgatatgactcttaacttggaggactgattaatattctactagcataacagaatttgggtaagagaactctttgacgcttgaatacaagcagaaaagatcagcataacaaacagcctgtgacaccgtggactctaggtttacttattctagcctcttagtagtcaatttaatttgcttggtatttaaagagcagaaccagtgtttggaaaataccattgaaattgccctgttttgaggatggcttttaaacttcagttttaatgtattatgtaagttgaaatatacaggatgaaatgtacctatatgcacgagctataaagcagatgcaccaatgaaaactaaggggagaacaagggggtcatgtaacatcggaagaggtgaaaacgcggcgactggtgcagcggtgaagacaatgaataataataataataataataataataataataataataataataataataataataattattattattattattattattattattattattattatgtaaacttagtttatcacgtggatgtaaattttgcaataaattgtggtgaattaatgattttttatcatatatttaaaaaagtaaatcaagctaaataatataaatataaatgacagttgtggttgcgcaaatgtgtgactataatgaaaacaaattcttcttcatctaatatcgttaatatattttcatataaataatgtatagtaggatggttacagacttacagtcataccaatgcacaacttcatatgcaatttttttgaacggggaaaggcgtatgacaaggttattgcagtttgtgctgatgatcacgagtacaagcattacaatattgaaatcaaggtgatcccacctcatcgcttcaactggatcaggcgcttcactagattacgtaatactccctcgttacctaaatgtttgacaccgttgacttttttaaacatgtttgactgttcgtcttatttaaaaaattttgtgaaatgtgtaaaactatatgtatacatacaagtatatttaacaataaatcaaatgatagaaaaaaattaataattacttaaattttttttaataaaacgaactgtcaaacatttttaagaaaagtcaatgacgtcagatattttaggatggagggagtatctagttatgcattctaaatgaattctacgaagtatgcaataacttatgccctgaccttaagcccgcaaagtactattagaaaatgtatttgatttgactcattgcagattccctaactcattaattaacataggacgctaccaatatcttgttcccgtacatgcattttctgaactcatgtgtcaactagggtcatgcaaatttgaaaaaacaacttgcctcttagattgaatggtttctttaaccgagacattattcagacaagaagaatgagagaacaaggaggttgctgtcaacgacttgcgtcttaattaagaggcaagcagcactccatgtgagtaattaactcttctaactccggaacgtacaacacggaaggcttgaggaggtgtacgtgtgccacttcctggatagaccgagaggatgttgacgaaaactttggagatactatcatcttatatgaactgctgtggtaatatccggtattaatgacatttaaagtactaacagcacaagtaggaacaacaaagagccattaaatattccatttatagccctcacctcagtgccactatgatacattggcgatacctcgaagtgtattctattgatttttttttttgttatctgtagttctgtagtactactaattatttgccaatgattgaccgagcacaaagacctgggtcgtttatctgtgaaatgaaaagcctcctcggttgcccatattccctaataagtcaaaacggcttattagggaataaaaattaatttatatttaaaacttatatatatttgttcgtagcgacttaaaaagccaacgctaaaaaaattacgttgaaaatatcttaagattaactccaaaatcaagtttgaaattttaaattttggttttttctttgacttattaagctaaccgatgaggctcaaagaaagaaacgccagagccaaggcacaaaatgtacatgaaacagtataatttcaatagaactagtgggattttcgcccatgtcaacataggacataaagaactttcttaacacaggaaccaattttaaattccagtatctgcattgttgggagcatctgtacattcaatctgtatgtgttctaagaaaaggcatttgtatgtgcattcgttctccaaaacttagtgtttatcagactaagagagctaaaaccatgcattaaccaaagtggcatagtaagaattatccaagtatgcagaaatcgagtaacaaagaactcaacatctgcaccagttgatagtcatgcacagaaatcataggcaacattttttttttatcaagggctgcatggccccatttccattactacaaatgtatcatagagtttttacatgaaaggagtaaaagagtgcagcaaaagagagagaatcatagagggtctgggacagaactactggagcagaccaccctctgctagccttggtaaaaaaacccagccaaaaaaactaccaggaatcataggcaacactttgagtcagtaactaaacaaattcattcatgtacagaaatcaggacacaacagaaatcacgacagagagccgaaacctcttcacgaagaatgtttactctaagacatctctgaatagaaactctggtggggtatttggggctttgccacccatcactcttatagtctgacggacctttcttatctcgtgaatagttgatttcatttcacgttcgaggtccttagaatcttcaagtgacagaccatgttcaacggcttccatcagagagatcatttggttgaataaatcaaccaaacgtctgtacttgctatcactgtcttcattcccagtaaggtaggaggcctctacatcaaatttctgaaaaatctgaaaaggaaaaacaaagagtcacatatgactcaaaacaatggggaaggaaatatgtctcattttatccaacgcaataatttgtaagccagcaatactttttattatacttttaccttttctttagggtcagcaaaccttcttttctcagaaggcgagggtgaattggaattgcaaccattgttgctaccatttaagttcccgcgctcccaaagttttcttgcttctttagcctgcagcagaaaatatcagctatgccaaaacaaaagcgctcgaatacataactaaacaaagtgcagtgtaaagaacaatccaatttatccaatgcacggcacaaatttatccgtgctcgcattttttcaagaaactgaaacagcaaaaatgttgctcacatcttaagagtacattaacagagagaagctaccaatgaaagagaacctacaaaccaagccatcaatccaaagggtgtagccagaaatagatgacgcctagggcatttcttacaaactttctacagtaatgagatcttaacagaaaacaaaagggacaaaatattctacacagtacagaaaaataccaaatacacatttcagacatcacatggtgtcaagttaacaaaattaagtagtcactgtaaacaaacaatgatcaagattccatgcaaacaggaaactacagatgtggtacatgcatagataatatgttataagaaagagcgaggaagaataactcttctgttcttagtcatgaactgcagtttaaatcatcagtatagaaagtcaaaacataacaatataacaacatttacaactaaaacaccaactaatttctaagagcattaacacaacccaaattaatatatcaaatgctataatggtcagaaaggatgaaggtttacatgagcaacgttcacgaacatttcatttcaagtttacaagaaaaatttttgactgactgcccaaattacataacaatatgagcagagaatcagtaattaagaagagcataaacaagctaaaacagagcacaaacattagacactaaactaatttacagataactgcacccttccatgagtccatcaagtctttaatagacaaaagattgtagcaaatacaaatttaccaataagtacacattaattcccctcatgtaaacacttcagtttcacaataaaaataagaatacacgtgagtaaacagtatgacgagattattcttaaatagagcaggcaagagatacaaattagtgaaattaccaacaaaaggagcagaagggtgctatgaaaaattaagagtccacaggtagtagaagaaaccggtggactatcaacaaaacaaaaggacagggcaaccatttttgggccgaaattttgttctaaaactgatctgacgctaccaaacagatacagaaacagattgaatagaaatgcaatcccataagccatcaaaacaaaaggaatcacaaaaatcctaatgcgcacaggccgctccccaacacagcaaatttactagaaaaaaaaaatcaccatcggagccaacgaggatgcgcatcctacagcaattcatccaaatccatgttcatctagatgattcgaaacgaacgaagcaaaagaacgcaagatactgaccgctttggcaccctccatgttcttgagagcgcgagcctctaacacggccgcgcgtacagccgccggaacgggagcaccgagaaccaagcccgcagtagcctccaccggctcgtggtccagtacaacgacgtgctcgacgtggacctcctcgccgtgctcgcggcggacctccccgcccggcgcgggctcgacgtggacctcctcgccgtgctcgcggcggacctccccgcccagcgcgggctcgacgtaggcctcctcgccgcggaacaccgcggtgagcgcgcagtcgttttggccatcgagctcctcgacgaggacctcgtcgggtaactcggcggcgcgcttgaccttgacgtgggcgccgcagagaacatcgacggtgatctcgcggccgacgtagtcctcatcgccgcggaggtagttcacggcatctccgaggtcctgctcgacgtcggcctcgccgaagacctcctcgctgggcacgcgctcgacgtgggtctcctcgccgcggaacaccgcggagagcgcgcgctcgacgtggggctcgccgcggacacgcttggacttggaggggtcgttgtagtcgccgccgctgccgtgcagctcctcgcggacgggctcgtcgtcccggcgcccgccgccgtcggggtaacccacggtcccggaagcccccgccgcgcggcggacatccgcggtggcgctccgcttggcctccacgctggctatccccgccgcgcggcggacgaccgcggcgtgcttgtccactgcaccggaacccaccgcctctccattgctccccttgccggcgccgccgctctccggcaccgccatgacgcccgcaatccagacgagaagggggattagtcgaaggcgagaaggggagggaacgagccgtggacgggggtggtgggtcagggtggcgccttggcggtggcctttatatcctactagtaacgaactggagaaccctgcctgaagcggctcttttcaccaacttttgtcaatttttgggcaaatattgagaaaacagatatttgaatataaacgttccaaaatttcatgacaaaaacgaatttagactaaaaggccattcgacagactgacaaaattgatcaaaactcagtcggtctgattgaaaattgaacggtctactcaagattctttcatttctgcacaaaagtgttaaaaaattgacaagattcgtggagaagtgagatatttcatggggaaatgcatggttggaaaaaaaatgtgatgaggaaagtttgggagtaaaatgtgataaatttggtagtagtggctaccctacctgtcacacaggtaaagactaatagtgctaacaaggcttatgaaatggtggtgtactaaggtactactccgtacttgggagtctaggacaggtttttgtcatgtggtgatttgttacgtcatgtggtgatttgttatgtactactacctcccaatttttttaagggttaattcgatccatgcaaatacaaattttctatttgtttaattattcgtagccttgctactgaaattttacaaaattataaccgtatcactctcgttacattttccatccatctcctcctttgcacgtgggacccacctatcagatttatcttcttccttttaccctcccttatcttcttccttccccatcttagtgtcacagtgaggagcgaggagcatagggagaacacctcgatggcacgggcgacgaagcttttgttctagtggaggtcgcaagaggtggtggcggcggcgaaaagggaaggagaagggatagcagggaacccgacccaccggtgcaagcctattagtcgtcgtctcccttgaggaagttgaatggcggaaatggtagaggaagctgacgaggccgagcggctgtgagggagagctctcccaagtctccatcaagccctcaccttcatcttccccctccctactttgctcctcttcatgtcgctgtcgcttgaagctaacagtcatctctcacaccaaatctagacaaagcttaggcaaggcggcactaccggcgatggagcttcggcgggttccacggcagggaaactcctccgtcaccgccttcctcaccttgtccggccgcctgccccacttcctctacacccctcatctccgtatcgcccttccccgtcgtctgaacagtgaacgcacaagcaccaaaaatctttgatgttctaatatggaaactcttaccagaatcagttatgaacttatcatcagatcaggacgagatctttttaatgttctaatatgcattctgacttgcgatcatagttattagaactggactggaccagcggtccgaccagaaaaaactagaaccagggcgccggccggtccggtccagctaaaagatcggtctgcaatcaaaccggcgagaaaccggttgaaccgggcggtttactgcagaaccggacaaaaaccggtgtggttcgaccgctggaacgcgtcgcatcacgtgaagttggagagaaatacggaaaaagctgcagaacttgtgattcgaacccaaaacctccatgcttccatggagagcctccaccactagtctatgcggcttgttgtgaaaccaatataacaaacatctatttgaacccgtttaaaccggcggtttgaccggtccgagcaataaaccaatgacccgagtgccttaccggtttgatcaccggtccggtctaataactatgcctgcgatctgtccctttccagggtttttggaacggatataggagtaatcagttcatggttatgtgggagatgccgcgtgatcatgcatcgtgcatgcgtgcacgtgccagtgtgctttcttcctgtataccggtgttaccgtgaccgtgacgcggaccttgtttgtgatggcgcccggcatagcttctccgtccgttgcgttagctttcttctgttcgatcgtctccaagtgctagcttctgctgctcctgctgatatgtgatgcttcttgtgctggcttgggtttgattggaaacgtggcaatccaaccaattcttaacagatgcgacggcagcactcgggtgcaccggcgtggcacggtcagaggccggtggtggcgttcttgcctagtaaaaaaggaaaacatggggttcggcgttttaaactagctacgaaccccccttggggctcgatcaggcttttgtgcgcagctgatcaagcggcggtcattgacggcatcagattaagctcgttgtctctggtgttcaagaagcagttagccgcaattcttgattggttgctagtactaatagttcattgttgcattcgtccgtcgtcgcagcgtgcgttcctcgtctggccgtctggtctatttgtgcggttgaaccggctgtcgactgtcgtacgccatgctagtgtgctttcttcctgtacgccggtgtggccgtggctgcgtgggcgtgggtgctcctcgtgtgcatgtgtacgcccgtctgcgggagacgagggtttctgaaccaggagacgcacgacgcggaggtgctccggcgaggccttgatgaggcggtgaaaggggttcggcgaataaaactcctaacgcccttggatctacgcgaccagtgatgagctgagcacaaaatgcgaggggaaaccggctcatgttgaaccgtcgcagggcgaggccacgatggagacggtggcacgggcagaggcatggctgtggtgttcttactgagtaaaacgtacgggcagaggcattgacgccatcgttctcgtttgtgtgggtcgagaagagcgttgttctggacgccagtaccgcggcgtgcgtcgtcgtcgtcggcgcgtggcggttcgtcgtagcgttccttgtcagggtgtgcgatcttgcacgttgcgcggctgcgtgctcatgggatcatggcgcgagcctgcctgagcatggtcgcgaatccggctgtcatgggcgtgcgcggcttgacgtggcgtggcgagaatcaggttcacatcactcgctgacaggatcaccatgacggcagcagccagcagggttggtgcttcttcctgtatgccggcgcgtgtcggtggccgcgcgcgtgggtggctcctcgcgtaccagcgcccgccggagatgagggttccgatcgaagcagggaacgcacgatgcgtctctcggaacccactgcgtccattgatctgccacggcccagatgagcacagtgtgcgattgcagaaaccggctcatacttatattgtatgagtgctatcaatttttttttagaatttttcatagtaattgtttggatggctttaaacaaacgagcgacattctctcgagggatcaaaattgtttcctccatttgcagcttcttcttttaatcatgtatattccctaaatagaggaacggccaatatactaatcggcagtgagaaggatgaaatgagcagaggcaaatcttgggtcgcatatagtcatccatgtgaatgttgttactaccagttagctgcaattcttgattggttgctactatgcttactgtggcgttcgtccgtcgtcgcggcgtgcgttcctcgtcgatctggccgtctggtttatttgggcggttgggctgtgccacggcgagctgcaccacggcgatcatgccgctgcgacgtactgcgtgcgcgctcagggcgcgaaccgggctgtcgcgcgcgcgcgcgcgtggcgccgcggcgtgtatcgctcgctgacgggattgccatgctagagtgcctctttcggtacgccggcttgggtttcctgctcgatcctcgtgttaaatcattgtcataattaatatttatgatgaacaattggctgtgcaaatgattttatcaaagaattggtttgagagatgtgtggatgttggtgtgagtgcgtgtgactaatgtgggtcaggttgtgatatctgtgcccagaaacggttgttttgtctgattgtgtgcaggtgacttgaggtcagccttggtcaatggtgaggaccgggactatgctcagggaggagcagaggtctagtgcggtcgggataccatgtgagaaggtgactagagtctggattcttggaggtcaacttcggtcaacggtggggatcggaactaaactcagggaggagttgaggtccagacggtcaagaataccgggtgacgaagttggatatgagatggcacacggtggatggacaccatgtgggagagatctttacaacgggcttcacgaggtgtgcgtgcaagtgccggtgttcgcgaaggagattggagtgagaaatcgagaaaagggtatatggtgctacagtacacgtggtactgtagcatgcatatggatggtatcgatgca

SEQ ID NO: 49521 - DNA, 30121 bp, Oryza sativa
  unsure (1)..(30121): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccaagttggcgtgtctggaaaacctaactctgcaaatttaagcagaacggtgtaatttccattctcaagtccaaggccatagtatctcagagacgacggcgacatccttgcagtttggaatagttctgaatccactgcattctggatcttctcaccactatgtattatcttactgtcatttggggcctggaataattttcctacattactaacgccccatcttgtttgacttgtaacataatatgatgagtccccaaggtttgtggaatccaattcgtacatagtattatccgaaactctgatagatctattactaccacagtctaccgcaaaggaataatctgcagtcatgacgtgcaaaattataatagtattagaatttcaagacccaatatatcagctgctatggttgaggaaaagtgagacatatacattttggagaaccacgaaaacatggagtatcttcctggaggcagtttagccctggaggtagcatgctgtggagatagttgactcgaaattaaaagtggtgagagagaaattagtaaaaacttatgaatgtacaaataaatgccataagtacccaatgttggtgctgccaagaataaagttgtttgccaccaaattccttgtaaaaaataaaaggttgagtataacatattttttcccttggaaacacaaatttgagaactttcttcttacaattgcagattgttctgggtaacccaggagggaaagctaccagtgagctggttgtatgagaaatctctgcaaacatgaaataaatgcatcattctaattttagctgtattacagggatgaattgtttactcacaagttcgttagcgaagggcttatcccatctggcaattctcctgttaggctgttgttgccaagaaacctgagttggaaagaagacaagatgatgaaacgtggtcatcaattataacatgtgtttcagtagatagtaataacccccagaaagaattccttacaggaatataagcttttgtagattcagaattgatttaggaacattccctgagatattgttaaaactcaagtccctgcgccagaagacagcatacttgaacagacacttacatgaaatttaagaaaaattaccaaaagtttcatggactgtgctatgacccataatgaaaaacgtacaggaaagttaagtttgcgaacttcgaaaaatctactgctccaaggtctccagatatcttgcagttcctcagtacgctgtaaaaaaatatttggtattaacaacttatatctttgtcaatatataaaattgtaagatgtatagttagaatttaaaagtgtcacatacagggtatccagagatgtcagactgctgataaaggccaatgaagagctcccatttacaatatcaccaatccgcctgctcatttgtgtttagtacaccagttatcgtgacaagaggggatgacaatgttgccactgaacgaagtacttacaaggttgtcaatttggttagattagacaaacttgctgggatcggtccttcaaaagaattaccttggaaagccctgtgagttcataatttaagaaagacaaaagttgggagatttaaggtccattagaatataggaaaaagtaacatctacatatcaagacactgttgaggtatgcgcatttcttaaaagtgatgaccaaacagaaaaaaaaatgctacagtttgaattaaaatagatagaacatttgcagaaaatttctgttgcaattccacttgtcttgtggtaaggataaaatcaatgatgtgttaaaaagctaataataaatcttacagatcttccaaattagacaagctcccaataaaatcaggtattgttccagtaaaattgttatctgatgcccgcctacaagcataaaaacatgtttagtgttgagcatataaaaacaaaatgaacatgaccactgtggttctgtttcttgaacttacaggagttttaggttcttaagccttgagagcgtagaagggaatgggccactcaacccagcactatcagtatacctgttattaaaacaatgcagaaatcattgatgtttaactgtaagtatcttgctggtccaaattaaactttgttcttctagaagtagcatctttcaagttagaaagagggggattacaaacttacaattgtcgaagtttggtcaagttgcccaattcttcaggaagttgaccagaaaaattggtcaaactaatgcctctgaaacaaaatgaaatatttcaggagtgatataatttagaaacttacaaatatttaagtttgctcaagttgcccaattcttcagggagttcacccgtaaaattggtcagactaatgcctctgaaaaaaaaaaaagctcaagagtgatataatttccgtgcatgcaatgctactagttgagaaaagtagcattgtatgtgctgacgagccttttgatccacaatattcacattttggatttcacacaaatttataagacaccatttgaaaagtaaaattacactggtgcttaaattttatttgtgattttctagaaatttgtagaaagaacttatgcatctagatttttccatataatgaaatactttagaccattattaatctgtgcaagaagggaacacttacagcaaattgaggttcgtgagatttccaagttcctttggaagtgatcctgagagtggattgaatcccacgtgccttttttttattacaaaaggaagaaggatgattcaaacaaaacactaactaataaggacaatgcaggaaaacttaaagtacaactcttacaattctgtcaaggcagtcaattgcccaatgaatgatggtatggggcctgacaagtaattttgatccaggttcctgaaaagaacaagaaacatcaagtcaattagcagcgatgaatttcaaacatgaggttcactttgaattgatgtcttgctgcaagatattaagaatatgtagtatatatccaacagtagttcatcatcaaggcagagccgagaaaagctagataccatacaagtaagttaggtaggtgaggttctgcaattctgcaggtatctgaccgacaacgttcaatgcgtataccctcctgaataaataaacaaaaaaagaaaattattcacatgagaaaaatactccattcatcccaaaatatagcatctagatttcaaattttattctaatatagtagcaatttagtacttattttaccattgaactacccataataacccttggtttaattatcatcatgcccatgcctcatctccccaaggcaaatcaacaagtccttttacctgtctccttaatggctgtgataagagctaatttctagagaacttttacggtacaatatactaccagtatatactggcagtatataaaagggcatattaggaatttgatagaaaataaaacaacactttagtaatttttggtttaaattgaatctaattgagagtacccggtcctggatcttatcgtgcactaggggaggagcatcctgagcgccatttgatgacaaagcacgtgacgatagcacgatttgattatagaataaccaagaaaagacaaaattaccctttcaaactttatattgcaatctaattaaataaaaaattaaatcaatctacaccattagatcatatatactttttactatttagtccaatatatgagctaactcttgaccaggcacacatagacagccctggtcccccacagaaaaatgggaaaaatacacacacacatcccaacaatattgtttggtcacagaaaatctgcttgggagttgggtctaatttctactatggttgcgcaccatgcgtagaattacaaaattgacgattgattagtttgatctctccagggctgcctggacttactcaaccggatcccagccagatccaactataatggaaggcagatggcagctgtggaaggttaagaactaaagatcttgcaggaagctgaacctcagattccagtacttggaccagtgaccaaagagcagtattaacaaaaaccgatcggtttttttaaactgcccgtggtcagtcatttgtggaagccaaacggttttagctggttttcgtatggcgttgaccaaaagtcatccgtttttgccgggtttcagcttgtgatgatcggttttcaatttaaaataaaatggtaaaccctgccaaagagatcagatttttctggccatgaggcggggtggggtgttgaaataacctggtttcccgattggaggagtaaaaataaaatacaagtcatcatgctttactcctaaatgaaattcggacccacaacagaatttcgggggacataaatgaggctcctctattcctaagtagtgaaactgaaacctgtggtcctatgcatatgctcaatggtgtggtcttgcaaaagttgcaatttcttttctttttctttttttttgcgaggatcaaaagttgcaatttcaagttaagtttccattagaacttatatatccagacgccaatggcctcctgttcccgtaggcactgcgtcgagcacctggtgtgcgtgcagatgaacagagccaaggaagcaggatgggagcgtatacgtacagctgggtaatatggcagacggtgccgctgttgtaggaacagtcgcacttgatgccggggttgttcttggggttgccgtcgaggtcggtgctgccgtcgacggggacgccgcggcatggctcgccgctcatcctccacagcggcgacgtcgtcttgccccatctccccaggatcgcctccagcgccgccactgcaccgaatgtatagtaccagagtaataataagtacaataattaagcttcgcattgcattgatatcaagactaattacgtgtatatatatatatatagcagcatgatttgattacgtgctttgattataccttcgattggatcagttgttgccgcttgctgggcatgaacagcggcgatcagccatgaggagcacatcacgagcaacacccacaccagcttaccactaacaccacccatctctctctctctttctgctgccgaaacaacacggaagcttgttaaatatatagatggtgtgtttgtacgatgcaactatatgcaaagggaggctctgtattttagggcgctcatacgtactctctacgtctcataaaacaccaatctaaaataggacgagacataatttagtacaacgaatttggatactctctctgtctgaaaataattacagccctatagttcaacacttattttggaacgtagtgagtaaaaatatgtccaaattcgttgaattagattatgtatcatctcattataagttggattttttggacggagtgagtagatgagataatccaaatagttcttatcatcactaccttattactaggaaaaatgtctatatttgacgctctttcggattcgtagtactcaaattgtctaattagctattaggtttgctatattttagaatggatatagtatttgtcatcacttcttaataagaattttattaagcagatgaaaatatttgactataacaatgtgagtatctaagcatcaaaacattgtaaactacaaggtcacaaatatgcgcaaaagcctgcttacggtttatatttatagtgtgaaattgaatatgatttgtgaaaaaaaatgaaactttcttatcattatattttataacagtgtttattatcctataactaaaagaaaatcaacggtagaaaatatgaacaggcctataaaaattagccatggagcatctctagcaaactaccaatagtcactactatatagtcacgttgttataatccataggtatctgtttcggtgccaacagctattattcaacaccaataacttggatcattggacatatgtgacaatataggtgctaggggtgcaccccttatattagtgctaaaaacccgaaaaaaataatatttttattagggacctatatggtcatatttaacttctcacgagtcacatgactttttcaacccatattcatgggcatgcttcaagcaatatttgaactcaacccacctctctccttctaagcctccttatcatctaacctacaaacgcttataatctataattaacaccatagataagtcttgttgagatctacaaatttgatataaaatttatgttcatccgattttatatgaaaaagttagataaaaaacacacatatacgagttgtgtcatcgtgccagttttaaacgtaaactagcacctatgggcttataagtgccctttttttaattaagaattggcacatgtgtgatgcctatatatatgtcggtttatgataaataaaaacctatacctataacattgcacttatagatgctaatttattataagaactcgcacctataacttgggggaatattggtgtcggtttttattacaaactggtataaatgagtggttataggtaaaagatggaaaaagcttcataggtgatatggttttaggcaaaccgataagacaggtctctatgtgatgttttgtagtggtgaatgctatcctataagttgttcacggggaacaaatagttttttttaatgaactatttctttggtctgaaaataaatttatctttgcttttcttgtttgtcctaagtaagttcattttgagctatcattgcattggactttgtaaaagaagtggacaaatacattgtaatagataaagtgggaacaattacattaggattcggtaagttggaggatgttattttgctttattattggtatgtgtggatgtgtgaaaaatgagcttattatggaaggaaggtagtatttagtttcgaatgggggcactactttaaatgactacgaagaaataatctgtcttagtgttttctttatttctttttttttcccatgcatgacagttgacgtggggtgggtggacagcgatcaagtcccttataaacgaaagaacaataattcatactctctgtcaaaaggacttgatttctagccatccaaaatttagtaataagaagtaaagagcaatgagtttctcgttaacactatagtagtattgctaggtgggtatataggcaaggtgtattaaagggataagagtcctttgaaactcttcgttttgtgaaaaaatggtaggcaagagactagaaatcatctcgacacattagaaatcaactccttttgagatacttttaaatatctttagtctagattactgttaccaaccagtactaaaaattaaattttagtttggattagtcttactaaccagagctaaagatcatcaagcattagtatcggctggtgttaccaaccgatactaaagatgtactcttagtaccggttggtaacaccaaccgagactaaaaatatttccaaagacacttttagaactagtactaatctaactaagatattggtggttttgtgtaccacgacgaaagattagttctccaatagtgtcggaaaatcaaaaaagaggcaacgtgacctttggacatgacctgatccaaagaatcaattgaaaatatatactagtacgatggtgccacatgcatgtgccggaaatatgaataagcacttgtcattaaaatacgttgacaccaattactttgtgaaaagactacatttatttttgaagaaattaatggaatccatttagtaccaaattgcccaattggcatgactgccaccgcacctactggcactgctatcatactatagcttagctactgcattcctgcaactgatcagaggagttaaactactgttaactaatcagttccctgttgtcacgaaggtataccctccctcgcatccgatccatgcattgtgtccatatatactagtaaaatatttaccaatacttctgtagtacaaccgatgatatttaattgggtaaacattaaagtaaaacctagggctaatcaaacataatatgtatacggcatgtctgcatgaaagacaggggttttctctgtcctcaattactgatcccgcatgattttttttcccgggtcagcagaaggaaaaagatggaccaaatttcattaagatttatagaagctttttacatgagtatggtcctataacattaatctgccgagttgagagtggctcaacactctcaaaacatgtaaacgaaagacaagaaaaacaaaggtaaaggtactcctctcaggattgaaaaatttcgacggacttccaaatagagatttcttcgttcgcatcactgaccagctgctccggccttttgaacctgtgttcaaacactcttctgtttcgctcttttcagaggagccaacacaccatcaagaagagtgaatcgaacgccatcttgtagcttgtccgaaaatggcgacgctcctgctgccaccaatctgcgagcagccagtcgccatggcccggagacggaagtccaccctaatccagtcccgaagcaaagaccaaaccctatattggtgtaggcacattggtgaactgcaggttgttgcagtcctcgaagatggcgttacagagggcgcaaagctgtttcgtgtggccacttaaattcagatttttacaataccattttaaattttgaagtataaaccggtccctgtaggttttccaaaaactagcaaaaagttgatatatgatttttgatcagttctgtataaaagccaggtaaaactgctcggattcagaaaccggtgtccaacgttttcatgaaaaccaataaaatttcatatagttttcgatcagcattgcaaaccttgcataatttcatctctactcgggacatccatgtgtccaggccggtaatctatctagctaggtcaggggccgggaggagctcgtctacgcccgtcattttcccaactactccctccatccaaataaacaaacttatgattagacgtgactaatataataaatatggatagattcttagctatccagattcatggtaataggatatgtcagtcacattaattttagagcaattctacggtccttgagtaggtaccatgaggtaccaaaattttagtgtaaaatttggtaccacctcatagtacctaggtaccacgaggtaccaaatttacaatagaaaaaatggtacctcatggtatctcctcaaggtccgtaaaattgatcttaattttaggttatttttttaagatgaatggagtatgttaaacataaaggtaattagcatgttaccatcatgggggcactgcacgctggtactacgacacttgagctagctagtactcccatcgacgacctgagggttgacgcgaggtgtgcatgcatgtgtcatgctatcaaattaattaacaaagcgacactacatacggcgtacggctatgtttggccgcgtaacgggagtggttagttgcaggggagaggctctctctggctgtgttttgcatagcataactatactttctttatgattgataaacactaacaaatattagaagctaatggctaacatgtaaatcgatcagctttacatatcatcattcattaataattagtccgtactattttagagcattttaaatcttatgcaatatacgtagagcttaatatataagtatgtcaaatcatttttctcacatcattttcacaatgtttcaaattttatcatttctataatatttaacatatattcatccataaatttcgcagcaaattaccacggggtgtcacgtagtaaatatatagatattactctgcccgtgctttttcacctgtcaaaatgcacatatttttatcgatagctactaatattttgcacaaatatatttcttattatatatttgtaaaaatgtattggaaatattaattatatgagtgcattttcataaaaaatgtactgatattattttaacgtatcaaatcttaatttatcttttaatttatgtctgatttaggattttttttatttcttgatcgtactcatctactctaaagattgtatctatttgtcgacgcaatgagtatgtatgaatattatttatacatattggtcgttggttcatatatatattaaaattttatcagaatttatacacagcattaaaagtttatcagaaattacgtgtaaaggtcgtatttggtactcgaaattactgtgcaaggaaaaatgtactttctttttagataataaggcaaaatgtacttttaatcatcctgtataaaaaccagataaaccactcggttttcgtaaaccagtctccagctctttcatatagctttcatgtattaaaaccaattgattttcatatagttttcagatctcctttcagttggcagttcatgatcacgtacacaacgatccattttgaaattaattagtaccaccaagtggcaggccagttgttaattaagcttgagtactatctctattccaaattaattgtttatttacgttaattcaaactttatgttgaaataattgatcataaagaagtattacttgtcccatcaatcacttataattcaaaatttcacttctctgtgtacactcagccatcattccacattgaactatacatcacataataaaaggtactataatcttttttctaaaaccttagcctatgccaaataacccagaacgataattaatatgggactgagagagtaacatatgtagcagaaaccaatagctccccagcgatcgatgtagaatgtaatatatacgtacgtgtactgcggccactctgttgaaatggaatggttttgctaggctgctagctagtactctctctgtttataaataatgcatgatgcattgtacttttagatattggtgttttatttacattttagtacagctattaaaaatattagtcaaggttaaaatatctttaataataaaacaaatccaaacaaaataaatactacgcaaatagtttttaaataaaacaaatgctcgaatgtaaaagtcaataacaatgtactaactccttttcaaaatgtataacacggttgattttcctaataacatttgatcattcgtcttattaaaaatttaatataaatatgtaaaagtataagttaaaattatattttatttgatgttttagtgacaaaaataatatttatataataatcaaacattacgtgaagagttaaccgcgtcatatattttaaaatagtgggtgtgcattttgaaattgagatagtgcatgtaagcatgaccgggcgggcgggccctgtacactgggacgatgacttgacctagttgaatcagatggacgacttgacccatagttgtagaatgcacacgtgtaacaaagtagtgctctcttcgttttaaaatataacaacttttagcctttaaaattatatctcaaaatataacaacttttttgtcaacattttcttcctaatgaatcacaactctccattatttgattttctcacctactttcacttcttatccaatcatatattttttctctatttaattctatctattttcttaataaacgtatcacacactaaaaatccttatattctgaggcaaaagtagtatcatattattgtttattaggtatacggctatatatgtttggccgcgtaatcggactggccgttggaaggaggctctctgtattttgcctagggatgatatatctgagaggaccgtaaaattgctccacatctgggcttgatggattactctatcccttctttcttcgcttgtcagtaacttactaccggttcttagcagcaaaattcaaatctaactatagatttatatttttataagtaatcaaaacattcgattcaaaacttttgctaatatagcttaacatagatttaatttgtcaaacctatatagatttgtctctttgtttgcttgatgtcgcatcgtgtacgtatagatcctcgtatcaacgtactctaatacccatactttccggtctacgagtatccctcgtcgacagacagcattgacgccaatatgccactagctagccatgaccactgaattataatactagcacgtatatagccggccgattgttaagctcgacctagctagcatgcagaagctgcatccacaacatagctacctcgtactaccatgagacacaaacaagttggccatgtgcacgcgtactgcagctagcgacactctttgttgaaatggaagggttgctaggcttcatgtaagcatcgtgagcagtgagcaaacgcttggtcaatcaatgacgacgacgacatgagctactagttgaattaagccgatcgacgacttgaccccaggccggccagatgcatgcatttactgtcatactttgagaagagctgtaatcgcagcaataagtactgaaaggatggattaattagtttacagccccattggctgatatgaggaaaatgcgaaatagcatatttacagatgaaaaataatttatgaataaaacttttatatatgtgttcttaacgatctaaaagcaaaggctaaaaaataaactacgatgaaaaaaaatctcaaaatcaactctaaatttaagattgaaaatttaaattttgactgataagtataagcataagtgaaaagatgaggccgttagtcagttgagcagatatgcatatatttcaaaggaaacttcttcaagccgacgaacatggaggaagtatttaatgagaaattaggggaaatggattctactctttcgatgggatatgttcccttgcaatgatggagccaagatatattatcactttcagcttagggcttgatgatgtattcttaacaaattattttatctcttaagagttaacattttgatagattttaataggtgttaacaccaaaatttggacaacagggatgttgggtctaagagtagggcttaattaaatcctagctgcccccacacttgtctacacccctattgtctcatgtaacctgacaatgtagagtatagcgatatctagtattaattccaacaaaatcaatttcaaattcaacctacgcatttgacaaaaaaaaagacaaataccaatgaatagtaccactactatttatatgggaatttgttttttatatcataatttgtgagttgagttttctatatcatatatatatatatatgtgtgtgtgtgtgtctatatatatatatatatatattatgtaatttttaccggggttgtctaaaaaatcttaaggacaattctctcaaggaacccctaggaaacgggagtaatactacttaagagaaatcgtaaatttttcatgaaattagatatgacaaatggacctaaatattcaatacaagctctcaaatcttttgttttagaaaaacaaaattttgagtttttgaacgacctcggatggagacatgctttgtatcaaaattatagagctcgatgggtctataactttgtagttaaaatttcttttatttgagatcgttgatgccaaaatattcataacggtctctcgtatctatatgtttttgaagatattcagtaggaagtccaaactttgaaacataattttaaatccttatagtatctcctttaatgacttttggccaacattttcttagtatatttcctataattgcatgtctcacaaaatgcttcatatcacccatctaacgtgagccctatatccccaacgcttcacctaggaaggtcccaccgaacccttctctctcatctttacttgctcactagacaccaccaacccattcatttctccacaacagctccaatcttatctcatctctccctctctctctctctctctcccccttatctctctccactatctcatcacgagcagtgatgaggctctcgtcctcgacaacggtggcctcttactctcatcctcgatggcggcctctcacgctcgtcctcgacgacagcctcctcagcttactcaaaggtggctcggtcggcctcggcttcctcaacggcgatgcggcacaacatcagtagccacccgtcctcaatggcaacgggacgagcttggccttggcttctttaatggcccacgcagagcacaacacaactgcagtgaactagtgccaagtctagcgatgcccggtcaccgcagaggaggaagtagttgagactatttttttcccattttttcaatatttaagccaatatgttttaagtgttcctttgtattggatcaaaatgttgcagtgagtttttgtgttgtttcatattcttttccttttatgggtgagatctgtggatgtttcaataattgaaacttgatgtttcaaatgctacactaaaatgttccacgatgtgatccgattgtgtttcaccattttaatttattaaaatatatatgttttgtttgagagctgaaacattttcattcaagcaataaaacatttttcccgattgataaaacatctaaaacattttcaatgaataaacatttttcaacaatacaatgcaacaccgatgttttacaaaatatcaaatgtccgatttgtagcaatcccccatgtgtcgtgctatcaaattagcaaccaccgttacatgatggtggtaacatatgactttgtttggccgccgcgtaactggaattaattattgcaccttggaaaattcttatatatattagctatgtttcaccatggatacacatgcatccgggcgtgttgatcagttactccgtttgtgctttttttcagtgtcaatgcacatatatgtagtatcgatttgttctaataatatgtttgtaaaaaatatatatattggaaatatagttatacatagcttgtaaaaatttgattctgccatccgttaggatttatcaacattctttggaaactattctggaacatgtaacttttaccacatatgtttactccggcaaaattggatttctcacacactatttggaaagatcgataaagggttaactaattaatatttatatcaactagcttaatgcccgtgcattgcaacgggaattaaaaagggaaccaactgtacattgtaaagcctaaaaaattaaaaaaaaaatatttgcatcgtaaaataaattttcattgtttgatggcttagggttgtgagactgtttgagggacccacatggtagtggactagtggtggtgggtggtggcagattcaccaccatcaccattggaatattttaaaagagtatggagtatagatactccacatcttgaattttgaagtactacacaactttcttcagaagcagtgatccctcttttgccatagactgaagatctttgctgcaagaaagccattgcccctcgtaggactgaggtccatacaaccttataactgtcacttgattcatttgccattcattttaattaatttatgcaatgccaagcatctgtgattacggaagtgtgctctagccaacaaattcgtcagtcatttctcaaaaaaaaaatcaaaactaatttaactaaatgaattttaaagcacccatgcaaatacaactggcatatacaaattaccaggatgacttggttatgagtatggaaaatattcagaacaaaataaatccatatatttgttgcaactccacaatgtccaaaaatatcacttgaagctaaaaccagaagcgatttgaacatatttgcattcaccttccatcatatgtgactccggttatcgttggagaaggggtgagtggggaagtctccctctgctctctaaattcaccagtagtagatccagagctatagttgctgcttatatagctggtgttccctcctctgagttgccactcagtgatgtagctcggcttcgtcaccatctcagtcatctcaatgtctccagtaagaattgccaggaccctagacattggtggtcgctggtgtggtgacccttgagtgcacaaaagtgcggcatagatgactctgaaggcttcctcactgtcaaactcatcgagttttgggtctacgattttgattccttgctctctttcatatagcccccaagcctagtataaattatcatacggacaacgtgttgattgtgagaaatagaatcagccaatgtattttcttggatgcaaagaccattgatcaacttacccattcaaagagatagatcttgtcattatcaagggaattgtcggtgtttgatcggccagcaactgtttctagagcaacaactccaaatgcgaaaacatcagccttttcagtcagatggcctctcattgcatactcgggtgccagatagccgcttcaaaaggtcagacgagataaaattagcttagacttcaaaggtaaactcataagaaaagaaagggtgaaatgtgcatacaatgtgccagcgattttcgtgctgatatgggtctccttttcatcatagagcttggcaagtccaaaatcggagatttgggggctcagatcagtgtcaagcaagacgttgctagctttgatatccctatgcacaatccgaatgctggactcctcatgaagataagttatgcctcttgcaatacctaaaatgatctcgaagcgtgttggccaatctaggttcaagctaccatgtcctgaacatggagaaataaggccttgagaattgagatgatggtataatgcagagaagaaaagttcttgacagtacatgaaaggaagaaggtcgcacaactgaacttaccaaagagtgcttggtctaggcttccgttttcgaggtactcataaaccaacaagggtgtgctgctgtcaatgcaacagccatacaatttcacaaggttcttgtgctgcacggctgaaattgttgcaacttctgtcacgaattcacttttcccctgatgagatgattgagaaagttgtttgacagctataattcttccatcaggtagcttaccctgtcaaagaaagatccctgagttacatacatattttgattttacaccagttgagttgcaaaacaattttagttagtacacaataaggtaaatcctcatagattgattgacgacttgtgggaaccactaaccttatatactggcccatatccgccttctccaatcacgttttgagaactgaaattgtctgtagctaatttcagttctgcgctactgaagatattaggccttccaaccaggttgtatagttctgcattttttttcacaacacatgagaaagaataactcatttgaaaattttggcacctaaagagctgcacttaaatgataccttcttgctgccttgccgcttttcttctcttctttaccaaaacaaagatcccaagtaaggctgctgatcctataactgacgcaccaatcactatcccagcaattacaccagctttacttttcttttttggaactccatttctcacagtaggagtaaaatctggacaacgtgtttcagtaatcagaaaaaaaaaactatcatacattcttcaagttaactaattcgggtactgagcttacttggagtgatacttagtgcagagatcatgggtccatagtaaccttgagtaggaatgcaacaagtgcctttgccagcccagaacagatgtatctcaaggaagttttttgacacagttgcgttgtatcttttgttaactgcaataaaagattttccgccagctgttttccttacatcgaagttcttttctttcagatcaccctatgcagatgccaagttggacaaacaaatatgttaataaagggtacaaaataggtaattgaattattgtactatgcgctcaatatgtacctggacatatatgtcaaaaactctccttccgatgctttgccaagtctttgtgtctggataagcaaactctgcaaattgaagaagaacagtgtaatttccattctcaagccctaggccatagtatctcagggacgatggtgacattctggcagtctggaacaattctgaatccaacgcattttgaaattgttgcgagctgtacattaggtaacttccatttggggcctcattgaattttcctacattgctgataccccatcgtgtttgccccgtaacatagtatgatgcagctccgagacttgtagcatcagcttcgtacacagtattatccaaacctctcacagatctattactaccagagtctactgcaaaggaatagtctgcatgcagttaagatgaacaaaattataaccttttattgaaaatcctgagatattttcttaaatgctaaaatcgatgaagagtgcaaaaatatacattccggagaaccgaggaaacaaggagtgtcttgctgtaggcagtttagtcctgaaggtagaatactgtgcgcataacagaaacaagaaataaaaattatgaggaaggtgacgtcaaaaataaatatttgcaaatatgttataggtacctatcgttgttgcttcgaatattaaatttgtttgccaccaaattccttgtacaaaaaaatacgtctaacttgtcaggcaataatttcacataatgtagagagtgtctaaatcaatatatatttgtctgaaatttcagaactttcaacttacagttgtaaattattattggtagcccatgaaggaaagtttcccatgagttggttgtacgaaaaatctctgcaaaaagcctaggattacgaacgtatgaaatgaatatatcattgcaatgctgaaaatcattttagcatacaaattatttagtgaggagctcttcacatctggcaggcttcctgtaaggctattgttcccaagaaacctgaattgagtttccattcaagacgatgaggcatggacattagcttaagatgtatttctataacagaaataatcgccataaaagaattccttacaaatatcgaaggctgttcagattaaggatggactgaggaacttcgcccgtgatattgttaaaactcaagtccctgtgccatatgtttagcaatattacttgagtaaacacttcacatgaaactatgagaaacaataactaataacataaatagtcagtatgccataaagacaaaacctacagcaagtttaatcgagaaagcttagtaaaatttactgctccaagattatcggatatcttgcagttcctcaatattctgaaacaaagaatatgttgtctcagaaaatactactccaatagtactttgcaataaaaaaaacaataatatctatcgttagaacttaaaagcaggacacatacaggacatttaaggacgtcaggttgctaataaaggccaatgaagagctcccatttacaatatcaccaatccgtctgcatatgtgtatttggcactattaagacaagtttggccttcccaacagtcaagggacaaatgtggccaaagaacagaatacttacaagcttgtcaacttggttaacttagaaaaacttgctgggatcggaccttgaaaagaatttccttgcaacctcctacaagttcatgctttaagaaattaggaagatgtaaagtccaccttaagatatacattttaacatcttgcatgaatagataaagaaaatgtaaatttattcataacgtagcatttatgtcgaagttgaggactaaaaaatgaataacgttgttctcttaattcaaatgaaaagaatacatacagaaaagttatgttgcaagatttctattcatctccttgataggatataataaatgattatgttaagaggttgacaaaaatcttacaaatcctccaagttagtcaagctcccaataaaatcaggtattttccctgtgaaatcattatctgatatccacctgcaagcacaacaacatatatagcattgagtgtatgaagacacaataaacataataactgtggctcagttcttgaatgtacaggatcttcagcttcttaagttttgaaattgtcgaagggaatggaccagagaagccagaactatcaatatacctgttattgaaacatagtaattagcatgttcaacaatatagatcttgcttgtcagttctttctgaagtagtgttctactggttaattaaaggggggaggggggagatttacatttgctcgagtttggtcaagttgcccaattcttcaggaaggtttccagtaaaattgttcaggctgatacctctgaaacaaaaggaaatagttgagtaacataacttatttgtctgcaacagtgttgatccataatatccaccacttttgagacttcgttgtttgggtttcagtatattaaacacactaggaaaggaaaatgaaattgaaatgattaagtaacatgagaaatcgtggaagggatatcttacaatgagatgagatttgtgaggttcccaagttcctttggaagtggtccagataatggattgattgctaagctcctttttaaaataaaacaagaaagaaagaaagaaagatgattaagagaaagcaccagcagatattggatggtacaaaaatatataacttggaatttaactcttacaagtactgcatgggaaatttgccaaagaatgatggcacaggaccagtcaagtaattttgcatcaggtttctgaaacaacataagaatcgccaagcaagttagacagagtacaaaaaggaattgtatacctgatttctgatatctatttatccgtgttttgtctggcaagtgacaattgaatgttcaaagaatgggactgaattagtatttactgcagaaacatcgttcaacagattgtgttcgatcatcaaatgttaagacagacatgtgttccgtcatcaagacagaggcataaagagttaggcaccatacaagttagctagatgggtgagtttctccagctctgcaggtatctgaccgacaacattcagcgcgtacaccctcctgcataaacatcatcagtaaaattcctctgatgacaagtaaaaaaaaaaactatatatgctttgctaaatgaattaggtgatagttatccaaattcaattcatcgtcacttgatcccagagcattcctgcaaccaccagcatcctaattttggaggatcgcatggcctctctctttcagtcaggcaatgcgtcgaacaccttgcctgcagctgagacaagaggtttgagttcaggggaggatacgtacagcttgacgatgcggcagacggtgttgttgttgaatgtgcagtcgcacttgatgccggggttgacgatggggttgttgtcgatgtcggtgtcgtcgacggcggtgccggtgcaggggtcgccgccggtgatgttccacgttttgggcggcttcgttccccatcgccccagaatcgtgttcagcgccgccactgcgttgacatttgcacacgaatccaatcaatttttttaccttttattctctccgttttatattataagtcgttttgatttttttacaactttaactaaatttataaaaaaaacatattagtttttttaaaaaaaaaacttattatcgaaatatattcgatcttagatttaatgaaactaatttattatttttaatgtttctattttttctgtaaatttgatcaaacaagtttatctacgaaaaaggtcaatttttaatgtttctatttttttctgtaaatttgaccaaacaagtttgtgtagaaaaaaagtaaaaagactttaatttgaaaggaaggaagtatgtgtgaagagaaaactagcaaaaaaacagaggcgagaaaacaacgtcagaaagagagaaaaaattgactttttaacggtcaccaaccacaccaaacagaactcctctcctccattagtcaacaaaacagaaacagcaggaagaagcaaagatttggatggtgtatcaaacttgaacttgatcactgaacttggaaaacagaagatgtctgatgctgttcatcgccgtaatgatgaaattcttgctctgaactttttcttttactgttcatcacaaaaacgtgggtgttctgacctttggtcttctcttcaatttaaaaaaaaaaaacagtaaacggccaagaaaggaacgaattaataatatccgaggaatccgaggattaactctcactgctaactgctaatttgtctctaagctgttgcaatttgcaagttgcgtcaattatatccatgctaaatgctacacatcaactcatcaaacatgtagtaagtttcatgtctctctaaagtcgcaaggaaaaggaaagaagatccaggcccatctctgaacctccaagaattagagacccctaaatattacagtttcaactgtaatctgttgcaagttgcatcaactgtacccatggtagatgctactacaaacaaggaagcatcatcaagcatgtagtagtcataactcataagccatgtctctctgaactccgaagtctcaaagaaaatggaaagaagagaggaacatgcttgtgtgcaaccatgaaaatctatgtcttttctccaagaacatctctccagcagaaaagaacagcggtgtctctgtaatctgtgaatgcatgtaattaactgataaatacatatatacataccttcgactggatcagttgttgctcctgccggcttctgagcctgagctcgagctactgcaacccatgagcacgcgatcaccagccagcacaggatgagctgatgaccaccatggccgccgctgctgctgctgctgcagcgtatcctcatcatctctttgcctctctgtgtctctgtgtcacgttatctcgctctgatcactctgtctgcctgtctgtctgtctgtctctctgctgcctaaaaatcgattcttgtgacaggtatatatgtacaaattaatgtacttttatcagcgtgtgtttctgggtttaatttagtgatcgatcacatccaccatcatcatatacatatcgatcgggaaggacgacgacggggtcgtccgatattttttttccaagaggcgaccttctgtggttatatcaatcggctacttgcaacccatcgttgtggctagtactgttgcactggactctaaaatgtacaccccggaagaatgacgaggtcatcgtccaatctctctcaaggacttgtgcatggctgggtgggtgccaatctcggtcctaaggctcagccactcaaccttgctgggacacagggccgtcccgtgaaattccggggccctgtacatatactctctccgtttcacaatgtaagtcattctagtatttcccacattcatattgatgttaatgaatctagatagatatgaatgtgggaaatgctagaatgtcttacattatgaaacgggggaagtagtggataaaccaaataacgtacacattaagggcttattcgtttctaagaaaaaccaaaggatttccaaaacagaggatttgaatcctgtatacagcattcggtttacaggattgagctataggaaatttgaagggaaatttccttttgtgccagctgtatcggtaaaacacaggaatttttgcatccagtatgacctcttgaaaattttcctggcgcgaaaagagcgcgccacgagcgcactgcgcgcgtaatcttttcgctctcacgacaaaaaaggtaggtaccgctgaaaggaaaataaaaaaaatcacaggaggcaaacagactcgcatagaagccatcgcctttgatcccatctcctctaccacttcctctcctgtctccacgattgggtactggacctcctctcccacatcgatcgccggcaccggatgcaccttcgccgcctaggtgacaggacgcaacggcaacaacgggaagagccacggcagagatcggcaaggacgcgttgattgcaggtttggtgcctcctcttccgttgttatgcatagatctgatgccccatgctgcttctttgcatacaccttagcatttgggtcgctgcggatggggtcgtagctgtaacacacaagggttcatagtgtctgcccaatggcaatcttgtttggttcagagaagttgttgccggcgggcggcggcgatgagcagcaacaagtagtaggcgagctagccctgttcatagtgtctaccgtacgttctgccgtacctatcggctgccgctgccatctgtttgtctacccctctgtcggctgctctcatcctttgctgtggtgtactgtggtctgctccttgattcgtcctgtgcttcagcgattgaccgctctctcatgatgagtattgaattttagggcttattcgttttaaaggattttttcattcataggattaggaaaaatgaaggaatagagatggttgtggagttcaatcctatgggaagctaaacctcaggaattgaaaaaaaaatgtgcattcggatacaccacaggagaagtgtaggaaatctgccatttgaaatatatttttttaagtttgcatcaactgacatcggccctcaactagctgttagctttgaagtgcataaatagccctcgttagccttgtgcaccattctcccctgttctttctatttgctcatcaactgtggaagaagcttgctgatcctttgttcttctcttcactatctgcataatttttccagaagctttactcatcgtctagccaccatagctagacgttacttgctcgtgtaacaacaaggtactacttgttcatctggtgcaccaaaattgttttttcctcagcaaaagtcttgatttttagctctcttctatgtgagtttacagcatcagtttggtagcatctgcacaccatgaatccaagctaccgacgtatatcagaaagtgatgatgagttcattcattttgttctgcctactttaggagattcatcacaatcatcttgtattaggagaccaatgcacacgtcaaaacttacagggggttgccgtgtacatgagattttaacaggacatgaaagattatgcaaaagaaacttccgtatggaggtcgacatttttcatgcactagtcaataagttacgtgagaaagagtacctaactgacacaatatatgtttcagtagaagagcagattgctatattcttatatacagtggcaaaaaatgcaaccaatgaaacacttcaagattggtttcagcatagtccagatacaatacatagatatttcaaagcagtgctggaagcagtcacaaatctcacatctgtctacattcgtgcaccatccctacacccacatccaataggggggcccctggaaaatgggaaccctattcggtcgctccggccgcgcgcccttagggacggccctgctgggacacttgagtggagggtggtggcgagggccaatgcctggctagtttcgtgatgcaaaccatacaacaaccgtgtgacaatcgcgatgaaaaagatagcatcccgataataatgagaatccgtacgcactacaacaaaaaaacatactggggagacgttttatgaatattgtaaaaaacattattttaatattgcattctagctaacaatgcttcataatgagttgtcatagttaatgatgagatattttataaaatgtctttacgcagcattttttttccacatgcatttttattcttataagattataattgtcggcaatgcactaaccatctcaacctaatctcatgacttgtttatctatgtgtcatgttgcttatatctccctatctagtataaattaacctcctaaaaatccctctctatatatatatatttaaaatatacctcgatgcctttgcatatgattgcataaaaatgcctcaatttagcaaatatatatataatgtgttaaagttgtctcctagaataaacaatatcataggtagaataccttaaaaatgtctctatctctgtatgaaaatcccaaatttagaggctctcctttgaaatttgccattagagaggtatatctaatcacttctttctatgaagctaatgcccactaagcacgtaaacctcagcatgtaagcatagtatttgtttgccctcctaaaatctacatgcaagcatgtcacatcaacctattaaacatgcaagcatatagtaattatatttataatttatttcattctaaaactaaacatgcacatgcaaaatcatcattctcaaatcattttcataatattacaatccaaatcattttatcatttctccattatctaatacatatatctgcaacaaagcgcggagcattatatagtgtttgtaatgacaaaggcaagtgcacatcacaaacagcggcaagtgtgcatgtgccttttttactcgtgctagtgcaaaatcttagactggatcggaaccagtgtgcagcttccaccataataaacctagccatgtcacctccaaccagtgaatttggaccaatctgaccccttgctttgtttctagaggctagatgtagccatatcacgtcttttcaattacacatttacagcagaaataattctatctactttttttagtccgtccattcagatcaattgtctcggaagagcatcatggagtaaaaaataattatctttaaacttttttaagtgagttgttaaaataattaacggtatcgagacctttatcgaactcattcatcctaataatcgacagaacaagaagcttctatcggtgcaatgtttttgttttgtttgttcttatctaattgttgtcagaaaagtttgaaggtaacatgttctctactatactagataacgttttttatagactctacattatggctgtgttcttaagtccaagttctcaacctcactctctcatttactgtgcgctcacttttcaaactgctaaacggtgcgtgttttgcaaaagttttctatagaaaagttgctttcaaaaatcatattaatccatttttaaagtttttaagctaatatataattaattaattacacattaatccattgctccgttttccctcacctaagaacacaacctatatttcttttgactagaaaaaatacccgtgcgttgcaacgggtgaagtttattttaatcttattattattatatggtttagttaagatgaaattcactgtaggagttctcttggatatatatatttttagaaaatcatgagctgcagttaggagagtccgatcgtctcaagttagcatgcgagttttttttaaaaaacagatttcttatatgattctttctgtattatcaaaagtgaacgatcttaaaaaccgaatcaaatacgaatatgtattttcaaaagcaaatgaacttaaaaaccgactcatacatggatgaagtaccaaaataccggcaaaaacatcttcaatttttataatagtggagaaagaaagtaggctagtagtaaccaggagagaagggattggatttaatctaatccatcgaattaaagggatggcttggattaagtaaatccacctggtggatttgaaggcaactccagggatccacaccccaaactatatgtttatcctcagctacgcaatattaattttaacatgatagtagcaattaagctaggaaggtttcatatgaactaagtgacgttagtagaaattaaattattagttgacatgacgttgtcaatctatcccattggatatgcacatgatggaaatgttaagcatttcaattttcccaggattaattgatgatatcaagtactttttgactcgatcggcctcgattcccattggatgcatgatggaaatgttaagtatactctccctctacactttttgactcggcctcgattcgagaatagtactggcacaatttttactacacttatagactttatatatctttttaatcgtatatttataaagattagtaaaagtatatatagggtccttattattcgtgaaaaacctattaatattgtttgtatataatgaatcttaactttttttatttcaagattttcatatttgaccatacatatctaaatgtgaactctcgttgtatgacttgtgcctatatgaacgacaaaaagatctctagctgaaggaacaagcagtgctaccaacagttgactataggctcattaggttcatagggtttttttcagtgaaatatctatgttgtgtttcctgaaatctcatgaccctaggaagattattgaatgctagctaaattatggagtaccatgttaattactatatgagtcaataattagataattagtacgtgtattggtcattcttgttctagtttgaccattgggcttttgaatggattttcgtaggattggtaatttctttgggtttttaactgtttatgtactcggttcacatgactcgcacgcaggaattttagaaaaatgccgtagcaaccatgtgaaaattatatgtccgcaatctataaatatgtacaactccaactttactctataaatatgtagcaacctactttggtgaaccaatctaaataattaaatttgagattactttttttccaagtggacaactaatgctgtggtttctactttctagtaccaattgggctacaacatctatgtaactaccacatagatcaacggataagtgttgagaaatcttgatagctagcggcccttaaaaaataaaaaaaagatttaattgaaagtctctaggtttctcaaacattattttatttatttatttattttctcaaacattaattactcgagacaatgtactctactgaaagagggcgactgatttggattatatgggatatatttggatgttgtactattgaagttaaccctgaaaaggacggaagtaccttgctaatagttgtcggtattattttaatttggctctagtttactcaaaatatagtactatctcaaacatttatttactcgagccaacatactcttctgaaagatggcgattgatttggatttgatatggatttggctctagtaaacaccgaaaaggactgcagtaccttaatttattgttactaattgtcagtattattataatttgctggacattgtgcttgaacgttagttatgttttgacaaattcaatggaacgcgcgttaggtatttcataacaccaacaaatatatatgtagattgatagtgacagaggatggcatttgagcaagtatcttgtctgaatattatttttctaaacaacaatcttgtctaaatattaataaagtttttggcaatacacacctgcttaattagaagttaatactccccctgtcccccaagatatagccaaccttgtttaataatgttatattaagcaacctactaaggtcatcgtacatgttttacacatagtatcactgatcgtatctctttttatatagggctttgatgggtattaatattttggttgttacaaacattgagttcgtcagaagtagcaatcccctcttctctgtagattagatcttcactgcaagcaagccattgcataattatgatccatacagccttgtaaagctgtccatttaattctttgttattttttttctcgaacgagcagaaaaactacgtatcactatattaagaaaatgtctaaaagactcctatacacccattaacattaggaaaaagtacgaattacacccccgaactatcgcggtcgtctgaattatcccccgaaccacaaaaccggacattcttcacccccaactatgaataccggacgaattacccccctcgacccaatctgcggtggttttggtctacgtggcgtacacatggcagttcagtcagcattctatttataattttgtgggacccacctgtcattcacaactctcttctctctcacttctctgtctttccctcttcctctctctctccctctctctctcacggggtcagcggcggcagccgcggcgcgtgacgcggcggcggcggcagcggcggcggcgcgtggcgcggaggccgcggcggtggtggctgccgggaggcggaggcggtagcagccggcacgtggaggagcggcggcggac

SEQ ID NO: 49522 - DNA, 5980 bp, Oryza sativa
gtccgccctcctcctctgctcggtcgtcgctgcgacgccgccgtccgccgccgctcctccacgcgccggctgctaccgcctccgcctcccggcagccaccaccgccgcggcctccacgccacgcgccgccgccaccgccgccgcgtcacgcgccgcggctgccatcgctccgtgtcccccgccgctgctgaccctgtgagagagagggagagagagagaggaagagggagagatagagtcgtgagagagtgtgagagagagaagagagaattgtgtatgaccggtgggtcccacaattttttaaataaatagaatgctgactggactgccacgtgtacgccacgtagaccaaaaccaccgtggattgggtcgaggggggtaattcgtccggtattcatagttgggggtgaagaatgtccggttctgtggttcggggggtaattcggacgaccgcgatagttcgggggtgtaattcgtactttttccttaacattaaggcaaagatgaaaatgcttctaaggtcttttggccaatgcaatacaccacaacttggtctcatctctaatagttgaagccctgaaattcctatggtttcatatccaccaagcgaccaatagtactaaccaatgttgcttagtgatttgttgcaaagcctgacgccactacttgctgaaaacaacgtcatctggccctgttgtttgatggtgcaggtccaaccaagaacagcacagatcagaagcaaacacacttgtcaacacacacatcaagtagtcagcaagtgctgcatgttctcctccaccacacacatatatagtgtgaattattcatggtgatcaagactgcgacgacccaatcggtcagcagtccaacaacgattcagcgatgctaaccacactgaaattctgcagcgaaatggagccccaagttgtccaaattagcttccaatgctcaaattattccaccccctgccccacacacacacacaaatgaccgttagctgatctagttgtaacttgtaatttgtaagcacacctgatctgaagaagatgtggtgtccatatgagttgatctcttccactccaagagtgaacttaatcccggttcaaatttcccaaagttgaagatattccatcagagggttggggttggtaaacctaccctgatgtttttgttagcgcttcataacgcgttcttcaggtagcaattctccttgtcacatgctcacaaagagatggcgcgagatcaaatgaggatttgccatgtaaccatttatcactactaccttaaaatgagtatcgtacgcgaaaagtaaccatcggttccaatgttctattctcaatcaccctcctagcatatctctaattgtataagcctagcctgttagtacaacgtaaagacattattactagtcagaaaaaaaagatcatgttgccatcctcagcaatagacatgactaatatgaacaacataaccaccgagttgggagatgctgtggaagatcgggtttagaaattacgagtactggttttgtcatcatggaaaaaaatcagaataagtactttcgtatttgttttctgcaacttacatcaacatacaattatataggcaggaataatatccaaaattgtcacttgaaaccaggaacaacaatggtttgcactttgcagctctgcattcaccttccttcgtcaatgcgtccagctatccctggatacgagttgagaggggcggtctccctcttctccctgaactcaccagtagtagatccagagtagtaggagctggtggcatagctagtgtcacctcctcctctgagctgccattcagtgatgtagctcggcttcgtcaccacctcagtcacctcaatatctccggctaggatagccatgactctggacattgatggccgctggtgtggtgacccttgagtgcaaaggagtgcggcacagatgactctcaaggcttccttctcattgaattccttgagttttgggtctacgatcccgagtgcttgcccgctctcatatagtgtccaggcctataaattagcaaatgcacagcttacattactttagggactagcatcagctgatgtgttctcctggattcaaagatcatcaatatataggcttacccattcaaagagatagatcttatcttcttcacgagagttgtcggtgtttggtcgaccagcaacagtctccaaggcgactaccccaaatgcaaaaacgtcggccttttcagtcagatggcctctcattgcatactcgggtgccagatagccacttgaaaaggtcaggtgaggataaaaatattaggttatgttttgaacataaactcggaataagagcatggtataaaatgttcatacagcgtgccggctatttttgtgctgatatgggtcttcttctcatcatagagctttgcaagtccaaagtcagagatcttgggggtgagatcagtgtcaagtaagacattgctggctttgatgtctctatgcacgatgcgaacgctagactcttcgtgaagataagttaggcctctagcaacgcccaaaacgatctcaaagcgtgttggccagtctagattaaagcttttgcttcctgaacatgtagaaataaggtcttgataattaagatgatggtctaatgtagagaagataattctcgagagtgcatgaagcaaggagcttaacaggtgctagtgatgagcaaaatggaacttaccaaagagtgctctgtctaggcttccattttcgaggtactcataaaccaacaagggtgtgttactatcaatgcagcagccgtgcaatttcacaaggttccgatgttgcacagctgaaattgttgcaacctctgtcacgaactcgctttttccctgatgggatgattgagaaagttgtttgacagctatgactcttccatcaggtagcttaccctgccaaaggaagatctctaggttacatacatattttgattatataccaattaaattgcaaaggcagttcaacttagtaagataagtttcacggattgagttggggggccactaaccttatatacttgcccatatccaccttctcccaccatattttgagaactgaaattctctgtagctaactttagttcagcattactaaagacattaggccttccagcaaggttgtacagctctgcaattttcagtacacatgggaaagaataaaccatttgaaaatttcaatttttgaatagctgcactaataaatgatgataccttcttgctgttgggtcgcttttcttctcttacttatcaacataaagattccaactaaggctgctgatcctaaaactaatgcaccgatcactattccgacaatcacacctgccttacttttcttttttggctctccatttctcacggtaggagtaaaatctggaaaaagggttttagtaattagaatatactataatccattattcaggttaaattattcaattgttgggcttacttggggtgacacttagtgcagatatcattggtccgtagtaaccttgagttggaatacaacaagtgcccttgccagcccagaagagatggatctcaaggaagtttttcgacacgattgtattatatattttgttaactgcagtaaaagattttccaccaactgctttccttatatcaaaattcttttctttcagaacaccctatgcaaatgtcaagtgaacattttcatataaagaaaaaaaatcaggtaaacaaattaatgcgcattgtgatatgtatctacctgcacatatatgtcaaaaattcgccttcctgtgctctcccaagtctttgaatctggataagcaaactctgcaaattgaagcttgacactataatttccattctcaagtcctagaccatagtatcttagggatgatggtgacatcctcgcggtttggaataattctgaatccaatgtgttttgaaactgttgggaactatttattacatagtttcgacttgaggcatcattgaatattccaacattgctgacaccccatcttgtatttctggtaacatagtatgatgcgactccgagatttgcagcatctacttcatatatagtattatctgagcctttcatagatttattactgccacagtctaccgcaaaagaatagtctgcagttaagatgtacaaaattatggccattactgaaattcccgaatcctttcaactgctacaaatgattaagttttaaataacatacattctggagaacctagcaaacatggagtgtcttgttgtaaacagtttagtcctgaaggtagaatactgtgtgtaatggaataaaacattaaaaaataatggtcaaaaaggttttgtaaaaaacataggcttgtagataaatgacacaagtacctattgttgttctcacgaatattaaatttatttgccaccaaattccttgtacaaacaacgcgtgtaacttgtcaggcaacaaacttcatacaacatagtctgtctttatttccatttttcatcagaaattttaacttacaattgcaaattgttattggtaacccatgaaggaaagcttcccgtgagttgattgtatgaaaaatctctgcaaaaatccaagattactaacatatgaaatgaatatatcattgcaatgctgaaatctattttggctataatactatatatgttgaattggcagccatacaaattggttagggaggagctcttcgcatctggcaggcttcctgtaaggctattgttcccgagaaacctgaattgagtcaccattcaagacgacaaaacatggatgtcagcttaacaggcgtttctataacagcaataatcttcagaaagaattccttacaagtatccaaggttgttcagattaaggatggactgaggaacttcgcctgtgatattattaaagctcaagtccctatggcatacgtttagcaatattacttaagtaaacacacataaaactacgagaaataataaccaatagcaatagaacgtggtactatgtcaagaaaaacttacaacaaggttaatcttccaagcttagagaaatttactgttctgagattatcggatatcttgcagttcctcaatattctgaaagaacaaaagatccaaacttagaaacaagttttcaatgtataaaactgtaagatgtttaataaaactttaaaacatgtcacatacaggatattcaaagacgtcaggttactgataaaggccagcgaagagctcccgtttacaatatcaccaattcgtctgcatatgtgtatttagaacacaaattatcatgacaagcttggccttgccaaccatcagggggaaaatgtcacctaagaaagaagtacttacaagcttgtcaagttggacaaattagacaaacttgctggaatcgggccttgaaaagaatttccttggaacctcctacaagtttacactttaagaaaaggtaggaatatgctaaataaattaacataagaagtatgctctgcatttcaaagagcttggaatgacaaatttcagagttcaagcaaaagatagcaagaactggaaagtgaaactttggctttctttacactatactccaggacccttttttagaaacccccacgttactcgtagatagctaaaagggcagaaattcctatattaatcaaaatttcgcaaaataatcaagaaaaggagaaaaaccctaacaatccaatctatttaaccagcatatcctttagataggaagaggatcaatatcttaattggtgtattgcacagataccctaacaaatatgtttgagttctattaaaatttatacaagtgtcttgagtccccaatataagtaactaagaaaatattcaaaacaccatgcacacatacattgagatggagtttgagttagtcacaaaagctatttgaagaaagcctacatgtatgaactgcttggcatggatggttagaatctattttttgtt

SEQ ID NO: 49523 - DNA, 20338 bp, Oryza sativa
ggcgggggatcttacaattgttcgagtttggtcaagttgcccagttcttcaggaagttcaccagtaaaattgtttgagccaatgcctctgaaacaaaaggaaatagtttagaattgatataacttgtttatctgcactaaaaatagcagaaaagtggattaacttttcctgatgatccataatattcacctttttaggatttcatttggattaaggttatgaacaccatttggaaaaggtaaattgcaccgacaagacttgcatatgagtaatgtttttttagaacttctccttgagaatatatgcaattaatttacttcagacactaatcaattgttgagaatgagaagacatgcaagaagatctcttacaatgatcgaagatccgtgagattcccaatttcctttggaaggggcccagatagcgaattgattgataaggtccttttttcataaacgaaaaaataacaaggagagaagatgtctaagagaaagctccaacagactgatgtagaagaatatataacttgaaatcaaactcttacaggtattgcatgaaagtaagcttcccaatgaatgatggcacagggccagtcaagtaattttgctgcaggttcctgaaacaacacaagaatcatcaaacaaattagccaaacacacgaggtatgattactattaatccagttttttcctgctaactgaaaattgattagtcaaaacatgggattggatcaatatttactgcaaaaatactgttcaactatttgacagtgcaacagaaagtgctccatcaatcatcataaaaaaaaattctaaggcataagaatttgaaaccatacaagttagccagatatctgagactctccagctccgcaggtatcgtaccgacaacattcaacgcgtacaccctcctgcataaacatcacgtcagaaaactcccttgcatgacgacagtaactaaaaacacaatgcactaaaaagattgtgtgttcgcaagtatccaaatcctattcatcgtgatttgtgaattgatcccaagagcaattatatgcttcttgcaactaccagaccaaaaataaaaataaaaatcggaggaccccatggcctctctctagaatttcctctgtcctctgaggcattccgtcgaacacctggcctgcggtcgaagcaagaggttcagtcaaaggcgtgcacgtacagcttggtgatgtggcagacggtgcggttgttgaaggagcagtcgcacttgatgccggggttgacgacggggctgtcgtcgatgttggtgtcgtcgacggcggtgccggtgcaggggtcgccgccggtgatgttccaagtcttgggcggattcgttccccatctccccaggatcgcgttcagcgccgccactgcattggcgttccacacaaacaccaatccatttctttatatgcaaggtctaaaccaatatagaaaaagaaaagaaaagaaaaaacagagaggaagaagcagcggcgaatagtgcaaaaaaaaaagtttttaaaatgtacgacgcagttcacttctcgaccaacattcgaccattcgttttattcaatttttttacaaatataaaaaatatttatatcatacttaaagaatatttgatgatgaattaagtcacattaaaataaataataattatataattttttttaataaaacaaatggtcaaactttgaaaaaaaattaacggtgtcatacattaaaatatagaggtagtattacacaagttgttcatcatcttaatgattgatttctcttcctctatttttttttcgagaactgcgtgtaatgtattattccctccattatttttatttgattgtgattattttcatcacgatcaaagacaacttaaccttttattttcatttaatgtgattatgtggtagaaattaatcaagaaacgtgcgctttaactaccccaaatactgtgctatacaataatgctatatgttaaatgaaggtacagtgtaatgtgatcttaatttgaaatttctaatttttaattatgtgatgatcgatagagtattactccctccgtttcaaaatatttgacacactttttagtacgtgtttgaccattcatcttattcaaaaaatttaagtaattatttattcttttcatatcatttgatttattgttaaatatattttcatgtacacatatagttgtacatatttcacaaaattttttttaataagatgaacggtcaaacatgtacttaaaaagtcaacagtgtcaaatattttaaaacggagggagtacattatagagttgaagaaaatcgtggaacaaacgatccggctaactctgctttgaacagaagcagggataactgacctttcgtcgaagataaaacaggtctctttatttttatttttagatgaaaaaagaggtcgcttctgactattggtctaaaaaataattgaaggaaagggacaagaaacagccaagaagaaaataattcttcttccaaaaaaagagagaagaaatgaattaataagccaccaggatcaactctgcagtgctattttctcttcaagatcggcaacatttttgctgatgcacatgtaataaaccctttctaaatcttaatgaaccgatcgaagacgttccatctctcatccggcgaaaagagaaaaagaaatcaaaacaacatcaaacatatctctaatctgtcttcctatctctgaagactcaatgaaaaaaaatggagagaaagctagcatatttgcaaatcggagaccaatgaacatgtatatatccaatccaaaagcacgtttcaactgatacacataccttcaactggatcagttcttggagcttgctgagcctgagcagctgcaacccaagaacacgcgatcaccagccaatacaggagcagcagctgcctgccatggctgccgctgcagcgcctcctcatcatcctgaaaaatctctctgctgcgtcgtcgtcttctctcctctccttaaaaatctatgtagctatgtctgtcaacgcatgtacatatataagctgataaaatcatcgatctgtcgtcggcacaaatggatgcgcaacttggagcagcaagttgcttgtcgacagatatgtaggagcagcagcggcggctccaggtgaagaggacctcgagaaaatcaatcgaacggcaccatgtgtttgtaatgccattagttggaagattaatcaacgccagaaagtcgtgtagacgtgtacagtgatgacgatcgaactggtgtcgagttgaccttgttttgttaattactagtataagagtaatttcgacgatttccatagtactgtacttaattagtactacacagttgtcagctttcaagacgttttaactttgatcaaaactgtttcatatttaactaaatttatagaaaaaataataatatttttaactcaagacaaatttattataaaaatatattcaattattaatttaataaaactaatttggtattataaatattactatatttgcttatacacttagttaaatttaaaatagtttgactttgactaaagtcaacacatcttacaatacacgaattagttccaagagtgtacaggtcatcaacagatatgcatagtttttctcactgcacagtaattggagttgctagcaggttaattagttttgagtttcacataacatctagcctgagtttagttggatccaaagtttggattttgattaaaattgaagatgatgtgactgaaaagttatatgtgtatgacaggttgatgggataaaaaaggactgaagtttagatgcacacagccctactactcctatatcccatcgactgacgactcgtcgacagtgacaattgttttggaagtatcaggaatatcctaggatcgatacatcggtcagggatcgatgccaaatatgacttgtgcccaaatctgaataatccatcgccgaattatagaggaagaaagcgcgaagcagtaaacgccatccatgagttgaatgcatgcgtctacattacagaatgcgacataaagttttggatcgaccagttccactactacctagctgctagtactaattgtgcatgcatgcgtctctggtcaattaagtaagagaagttcttcgagaaaacaaaataagattagtcccacacgcatgcatggctagctgggcaacaacctgcttgacttgtttactacgctctccgtttcctactataaatcattagaaaaatatccgtacgttgtaacggatgaagagactattttaatcttattattattatatggtttagttaaggtgaaattcattatattaaattcatttgaatatatatatttttgttagaaaatcatgtgctacaattagaagtctgatcatcttaagttagaatgcgagttttttaaagagatttttttatatgattccttctatatttccaaaaacgaactaacttaaaaaccgactaaaatatgaatttgtgtttctaaaagtgaatgaacttaataaccgacttatatacggatgacataccaaaaataccggcaaaaatatcttcaatttttataatattagagatttagttattttctaagtttaaccaaatttatagaaaaatataatactctctccatctacttttgataggcatatttccaaatctaaaaattttatttttgatagacatatttcaatctaacaatctatactcttaatgactttcttggatttaaggcgtgactctacattctttcatacaagattggctacatggatatcgagaaatataaatattaaagaatcgcttgttacaaggaataactagtagcatgtttaaatggatgataagtagaattacttatccttattctatctgccaagatgaaatatgactataaaaaatagatggagggagtaacatttttaacacaacataaacacagtatcaaaacatatttcaagttatatttaatgaaactaaatgttataaatgttgcttttttttaataaaacttaatcaaacgtaaaaaaagtttaacgcgaaaaaaaaatcaaaataactcataataatataaatgagagggagttaattctgtagttgacaagactcagattgacaagatgacaactgtagatgtagtactctgtatgcatgcgtatctcgtactctcgtatactcaaatacattaacgtacgaagagagcgatgtctaagctacctagttgttggatcgatgtataaattacgcacgttgggatatagcgcgcataactaatgctaacgacgcgcggtttgaaagcccacagtatcgaattgggatcacatgcagtttgtacatggactacaagttaagatactgcaggcaataggagccatctattttgttgatgaacggaccagatcatcagctagctacagtatctctccggccggttgcttgtttcgttgtagctagcgtacgactgtacgagcaaattaaaaaaggcaccgtatccggtgcaaatcagggttgttgtgcaaccttacaaactttcaatcaagaccacaggatgcccatccgatggctagggacagatagagctgggacttgggccgtgctttatcaggccggcccaaggcacgaaggtccggcacgatagaaagcacggtccgacacggaccgtaaatgggctgggccggcacggcccgtacgtgggccgtgcctgggcctggacaacgggcacaacgggcggcacggcacgaccactgggccgtgcttgggccggcacggcacgcgaatggctgctgcagcacgaggtcatcagccatcacccatccacggtcaaatttcctatgcagccagcaggtagcagcaagtagcagctcgttttcttcatcggctcatcggtagcacgtagcagcaaccagcaaggccatcagcccagcaggccagcactagcatttggcaagattgttggctgactcacgccgccacgccggtgggctgcgtccccgcgacgagctgacgaggaggagcaggatgggcgtggctgtcactgccgcgtcaccgcgacgggacgacgaagccgcaagccaccgctgccgcgtcgccgccagagtttcttcttagcgcagccggcctgctcccgtcttttgggtcgtgcttgtgccggcctggcacgaataggcccgtcgggccattgggccgtgcttgggccgcgtcctgaagaggccgtgctgacacggcacggcacgacaagtgggccgtgctgggccggaacggcccaatttggcacgaagcacgctgggccgtgccgtgctagcccggcacggcccaagtcccagctctagggacagaggtgggttacttttgcacttaaccgccctcactcatctctactaatttgttttttatgcaaatcccccctaatcacagctccgtccgtccgccctccccgcgtcgtttcatttctatagcacacacgattcgccgccgccgcctgcctgagtccccgccgccttccagcgactcgccggcgccccttcgccgcgccaccgccgccatgtcgcaaaccctcccgttgtgaggtcacggtgtagaacgtgccgctgccgccttggagtccggcacgcgcgacgtttcgaattccaacgcgacagaccctgtgcaggaccagcgggcgagcgccgttgatcctgtcgtcgccattgatcccatctccgttgaggccgccgccatggatcatgccgtcatcatcgtggacgagggccaaacaagctgtgaactatgaaccgtggaagtgtacttgctggaagtccctatacttgatgtattcctgaatgagacatgcttattttcgtattgtgaacattttaatcttaacctgtatgctcttgttatgggtagatgctgccaaaatttagtaaaaaagggtacatgctgccaaaatctgaactgcaacaagagcttcttatctgagacatatttgccatcaatatattgcaatacatgaaactgaacctgtatcaaacctatcaagctgttgtgctctagcacatgtgcagaaaatgcacaacaagtagtttgacagtttgacagattacaaaattcgtgttggtttcagttcatcttttatccgaatgcgtgaagctgggcatatattcagtttgacagattgacacagaaaacaactggtagttcattcaggctattattcataagagcatctccaacagactacccaaatccgactctccaaacacctatatagccaactctccaattgatttggagagtcaaacttatagattactccaacaacatctctatccacgctctctactctgagtctatgacaacgacccacaagtcagtctctactctttctccccctctctctcgcttttctccccatatgcgatggcggagacggcggaggctacgaggcagaggggcggtggacggtgtcggcgtggtcggagcagaggcgcggtggacggcgacggcgcggttgagaggcgcggtggacagcgacggcggatgtagaatgcgattgcggagacggcagaggccacgaggcggaggggcggtggacggtgtcggcgtggtcagagcggaggcacggtggatggcgacggcgcggtggacggaggaggcgcagtggatagcgacggcgccgttcttcttcccctctcctccccgagttcgcgccgttggatggccgggggcaaaggcggcgacaaatgtggctgtggacgaaggcggcgatgctggcgatggtaggggatccggtggtgggcgggacgacgatggcggagatcgagacgacgatggtggagatcgggacggcgacgaagagggaggggatgacggagatggggacgacgatggaggtgcggccgaaaggagcaccgtggcggtgaggaggagctagggcgcccatctgggagcgggagatccggggcggcgcgcggccatggccggagatcgaaggcagagaggggaggtcgcggctagctccggcgcgaacgacgacggtggtcgcggcgggcttcggcgcggacgacggcgtcggtcgcggctggctccggcgcctctctcctatgtgccgtcggccgtcgctgtcgtgcagtgcggttcatgccgtcgccgttcacgagcgtgctcaagccgggggagatagatgggtgggagagggagtggtgggtcccacaaatagccaggcagggagactctccaagtttgaccagtgaagtatgcgatttagccatccggctgttggagggtatttttctcccatacttgctaaaatttaacttggccagtcatttagccactctattggagttgctcttacacacccataggttccactgtcaccacaagcaagaaaaaaaattttatggttccacttgactcaatctcattatcaaatgacattacacaattccattgcatatttgcagtcacaatctttcagagttttagattacaaaatcagtacatcagtgtcaatctcagaacacgattccattgcatatcagctcggcgggccagcgaccgcgttgagccggctgacgcggccacggcggcgagcggcgacggaaggaggcacatctcggcaggccagcgacagcatcgagtcggctgggcggggacgcggccgcggcggcgagcggcgacggcgggagggcagagggagaggcgaggcagagggcagaggacggcggccacacgaagcaggggggatttgcataaaaaaaacagattagcagatatgagtgcgggcggttaagtgcaaaagtaacccacctctgtccctagccatcggatgagcatcatgtggtcttgattgaaagtttgcaaggctgcacagcaactctggtttgcaccagatacggtgccaattaaaaatgccaccttctcacacggttaatctaaatatttaacaacatgcagcttttgatttgatcaaattaaccttaccaatctctctctcttttttttttgaagaatctccactactcataagttcagaacatgcagccttcgtttcatattatttttgtcctaaaattaattaccttcttagaaaaatatatcaacatgatctattagattaatttcataaaagtcctcttaagagacccacatgcaaaaaaaatatatattttcacataggagcctcttaacacacccgcatgcaaaacacaagcattttttagcatgtggatttcttaagcgggcgcatgcaaaaatgtctcttcccgctcagcatctttaaaattttaagtccccatcgttatctcctcaacttctctctcacctctcatttttccacaccctctcaatctccttactcaatcccccactcatttttctctcctcctctcccacttcctcctccatcgctgggtaggagcgcgggcgggcgacaatggcaggagcggcgggatgctccccggctcctcctccacagcccggtgggagcacggcgggcgggagttgcagcggcggtgacaagcttggcctcagatggagccggggtggcagtgctagggttttttttttccttttggggaattttatttttttcgcgattttttgttttcgcatgtagttgcgttggtcgcatgcaaaaatccgattttcgctgacctttgggtgcaagcgggccgccccatccgcatgcaaaaatcgattttggcttcatggaaaaactgaatccgtagtagtgcacgaaacatatcttgatgatgtatttatttattattgtatatatttctgcatttttctataatcctgatcagagttgaagaagtttaacttaatcagtacaaaagctaaaacaacttataatacagaaccagtggaatatctcataagttcaccgcacattgaagaggtagtatgttatatatttttatactacctaacaagctacctcataatttatatatttttatgctatctaacatactacctcttaaccgcacattaaagagtatgtactttaagtctttaaccataacttacccaaaaattttgaataagataaatggtcaaatgtatgtctaaaaattaatgttatcatatattaaaaactgaagggagtctcttttcctatttcatggagtcatactacctataataaaaatatattattattattattattattattattattattattattattattattattattattattattatctttattagcacagttaaaactcgaccaattgtgacgatgtaaagtggactttttcccacctccgttacatgtgtgcaccctcggcccaaatcggtgtaccccaaattagtgtacctttcggcccaatccggcctgacatagagagccaacgtcaggtgtgtctacaggcagcggacgcgctaaccgacgggagtatatcaaaccgatttttaatcttttgattaaaatccaatagacacagtaaaaagcaaaaagcaactcaaaacaccataatgaacactaaattaccatatcttcaagaaaaagacaaaatccaatataaatttcaaaacttacatgcaaagattaaaaaattacattgtagcttacaaaagttacaatgtaagtttcataaattacactgtgacttaaaaaaaatatactgtaattttgagtgaaaaaattgagtgagagataagaaaaaatctttcgagtgagatatagcaaaatcgataacggattcctctcccgaaattcctaccgcgcgatcgcttgcgaggcacgatcaacctctcctctccacgtggtttttttttttcaccgtattactttcatattttagtaaatttatgcacctaaagtttgtacacctcaagtttacacatctaaagtttatacacctaaagtttagagacccaaagtttataagtcaaaagtttatatatccgatttaaatttgaatttgaatttaaatattttttatatatagtatttctatacatctaaagtttatacacatatagtttatagacacaaagtttataagtcaaaagtttatataccctattcaaatttgaatttgaattcaaatatttatatatatatagtatttccgtacataaatttttctaactttgttttcttatttttttttcaaatttatggtgtagtaggaagagaagaggggatgagaagggggatggagggggggtgatcacccacccattagcgttgcccattcctgattcaattgtgttaagattggggcaattgtgttcctgcccttgctttctgattcaattgtgattttacctcttctttttagggtttgtgattttgcccttgttttttcaaattgaagcttctgtttgcccttactctgttaggatgaattaacggtgttaatttagtagcagaaagactggtgtgccctttgcatttctttgtgtggatgtactgtttttgccccgatatatgatgtggacattaactttgagattgtatggcaactccacacaaatcaatttattgccagttattttcaggaacatgtcagttgcatatattcatcatcacgaagggaaaaagaaaggagaacgcaaccaattgtccaaacaaatctattacctagctttttcatgaacaaagagattgcacacatcaaaaaggagaaagaacagagagcccaagcaaaaaataatccccagatccatctaacagagcctcaatgattcatcgcagttgcttgccggttgattcaatcaacaaagcaaaccattaaaccctcccagttcctcggtggcaacggtaactttgagcaaagctgggatccaacaaggaggaggcgcaggattcacatgagacgatgcacccagcggcaaaatgtcatggctgacgcagtcgctgtcgaagtgtcgataccgcgcgggaaatcagaagcctgccgcctttgcgcctgcttgcctccagcaggctccggtccgcagtcccgacgacggtcggccgcgcgtgcgcctcccctgcgttggcctgttatccccgccgcgcctccccttcatgtcgacccgtagtcccggcgacattccgcggcgcacgcacctccccttcgcgccgccgcctgctactcccctgcgtcgcgtcgccgtgcctccccgtcgcctgttcgtgtcgccgccgcttgctcgtgccaccggcacggccaaatcctctagccctaggttttgggatgggggaggggaatccgtagctttccaacccaattcgcacagctacttgagtgatttatttactcaccaggggtataacagtcattgacaaattacgaaattatttttttattttcttccccctttgtttaactcggaaattctagccccactaacagccgtcaaaatcgagggcaaacagctacttcattttgaaaaagcaagggtaaaaacacaaacctaaaaaacaggggtaaaatcacaattgaattagaaagtaaggacaggaacacaattgccccttaagaagggcttaaacgctaccaataactcaataagagcatcatcaatagtgcctctaatccacttccaatttatatttttaatgattttagtctaaaaatccggcccaacggcctccctaccttgtccctaaatctttgggaattttcttccctttgattttcgctctaggcatatgagggcgaggcctcgctcccaatcttgcggtcacgtcgttgtgaaacatactaggtctcttgtgatgcctacgcatatatcgaagcgggttgttcgatcggtttaggttcgccttgcctacacatggacttatgttttaggcaccatagaatttactaatggtgcatattaatagcagaagtcccaaaagcagcaaactagtagcgaaggtagtttgatgaaggctcccatttttcaggaattcctagacgagaagcggtgctttattactcccaatgcaacaagcatgcaacttgacaaccatgcgggtgccaccactgaaaacaagaaaaggaggagggggacgcaaaatagacttattccttaacccccaaatcatctcattctcctctattcggaactccggcgtcgggcatggccatcggccgtcgccaagaacggcgcgccactcctcggccccggcggcggaccttcctccagctcgtctccgcgggctcatctaccgctgccacgcgcgcgcgcgcgcgcggggtgtcacaccgcgacgtcaagccacagcggagcaggaggccggccgcctccacgccagcttcgaggagaacgtacggcggccgcccccaagtccatcccattcgccgcgcgcggccttctccgacctcgacctcattgtcgtgtaccccgcgccggcggccgggtagaacgcggtggtgcgcgctgccttgccctcgtttctcgcccccctccttcgccttgccgtgtcgtgctgcatctgtttggcaggcaacgcgtcggccgcggccgttgaacttggtagtgtggccatcagcaagcaggcaacagcatccaattttgattttggtttgacgacggtttcagaatgggtttaaatccatttcttagcttgtttggataattggattagctttaattttgcacttggggctgttgagattataggcatataataatttaatatattccataaataaatcatggcattgcagatgtatactagcattaacgcatcattagatctacacatgtaaactaagcagtaaaacatgaacagatcaaatatgcgcaacatattgaacacgtaccgaggtggtagaaagaccggctgctcggcaagaacatttcgcaattgcaggcgtctacgaaggcgcgcagcacgcgagcgaagaggaagacgagccgtcgcggacgaacagggagcagtcgcgctaagcgcttcccaaaaaccttattgtcgccttctctcggtgcaggacatcgaaggcagaggttcaagagacctgctctcccgatcgccagtgcacgccgacgagcgcgatggagtaatctacgagcgacggtgcagcatagagtaggaggcaaaccctagattgattttgcgtgcgttgcgtgaagacggcaggtcggtttatatagagaagggtcgcttgatcagggcgcccgcacgatctccactgcgcataaccgaaccggataagtcacgcgtaacttatccggactccacgccgttttcacgcaccggatttttcggaatgtttccaaaacaaaaatgaatccgaatttgcagcaaaacaaaactgcaaaaggaggctgcatctacgccttgcccaggccaggcgaggcgagcgagcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccatccattaattccaacgggggcaggccggttcgggtgttgcctttgattaatggatttggattggtttggtttgtgaagtatagtgtatatacagatgaatggagcgggtcctactaatgcgcgggtgatcgctgggcgcactcccctcctcctatgccgattcctctctccccctttctccttcccatcttctcttcctactacagtacaccacaaatattttttaaaaaaacaaaaagttagaaaaaattatggatagaaatactatatataaaaaatttgaattcaaattcaaatttgaatttgaatacaaatttaaatttgaattcaaatttgaatcaaattcgaaatcgaattcaaattcgaattcaaattcaaattcgaatttgaatcgggtatgtaaatttttgacttataaactttgtatctataaactttagatgtatagaactactatatatagaaaatatttgaattcaaattcaaatttgaatcagatataattcaaattcaaatttaaaacgggtatataaactttaggtctataaactttaggtctataaactttagatctataaactttaggtgtataaactttagatgtatataaatattatatatataaaaaatatttgaattcaaattcaaatttgaatcggatatataaacttttgacttataaacttttggtctctaaactttagatgtgtaaacttgaggtgtataaactttagatacataaatttactaaaataggaaagtaatacggtgctaaaaaaggaaaccaggtggagggagggaggggggaatagggtgatcgctagccaacagccagggcgattgatcgctgattagagtttctggaatggagcggaccaatccctagccagctggccagagaatcctcttaagatcagctttcatggaagaatcacccacatgatctgtcctcagagatttgatattttgacaccacaaattgggctttgattattcgacatcgtgacccactgtaaccaactcagatggacccgcatgttattgtcaagagtgttaacatgatcgaagcggcaacaaatatggagtgtcaaatcatcaaatttaaccgtttcagtgtagatcaaggaaaaaaagacaggcaggactggtcaaagatcataaagcttacagaaattcagaaaacttgtggttgtgatgctcaccaacccccagcttgggtctacatcatgtgtactctccactgaagacttattcagccaagtcagggactgtttcaagggaagtgaagagcacagaggatggtgattttgttcatccttcacggcgaattctcccaatttcttccatttaagttcttcttggttgtctgattattaggtttctgcttcgaaaatgctggtttgctctgctgctggctgcttgggttcaacctgatctggtgcttcctagtcgaattcaaggagagccggtgagctaagctccaaaccagttgcaatttgttaaagaaccagtcgattgtcatatgcttgctaacctgcttccgtatttgcagaggaaaatatttgggaggggcaatggcagaaaccgcggtgagtgcatctaagggtgtgataggtgccctttttgagaagctcactaagctggtggaggacaagtgcaccaatctcgtaggcatgtcaaaaaatattgtgttccttaaagatgagctcccaaccatgagcgcgctactcgagaagctagaggatgcagatgaacttgatccagtggtgaaggcttggaggaaccaggtcagggagatggcatatgatattgaagattgcatcgatgactttgtgcaccacgtgggaggtggtgatgtggaagctggcttcatcgataaggtttctcactttctcagaactttgagggcccgtcttgagactgccgagcatatcaaggatctcaagattcagctaatagagataaatgaacggcacaagaggtacaaatttgatctagatgacactcctagttctagctttgtggccattgatcctcggttgccagcactgtacagtgaagccgctaatcttgtgggtattgaaggcccaagggaacaggttataaagtggttgacagatgcggatcaacaaataatggtcctaccaattgttggctttggaggtctgggtaaaactacgctcgccaaggaggtttatcaaaaaattggacagcaattcaacaccacggaatttgtttcagtttcccaaaggcctgatgtaacaagatttctcaaaggaatacaatcaaaacttccgataaggctgtcttctgaatattgtgaagttaaagacatcattgacaacatcagagcatatctacaacatagaaggtcagtatccatttacttataatagtggtaggcattattctttttccgttctatgttttcaagggttcatatggtttcaagaagttttctatctaaagtgcctgttttgctctacataattacttgcttgcagctgacaggcatcctttgccagctttttggcttctagaaaagtaaagctcttctcttaaatgggtcatgtgccagagttgaggggcaaaaatatctaggtctatattagcatagcgcacagatgttggtgcgatttaggtttgagttctaaatgaatatcctaatttagcaatataattcatggttagtacaaggaaaaaaaaactcatgaatttccttgaaccaaatgtgcttattaattgttgaatttgttgatatatttcaattattcatcgcacataccaaagaattgtatggcacttgataatttaatttaacaggtacctttttgttgttgatgacttgtgggatgcacctacatggaatattattcggtctgtttttccagaaaatggcatgggctgtagaataattgtgaccacacgatcggaagatgttgctagatgggtatgctgcaatcatcgacgattcatttacagaatggagcccctcagtgatgaaaactcaagatggctattctttaacaggatatttggctcggaagatggttgcccttcccaatttagagaaatttccgctcagattctgaaaaaatgtagcggtttaccacttgcaatcattaccattgctagcctattggctaatcagcctgcaccacacaagaaagaatattgggagagtattcgtaattctattggcacctgggggtctggcacaaatcccacgttggaagggatgaggcaaattttacaccttagctacaaggatcttcctcgtcatcttaggacatgcttcctataccttggtatttatcctgaggacttcaccatcaagaaggatgatttgattagacaatggctggctgaaggctttgtccatcatttccatggggggagttcagaggaagttgctaagagttatttcaatgaactgatcaatagaagcttaattcaaccagaagaaaccaaatatggggaggtagtttcttgtagagtacatgatatgatgcttgatttgatcttaagtaggtgtgcagaggataattttatctgcgtggcatacaatctagaagaattgtctggaaaacatgaattcaaagtccgtcgattattggtcgactctagagttggtgattcaggagataccaaaatatcaggaacacctgctcctagattgttgcaactcagatcacttcagctgtttggagtatctgtatccctgtctttgttgccactgtctaagtatatccgagtgttgatattacacttgggaaaaaccgggacaggaggcaatgaaagagttgatgtgaccgcaattgggcaattattccagttgaggtatttgaagattgtaagcctccatcatgcgctcgtactagagcttcctactgaaattcgaggacttcaatatttgtcaacattggaaatagattgcacaaatgagaacagtttgccatcagatattgttcatttgtcccgcttgtcccacctgattgttccaagtggtatagggttacctgatgggaagataggcagcatgaagtccctatgcactctccaaaaaattgagatattagatatcaagagcgccattggccttggtgagctgaccaatctaaaggaccttgagctgtacagtaaacaggctctgtcagagagagagattgatgcgctggtaacttcccttggaaaacttcataagctcatatctctgcgcatgtctaagtttgcagaatgtatctggtatgatgaggataaccggctcggttcattgtccaatcctcctctcaatattgagagactccacctgggaggatggaggttgcgtcgagttcctagatggatcaatggtcacctccaaaacctctgcttcctcgttcttgatgttacagagatgtcaactgatgaggttcggctccttggagagctaccttcactcagtgaactctgcctgagcgtgaagcgtttggctccatgcagcgcatccctcgtattcggtgcagggttcccagcattggagtgtcttgaattcttttgcggtggagatatatcacacctgtgctttgaggcaggggttatgcccaatctcagaaagatcattctgttttacatagatattgaatggagcggcaccgcaccagttggcattgagcacctactgaacaaacaactccgatacatccaattacatccggttactgacacagcagtggatgccgagcgtatcagcctcgcattcacagaagctataagagcacatacaagccgtggtggtgctgaaccttacctgcgcttcgcccggatccgaagtggtagcctcataggtgcaaactctttaatccggcacagttttacttgtcatagagtttctgctttgtttctcctgaatcacattcttgccattcttttttctaaatttatattgtgcatttctgttctaagtttacttttttggttgtacgcgtaccttgctgagtattggaaactcttccactttcagaatgactgatcggctaccttctatcttgaaatggcgcggggacgcattcatgtttttagttcaagctgcagcaatgtttccttgaagaacattctgttaaatggtaggtgcccttcacatctctttgggcttgttcactttgatgccaaaaaaaaaccttaccaaattttatcattgtccaaaattttggcaatggcaggattttttatataattactaaaatttgacagcaaactaaatatagccactttttgataactttactaaaatttgataaggttgaaaatggcatcaaagtgaacagggcccttcatcagctccaggagacagcttcgggcttcggccagagtcactagaacagatcaatgtgcagagcacttatgtcatgccagttatgacccggcactaataaggttttctctgttagtagtgagctactccttccaatttcacaactcttgacattttggataatattgtttaaaatgtcaagaattatagaactggagggagtcactgctcgtaattgttcgtgcatctctggtaacaaattaagtaaagtcctggatgcacaattagttatagaaattcactgcaataagaagctggccattgcatacatgggcaacatgctggacatagattgtttactagtattaacaacaaaagaacatactggacaacgatccgtggtgacctcgagttgatttttttttcttcaaaaaacggacagattggattgaggctggcgccgcacctgcttatgcatagtcatatatatatgaatcaggggcaaaaaagaaccgaagccgaatcaaatgcaaatcaatcgcgggacgggacac

SEQ ID NO: 49524 - DNA, 35155 bp, Oryza sativa
tactttgttggaatattgcccttccgaacacagccttgacggtgtcaactcggttataaaaacacatatacaagctttaacacttgcccatacttttctaacaagatttgtatattttattaaatttaacgaaacactgatagatttttgacaggattttcacaaacttgcaacgggtgcaaaaaaaaaaatcttccaaaagtattaatcacattcaccataaaaaagatcaccaaataaattccttgtagtcaggggcggagccaggtgtggagcaacttgggcccgggccccacacctggcagaaaaaataccaaggaatttactaatttttctattaaaatttgttcaacaagttcatactctaatgattaagccctactcttaacataatcctggcttcgcccctgcttgtagtgattgggaaaacaaaaaaaaagaagagaaagaacaaacgttgcaagctgcccgtggacgagccgctcgacatgcctcgtcgacgagatgctcgctcgccgcccaaatcgtcgcgtgctggcgtgcagctgccaaggccgccgccgccgcgagctcgcgcactgccgctggagctgctcatacacgcgtgctgctgccgaggtcaccgcatggtccgcatccgcgcccctcacctgctcgcgcgctgccgccgccggagcgcctccttcaccgcctggcacctgctcactcctggccgcgttgggatgcttcgcgcagccgcggccgtcgcctgatgctcggtgcgtcggcccgcctagagcaacccaggctctaggcatctgctgctcctcgcctcgccccacccagccgccgcgccgctgccgcagccgccatgtcgttggtttcagaatgggggagcgggtgaatggtgccacggaatgggtataatggtccatttctactttctttacagtttcatatattcttttcacactcttattccaggtccaccaaacgatctgagcgtaaataatagcttcatttaaaaaaagtaagagcaaaatcacaaactctagaaacaaggggtaaaattacaattgcttctgaaagtaggggcaaaaatacaattatcccatcaattatttactactgttagatgtagcaattaatcatttattacctagatccacacatgtcatgcacatataagatctacatgtgacacatagatagtaaatgattaaacgctaaatctaagagtgggattaagttaaatgtcctgagaaaaacaagggaagaaagataaaataggacatcgtgactttacggttttagctatatgctaccacacgaagtaacttttataagaagacgtacactttgtaaatatggaaattagctcatggacaccatgtatattaaaatattcatttctaattgaatagaagagagaaaccacgtgaatgctatgaaatatctcttggcggctagatccacatgtcaagtccccctatctttgcccctctctctctggaagtcatggcaaagaggagcaagaggtgagagaatgcgctggagcatggcagtgccaggcaggccacagtggatgacgtcgagtaggagcggagtgcatggagatcgacaaggtggtgcggacgaagtgcaagtggatgcacgcaggttagagttgcgtggaagcagtagcgctaggtgcgagtgcacaagacatcatcggtggcgacgggaggaggaggttgagctagagcccactcggcgccatgcaaccgagctagaggagtagtaccagcaagcgacaacccaagaaccaagcgtgtggtgggtttgcatggagcaacgaggttgttgcgacggggctctacgccatcctcaaccacattatcctccatgccacacccgtccaagccgttgagtgcgtcagtgactccgactcccacaccaccaccggtgccatggccgttacggcaaatgacacctattcctgttgcttcgtgacaaaggtgtgtgctatggcgcccatcgacatggaaacccacctcagcggcctcctccaagtgggtgtgcaagtcttgcagcgagcgtggcttcaccgtgttactcctcccccatttaactattcatgtgcgagcgagatagagagatgatagacctgacaatatgggctcgagggtattcgatcaaaataaatattataatgggtgcagtgtccatgagctaatttccacgtttagagattatcttccatcaaaaatcactttgtgcggtatccaacattaaaaccatgaagccataatatcatgtagaaaaatttgaggaaaaaaaaacaccgcctcactcattgtcctattttttcatacctgaggtgcaattgttgcaaacaatgtagaactgttgtgacctgaatttgttcactgactatacagaacctccgctatacaaatcaaggatgctgttgtgggagaaaatatttatgttgtagttgcaaatgtcgtgcgatggataaagctgtttgaacgtgctagaggaattttgaaggaattaagatgtttcttaactagagagaataagagaataaggtttgctatagacttctcaagtgaatgttaataaaaggtttaaattttttctaaaaaaataaaaggtttaaattaagctcatgcttgaaatccttcaaaaagtggaggaagggaatatttccctcttttcagccactccattccaagatcatcataagagaaaaaaaaactcatagggccaataaaaattccacctatgttttgttaattccaaactcaaaaaagcacgcacacaaaattggtgacaaatacatttgcaaactcctacaaaatttgctgtacccatagattgtttatgtttcaaatgtaattggtcaggaattacagaccagatattacaacaccatgtgcatccagtgtttgatctactatacatggaagaaaagaaatacacaaattgttctgaagtaagaaaaattaggcaaacatgattatatgaattataaccctaagatatgaaacccaacatgtctagttctcatggaaagttaatgaagggcacaatgtttgaaggagaaaaagggaccaagattcactcaaacttaaaaacagcacccttgggtacttatctatcaccttccctcagcaaactcactgatagaattagccgacaaaacaagtgggaaggtttccccttgggattttgtgttgtttcctgagcttgatggcacactagattcggtgcctgaagattgctgcatcgatgacgtgaagaaactatcacttccactcttcctctgccactgaggcacatagctaggccacatactcatatccacctcactcatctcggtatcttcagtaagcatggagacgacttttgacatcggtgggcgttgctcaggcaggcccacggtgcaaaggagaatgatgttgatgacacgcacaacctcttcctcgtcaaatcttgcaagtttagggtccaacatttcaagagtctgacttcgctcatgtagccgccaagcctattaaaatcagtttagtttgatgatttgatgtttaaccatggaaaagtacttctcttaatcaactcacccatccaagcagatacttcttatcatcctcgaggctctcatcaaagtttggccttcctgcaataatctccattgccacaacaccataagcgaagacatcagccttctctgtcaagtggcccatcatggcatactcgggtgctagataaccactaaaggtaagaaaccaaatatatgatcaatgatcattttttttgttataggtcaattaaaataatatcatcaggagagtttcttacagcgtgccagctactcctgtgctaaggtgagtcatgttgtcctcataatgcctagctagcccaaagtcagagatttttggattgagatcaccatcaagcaagacattgctggttttgatgtccctgtgaactatccttgtgctggactcctcatggagatatgctaggcctcttgcgatgcctacgcatatgtcgaagcgggttctccaatctaggttcatatttgtcttgcctacaagtgaacttaaattttagggaccttggaatttgctggtggtgcatattttattattacagaagtttaggaagtcgagagaagcaaaccagtagcaaagatagtttgatcaaggctcccattttctaggaattcatagaccagaagtggtgctttgctctcaatgcaacaaccatacaacttcacgaggtttcggtgttgaacggtggatatagttgaaatttctgtcatgaactcccgtttcccttgatgagatgttggagataattgcttcacagctaccattcttccatcatatagcttaccctattcatggaagatatagataacaattcaaaatgatgaatgaaattatgcaaattttgctacatgacactaaaaaatgctggtagacaacgtaaagacgcgtcggctgaaagacaccctaaaaaaccagtaatttgctggaggacgctttcggctcaatatgatgagagaaattctttaaattataaagacaagactaccttagggccaaaagcattcgagttgaggctagagtgaatatggaatatgatatatgctagcgatgtatttgggtgatggcaaatttagagttgtatagtttcaatttttcactccaatgccacatttgaagcatgtggccctaggggcattctcgtcattttgaagaatgtctctcttccagtgttcacctagtcgctaaacgctagtcggacggccacctactgactagcgactaggctgattaggcggcgactagacggattaggcaaattagacgttttttctatttctttcacacaaaaatacttattctagacattcggtacttggtaaatataggcatttaggcaaatagcataaatcatagttaagttcagaaatcatcaagtccatacaacgcactgacactgcacacgaagcattgggtttagtacaaatctatagggatagcgaacacatcagtatagccactgtacatgcacatcataattcataaatcataactttatagatctgaggggctagagctaggagagaggaagaaaaatttatctggaactggaagaacagaggaggtgaggtggtggaggggagcctgatcccctgatggcctgatttagggttggcgtaggctgcttgagtggtttcgtgcttgactgcttcaatcggtgtgtttgccaccttccattgatggcaaggatgaaggatgggagggagagcaggagcagcagaggagggggaagaacgtggagcagcagaggaggagagggaagaacgtagcggcacggtggaagatcgatgggcgcggcaacggagtcgtcgctcgtggcggtgtgaaaaaggggtaggcagggattgcgctctctctccaggctctcaaataaggcaacctaaatccccttctataccgagtcagtcccacgtggtgcttctaaattttatcatgcccaaattttgatttctatcacctagtcgccacctagacgcactgtcccgttgtctaattgcgcccaggcaccgtcctgtccaggccgtccaggctgcctaggaccgactaggaccatctaggcggtaaatcgactaattcactgcctaaggtgtaaactggacaaattgtcgctgaccagcgattaatcaccgtctagacgggctaggtggctgtttaggcgaacattgctctcttcaatcgagccgaatgttccatctagcaaattacctatttcttaaggtgtctttaagccgtgacacattttcgcaatgtctacctgcaaattacataaattttaagtttctagtagcaaaatttgccaaattatggtgtaactgatcatgtagagtaacatacgagctactttacaccaataattagattgaggaatattataagatagaatcaaattgtactactccctccgtttttaaatatttgacgccgttgacttttttaaatatgtttgaccattcgtcttattaaaaaaatttaagtaatcattaattattttcctatcatttgattcattgttaaatatacttatatgtgtatatatagttttacatatttcacaaaagtttttgaataagacgaacggtcaaatatgtgctaaaaagtcaacggtgtcaaatatttagaaacagagggagtatgttgtaacgattggaaagctctaccatgcatgggttacttacactgtgtaagttcccaatatataaaacatggaaggaaggactattggactaataataactgcatgtaaaaagggaatcatgttcttgtgaaactatatttgtttggtcttttgtaactcattttctagtttagtcagtaagtaaactaaaaagggatttttttaatataaaatagagctgaccttgtaaacaaggccatagcccccccttcctaggatgttatcctggctaaagttgttggtagctgattttatttcaccataactgaagacatctggccttccaactacactgagaagctctgcaaaatccttcacattgtcagacaaaacaagggaatcatataaggctatgtttagttcacgctaaaattggaagtttggttgaaattagaacgatgtaatggaaaagttagaagtttgtgtgtttagaaaaagttttgatgtgatggaaaatttaaaagttcgaagaaaactttggaactaaacacggccataaataagtcccactttttccaaagagtaaacagttatgtaattttaactacctcccatctccgcctccatttttttccttttctgtctccaaagaaatgtccctgtggataaaaggcctaaaactatagtacagacaacaactccagctaccaaagctattttacttttaccagcactgtttttaataggaccaggatcaaccttattgttgccacctgcagtaggataaaatgaaacaaaatagatgttaattataagatgatcacatagaaccaatggctcttgatcaagttaggtaatgaacagtaccataaggagatacacttaatgctgagattaatggcccgtaggatccctgtctaggaatgcaacaagttccttttccagcccagaaaaggtgaatctccatgaaattttctgtaactctaacaacatactgcctcaaaacaacagtataagattttccatttgtttgtttctttatatcgaaatccttttctctgagttctccctgcagtaaattgaaaaatagaaggtgtgaatgcacaagaaaacgtgcaacataactgttgcacactattaaaaggtatacttattttccaaaaataacattcattggacctttataaaaaatccacctgaataaatatgtcgaaaatccttgttcccaagcttgtccatgtcgtgttgtctggaaagaagatctctgcaaattgaagctcgacgttgtaaaatccattctttagtccaatgccatagtatctcaatgaagaggatgacgttctggctgtctggaatagtacactatcaagcgtgtttgtaaactggcgtgaagtgtatactatgaagctaaaattagcggcttccatgaatttccccgtgttgctaataccccatcttgttgagttcgaaacatagtatgatgcctctcctaaattcgtgtcgtcgggttcgtaataagatttatctgagcctataatgggtctagtaccaccggagtcaactgcaaatgaggaatctgcaatttaacagaaaacataagagtgcagatattattattgcggagattaagctggtacagctaatggtgaagagataagtgctcaccatctggagaagcaggtaaacatggagtatttcgctgtaggcaatttagacctgatgacaaaatactacaagcacaaaatagttagaagagttccattgagaataatgaagaaaaacctaaatttaatcaagtaagggaagaaaccttctgtttgaactatctatcatgaagttgttccacaccaaattcctataagagaaatacaatgcagacacagtaatagttacttttgtaattttatagtcgcgtacagaggtggacatgatcacatgaattgatttgtttactttcaaatggacactataacttacaaaaacctacacttgtaaatgtctttccgtgctataccaagaagggaactttccagagagctcgttgtaggagaaatctctgaagaaaaaagaccaacatatttttattaggaaaagaaacaccaacatttatttaaaatatacaagtaaaatcatcatttagatgttgcactagatgatgcgtatacatattgtcagtgcaaagctacgaacaacagttcacaaatagataaaacgtaaaaaggtaggaaaagacttacagaactttaaggctagcaccctttgtgtctggcaagctcccagagaggctgttgtttccaagaaatctgagtgcacaatttttttagagaattacaaaaaaaaatcaagacgttacatgaaagaaaactgatgaaggcattgaattattcaaatatttccttacaggtaaatgagtgaattcagattcaaaaggactgaaggcactttgccagtgatgttgttaaaactcaagtccctgcgccattaattccagatatacaagggggggaagagcaaaaagtaaacactcatttcacttttaaaaagaagcaagtagtaccagaatgcaaacaattggcgaaaatagatcaacaatagtttaattaagttcttacaagtaataaagtcctacaaattttgagaagtccactgaagcaaggttgtcagatatcctgcaattcctcagtgttttgaaagaaaataatgcatagttaaggtcttccacatttgtcaaggcatagctaacccattaaagccaagtgcacaatcaggccaccatacagaacaatcaaggatgtcatgtttgacataaaagccaatgaagaactcccactcactaaatcgcctattcgcctgcatgcaccacataaatagttaatgtactgttgaccattgcacacaagcaaaatgtatcaccaaaactaaagcacgatggacttacaaagatgtcaaattgacgagattagaaaaacttgtagggatgggaccatcaaaattgtttccttgaatcctcctaagattgatatataatccggtcagcaatggaagtaaacaatacaccattctctcgaagggtaagtagataggccaggggttaattatcacgaacataaaacacatcattttattgcaaaggttcatttgaattcacctacaagaaaaaaatatacttacaactctgtcaaatctgataagctcccaatataatcaggtattctcccagtgaaatcattgtcggatgcccatctgaaaccgtaaaacaaagttggcacactaaacataccaagatgaatggaaaaagtccatatactgtcctccattttgatttaaagaccacctaacatcacaaactttaaagccaggcatccctgaacttggcaattccattcatgtatctgcctaaagtggttttacattgtggtttcgccattgttgaagtttaaaacaagcagtttagaggttggcatgcactagtcatcgttgaaagagaaatggggataagcaggagagaaagggaagaattcgacgtatatgtccaatatgtatgccatttaaataaaaccattatgcaaaaaaaccactttaggggttatatgaacggtttgtaaatttcgtagggttggatattcagtttcaaagtttggaccgttagaaatcttccatttaaagtttagtggagtatatgaacttttcccaaataatttttcgcaactgaagttatgttcacaagataatttacaagatcttcagttttctaagtttagacaaggctgatggtagctccccgcttagaccacaactatcgatatatctgcagttggatgatagaaatgattaaggtcaatttatttcaaatacatgtgcaatacaataaaattaggtcaagaagaagaaagattttacagttcctcaagcttggtcatgttttctagtacttcaggaagtggaccgacaaacttatttgtgctaatgcccctaaaacacaaagagagaacagtgagcaagtaaaatatatgtgtgtgggtgtgcccctttttggagcaatcttttctattgcttggcagagtactcttaaaagcaatgagcctctgatcgacaaacagattgaggttttcagaagttcaatatgattataaaatttcaatgctgtttatttattttcttttttccacaatacagaagaaataatcacttacaacgcaaggagattgttgagattgccaagctcccttggtaaaattccagttaacgcattgattcccaccaaacttgtagttttgtaaaaaaaaaaaaaaaaaaagaacatggcaagtgaatatgtcggaagataccatgtaatagcaagttttaagttgaaatgcttcgttattagaaactttagaactgtaattcttacagatactgcaatgccgtcatttctccaataaatgccggtaaagatcctgtcaaataattttgctgtaaattcctgaaagcacaacaattaaaaagcaaaaaataagatatttgaacttgtatctgcagaatctcttattggcaggaaggaagcatcatccattacataagcctttcattgcaatagcaattggaagtagcatgttaaatgttaccaaaatgatatgaggcacaaatgcactgaagtgaacggtaccaatagtggggccttgttgaagttggactacatattattataactactgaaggcaacatatatatgtacttaaaaaaaggcataaaaaagggaagtaaattctgatgaggaattgaacctcctgaaaaccaacatctcaaccaaaatactccctccatctacttttgatagtcatattttatcttggcacacagaccaaggataagtaattatacttatcatccatttaaacatgctactagtaattattttatcgtttgcctggtaactaacaattattattcaaaattagatgggattaattaaattaatatttactgcagaatatttttcaaaagtttgacagtgattgatagtgatacatattaatgtgctttatcatcaacacatacaagttagctagataggtgagattctccagttctgcaggtatcggaccgacaacatccaacgcgtacaccctcctgcataaacaaacacgtcagaaagtttccttgcatgacagtaacaagaaggaaaagaaaagatactgcaacagcgtgttctttgctaaacgatttgggtggtgttcttgtaagttttcagatccaattcattgtgatatgtgaattagtctgagagcattctatgcttgcaattaccagactacagatcttggaggaccctatggcctctctccagatcttcctctcaggcattccgtcgaacacccggcgtgcggtcgaagcaaaggttcagtcaaaggtgtacgtacagcttggtgatgtggcagacggtcgtgttgtcgtaggagcagtcgcacttgatgcccgggttgatggtttcgctgttatcgatgtcggtcgtttcgtcgatggcgatgccgctgcaagggtcgccggtgatgttccatgtcgtcggcggcttcgtgccccacctccccagaatcgcgttcagcgccgccactgtgttgagttcacatgtccacacaaacaccaattttgaatctcaattatgattacctcgctcccggtaatcaattgatgttcaattttaattttaaatctcaattttagattaattttgatgttttttcgtactttattttttaacaggtcgcaaattaatagcacgtctaatgatctaatctatgttttcctacctgttaccgtcgtctgcttcccgtacctacctgttagccactcccgcgcccgtccacccggtggatggcaacggcagcgcccgcttctcccccgcctgcccggcatccctggtggtactggtggacggggacggagtgtcacgatcctagtttctctgcagcagaaaacacttgaaagaaggaagaaattggatcggaagcagaaagaaggggaagaacagagctagagatgaagaacagatgaagaacaggggagagttggaattagatttgagtttgtttgtaatacaatcttcgaattccccaacttgttaccctgtcggcttatatagcaatttactattcagcctctctctctctctgacagtggcccagcctatgactactgggtccactcactctccgggaatcgcgtgttcggtcatcttgtgcacctggaccgacttcccaactgagcctctgttgcttgtcctgcattgtcgtcaggtgaggtcgccaccgtgacattccccccaccttgagacgaagcttgtccccaagcttcagaatgcggaaaacgtcgacgcaattcctggccattttcccaagtgatgacctgtggatcattaccagaccatcgaacttgcaactgctccaccatcttggatcctttccgcacaaaacggcgatccaacacttgagaaggaacagctgtcagaccctcatctttagactgcaaaattggcaactgtgattgaacaaattcagtaggtgctaaggccttcttaagttgagatacataaataactgggtggatcaaactggtagcaggtaaggccaatttgtaagccacagctccaatacgatccagaatctgatagggtccataaaagcgaaatgccaatttgcaattagcccgagtaaccaccgactgctgtgtgaatggctgcaacttgagataaacccaatcaccaactacaaaagatcgttcagaacggtgtttatcagctgggaccttcatgcgagcttgagcccttaacaaatgatcacgaatcaaattctgcatcttatctcgttcctgtagccaatccgacaactctggtgactgacagagagcattaacagataaaccaaaatatttgggtttgcgaccatatagcacttcaaaaggagtagttcccaaggctgagtgaaaggatgtgttgtaccaatactcagccaaagccaaccatctactccatgagaagggcaagcatgcacaaagcaacgaaggaatgtttccaaacattgatttaccctttccgtttgcccatcggatgatacgatgaactcatacgcaattgagtgccagccagtcgaaacaaggtagtccaaagagtgcttgtaaagattctgtcacggttggaaataagggattgaggcaatccatgtagcttatggatgttctgcatataagcttcagccacatcgaaggcagtaaagggatgagcaagaggcacaaaatgactatatttagagaacttatcgataaccaccaaaatacaattgaaagtagcagatttgggcaacccttcaatgaaattcaatgatacaaattgccaggcatgctcaggaactggcaaagtctgtaataatcctggatatttgacatgttcagacttagctcgctgacagattgaacaggcattggcaaactgaaccactattgtgcgcaaatggggcgaagcaaataaggattttacgcgctgataggttatagtaatgccagaatgccccccaactggtgaagagtgaagatttgctaaaattttctgttgaacaaaagaattagtaccaatccacattctgcccttaaaataaagaacacattccttcagagtaaaatcaggcacaacatttgcactaatgcacaaggtttgaagtttactcaaagcatcagaatcattggcatatcctgcaatgatttcctgaatccaatctggaaccatagaagatatcgctgttaactctgaaacagaaggaaatcgtgatagagcatcggttgcaccattctcactgcccttcttataaataatcttgtaacgaagtccaagcagttttgttaaagccttgtgttgccaaggagtagtcaaacgttggtcatccagaaaacataagctccgatgatcagtatgaatgaaaaactcagagtgttgaaggtaaggatgccaatgatcaattgccagaataatagccaaactttccttttcatatgtcgataatccttgatgacgaggacctagggctcgactcaaaaatgcaatgggatgttgtttctgcattaaaatggcaccaattcccttatctgaagcatcggtttccaccacaaatggttcggtaaaatctggcatcgccagcactggggttgtcattaaagcttgtttaagagactgaaaagcttgttcagtagttgcagtccaaatgtaagattgtcccttcctcaacagatttgtcaaaggtttactcaacacaccatagtatcgaacaaatttgcggtaataaccagttaatcccaaaaatccacgcaattccttcacattggtgggagttggccaattcttgaccaccaatatcttatcttcatctgttgacaccccatttggactaataacatgacctagataggccaacctttgttgtgcaaatgaacatttacttctcttaacctccaggtgatgttctgttaagatctgaaacacagattgcagatgctgaacgtggtcagataaggttctgttgtagatcaatatatcattgacaaaaacaagcacaaacttccttaataagggcgacagtatactattcatgcagccttgaaaagttgctggtgcacttgtaaggccaaaaggcattactctaaactcaaaatgcccatggtgagtcttaaatgctgttttatgttcatccatagcctgcatccgaatttgatgacagccaacccttaaatccaatttagtgaaccaccttgctcctgataattcatcaagcaattcatcaataattggcaatgggtacttgtttttcaccgttatagcattgagatgtcgataatccacacaaaatctccaagttccatccttcttcttaaccaaaagaacaggagaagagaaaggactggaactaggctgaataatgcctttgttcaacatctcctgaacctgtgactcgatttcatccttctgagctggagtatatcgataaggtctgacatttactggcattgccccaggaatcagaggaattgagtgatcaaatactctgaagggggtaatccatcaggctcctcaaaaacttgtgcaaattgagacaacagttgctgaacttcagaaggtacagtctctttggaagaagaatctgtaatggaacataactgaatcagatgtgagatagcctgtctatctttgaattcctgaaactgttgaggagaaatccttgcacactgactcattttagattgaattccctgtaaagtcacagattgttgttgccaggtaatggtcaatgttttcttgatccaatccactctcattagactatgctgcattaaccaatccattcctaaaatcatatcataacttccaagattcaagatcttaaagtctgtacagaaaacccttccttgagtcatccattcacaatttggtactgatgcaacacatgacagaactgttccattggctaccttcacctgagatttgttcaataatggcacaactccagaaagcttctaagcaatctgacaactaatgaagctagctgtactgctagaatccaccaaaatcaaaactctttgccttgaatgaatcctaacattctcatataacccacagcttcagatccatgcactgcctgaactgagattgccatcagaccctgattatcagactcctccatactagcctgataagaaaattcatcaaaacccaaagtggtaaacaattcttggacagcatttaactaaacagtactggcacatttgtgtgatggagaccacttctcggcacaaatataacagagtccttgagccctgcgctgagccttcagagctgaaattttgtcagtactgtttccaatcttggaattgtcaactaccttgcggtcatctgctcgagttaaactaccactattcaacacccggtttggtggcaaaggtagaggtaaagcacccttgaaagctggatgtggccgaacctgcaacccattgtcactcttcttcagatttgaagctgattctagaatcacttcttcctgtaaagaagcaattgccaatgctgcctccaaatcctttggccgttgaagaagtactgcatttctgatttctcgacgtagtcccttagtaaaacgatgtgttaggtatctcatattcaaatctggatcataagctagcaattgattcattaactcatcaaacttttcataatattatcacaccgggcctacttgtttaatgttatccatttgtctaatgagcatctcatgaagatctctatcaaacttatttgacacagcaatacaaaagtgctcccaattcgggtacctaacatgagccttagaggaacgtaaccaagatgaggccctcccagaaaagtaaatggtggctatcctaacccaaagtccaggaaaagtattattcacatcaaagtaatgctcatacctcatcttccaatccactggatctgtaccatcgaatttagggaaatctagctttggaactctatggttgtactgacgcccaaattgatccccatcacattccccatttccaaactcagattgatcaaattttttcatcgatgtggagggaaattcgtacgtacccttgaccggagttgggcctagggttgttgccatccctagtacccttccccggtgttcatgagattgcagacggctattcgcccatttgcttccgccttccgccgcagcaacttgagaagaagatggcggcgtaggcagcaacggtgctttcctttcctagtccgtcaacggaactcgaggggaaagcgtcgttggagaagcttgcttcgacttgccgaccagatccagttgcacacggagttcgccgacttcctcccgcgattcctgcacggctgcctccacttgtggcctccaattgttcgtgtcttgatccagcttgacgacggccgcttgagtctcaccttgtgctcgattcagcaacaccagggactcttgaatctccatcagaagcttgccgaagtccacgttctgcttctccatatcttcaacttgaagttgcagacgggaggtgtaccgtggtttctccaggatcgaagcggctctgataccaaaatgtcacgatcctagtttctctgcagcagaaaacacttgaaagaaggaagaaattggatcggaagcaggaagaaggggaagaacagagctagagatgaagaacagatgaagaacaggggagagttggaattagatttgagtttgtttgtaatacaatcttcgaattccccaactcgctaccctgtcggcttatatagcaattcactattcagcctctctctctctgacagtggcccagcctatgactactgggtccactcactctccgggaatcgcgtgttcggtcgtcttgtgcgcttggaccgacttcccaactgagcctttgttgcttgtcatgcattgtcgtcaggtgaggtcgccaccgtgacacggagacagcgacgcccgctactcccggcggggcttgtctggtgtgctcggaggtggcgatggatggccacgtcagccggtactcccacgccagcctggcgcgatggcagcggtggacgcgacggcaccctcagtggtgaaggtggatggtgacggcggcgccaactcccgctactcccatacctgacacagctcggccgtgcgctcacgtcggttgtgcgcgacgaccaccgccacccacgcgctcccgctaccggccaccgaggttgctccctcggctctcctcgccattgccatgggccatggtctccggtgatatgaagatgaggagttggagggaggaagaagaaggacaagggtaaaatagtccaaaatggtattctagcatagtggtattttatcgaagctagtttaagtgatggtattatagaaccactcttttgcgatagtataatctcaaatttctcccgcccaacgccggcagtcctgttcgtcatccgtcgtcgctgctagccatgccgctagatgcaactactgatcgcctccgcttcgtactcccatgccgccgaactagcaggggcaagcaggaaccacagaccttttcatagtgtcaccactcacaaccaggcttgcaagctagcagaccaacccaccatcctgctagcccggaagataagacgttgcaggccagtttagccaccgggcgtcgctcctcccactgcttgcgggcactgctggccagtctactagcggtctagctaaggggcagttattgcaagaaaaaagaagaactggatctggatcttgaggaaaaatgaaggaagaaagaggaaggtgaaggtggctcaaggatcaggggaaaggactagtgttgatgggatgtgggagggaagaggcgccgccacccgccgcgtccgccagcaccgtcgcggcggcggcggcaaggcgcggagtgtgaggagggagcgcaggttaccatgacgagtttgctaattgcaaaccggcaatgataaaagaagaggaagagctcgttgagaaggaattgaagaacacatgttggagacttggagcgactcaatttgataaactgatacgatcttttttgtcataagttgattatccctttttttttttttggattcaaccgtgttgtgcctgaccgattggggggttattcttagtgatttcgaagggttcaagctgttgagaatgccattacgccaatcgaatcaattagaatacataatttgttttatgcttatacgagataatgcatttggtgttgggtatgttttctaattttctgttcatttgttctgcaggtaaggcacgcaacaagagtcggtgtttccggcttgtgttatggttccaacacggttcaaggaggcaggtcacaacaagctttttctttaaatacgtaacgcataatcttcataatattatttttattcctttacgacacatgaacattttttctagtatacaaaagtaatattcacaaaatattctttttaatgttacggcttataatcaactataagtgaaataataggacatgttttagtcacttacagtggaaaaggtgtactagtactaaaatacacaagttgttcatcgccttcataatagagtttaatctatagttttgggcaccaatatggccaaaattttgaccgaaataatagtgtgtgtgggggaggggggtggtattttaaacccttatataataatggaactttgtcgtccaaaattttcttccggaactgtgtgtaatgcattagtacgttatagagtagaagaaaatcatgaaactatcgatctggctagctctgctttcaatagaagcagggttaagtgacctttccttgaagagggaaaaaagatgattctttattttttcaatgagaaaaaggaggtatcttctggaatttggtccaaaaaaataattgaaagaagggacaagaaacagccaagaagaaaagaattctactatcaccgaaaagaagattataattaacaagctaacaggatcaactctgcggtgctaatttgtctttaaacttgtctaggagaatctgtcttcaaactgctagacgcaagaaacaaacatcaaacgcggcggcctctgcttttctgcctggtagcaggcgctttattctcagctaatttgttttttaatcttaatgaatcgataagcgttcagtctccgttccggcgaaaagacaaaacaagaaaacaaacatcaaaacacgtctctgatctgttcccatctctctgaagactcaaagaaacaaaaaaaaaaaagaagagagaagctgacatgtttgcagcacttgtatgtacatatctctccatttctttttttatgatgttggttagatcaaaacattatgggatggggtagtacatagcatataccttcgacaggatcagttctcggtgcctggtgagcctgagcctgagttgctacaacacatgaacacgcgaccaccaggcagtagtacaggccgagctgccaaccatggccgcctccgccgccgccgcaacgccttcccatcgatctcttggcaggctctccgtcgtcgtctctcctcttcctctgcataaaattataaaaatcgaatcttggtatggctatatgtatattagataaacattgcatttagatcgaaccccaaaatttttcacaccgttacatcaaacgtttgaacacctgcatgggtattaaatatagactaaaaaaataactagttgcacagattgcgactaatttacgaaacgaatcttgtaagcctaattgctccatgatttcacaatgtggtgctacaataaatatttgctaataacatattaattagacttgataaattcgtttcgcgttttactgatggattctgtaattagttttttttattagtgtccaaacatctcatgcgacgtcctatataatatctgatgcgacctagcaaaacctttatagatctaaaacacccccttacatttactccagataagcagcaacctgtcggcaccatggatgcgcaacttgagcagcagccagcaagttgcagacaagtcgttcaaaaaaaaagcaagttgcagacagccagacaggtaccagctccagcggaagtggacctcgacaatcaatcgatcaccatgtgattgtactgccattgattatttggaagactaatcaacgccacgtataagatgtgtactgagatgacgattgaactggtgtcaagttgaccttatctgggtcgtaatttcgacttcataggactgttgcttgctttattaatctctgctaaagtcctgagtatattcctggcttctgcgcgctacaaaagtgcacacgatacacacccacgcacttaaagaaaagaaaccaaaagaagctcaaagactatatatccgaagactagatctttacccatgtatcaggataaagaaattctctacttttaaacattatacttgtgtttttacccctgttaatactcgtggtaatccaatatcttctaaatcatccttcattttcatttatttcaccctataatatactaactgcatcttttctcttctatctaccgtataattcactaaactacagtcatagagaccttattcataaaatccgacatcctaaattcttcaaaaccaacgccttggatcatcccacgtttccctctcacgccgcccacctgaaaatcacgttgcctctgcccctcctctctctctctcagcagaaaataccccccccaccctcatgccaatcgccctagaaccgtcgctgtcaccgatccatcaatgcgccatccttggctgtcgtctccacgcctactcctgaatcctcgtcttctcctcgatccaccgtcactactagaaaaatcatttttaatagtgttacacttttattttcactggcgggtttaataaaaatgtgcttgtgaaaataattgagtgggattgcgaaaatccattttcgttgacagttacttaaaagaagtctgcttgcaaaaatagaggtctttttacaagcggacctcttaaataaccgctagcggcagccaagaccgattgcaaaaaaattatttcactatattaacagacgcacaccgcatttcctctctgcttctcacactccgcctcctcccttctccctctcctcttactcctcctcggtgagcagcggcgctctaggcaccggggtcttctcctctccttggtggcattctctgcgcggcaagcttgggaagaggccagatccgccaccatgaggcgtcggcagccgcgcggggaagagggcggtggcggcagcggctctcggcggcagcggcgtgggggagggggcgatggggagcggatccggcgcctcctccctccccaccggcggcggtgaggtggtgatgacgagaggctggcggcggcacggatttgtcgagctcgactagttttttttttctgcctgttgttccatatgatccagatgatgcagatgttttgtgcatgttgtgatgtttgatctgtgctaatgatgattttgtattttgtgtttgaatttggaaatgagcagccatatgcatatgaattgaatttgaatctagatctctagatgtggatttgaattttgaaaatgaatcaatgggcttttctccaaatcttcgctggcggcttggcagcaacatggttttttttgccccaaattagattttcgctgacggccgatttaacacagccaccagcgaaaatgaatttttgctagcggctgatgtaagatgaccgctagcaaagatccatttttgctggtggctggcttaagatgaccatcagcgaaaatgaattatcgctggcggaatcgtgatcttcactagcctttgttttgtggcggctctaaattccgccagtgaaaatctaaaatggccgcaaaaaaaatggttttcgtagtagtgcgtcgtcgccgtcgaatcctcccttatcggcttcgctcattaatctcatctcccttcgatcctctctcatcgcttccgctcattcgagcaggtacaatagcaggctatgtcagctataaacacatatcgatgagatgaaagaagagagagatgaacagcgggctacagatttgtagtcagctgcagcatgggctacaagatgaaatgtatgtatgacaggtgggaccatgtactaatagtgtagtatacatttatatgtgtttatatgttagtactattatataaattggctattaaattgactacaataatttggagccagtagttggctatatattaaacttgctcttaatccaagcaaaccacctgtctccatcaaggaatatttgagcctccatcgtcgtccacggccactgctcaaccaccagtcgccaccgccgccatccacttccaatgtgcttccaccgcctgccgttgtccacatctatcactatgccctcaacgacatccattcaatccaaggagatcaccctctgcccagacccgaagacgaccagctgctgcggagctcttgaatcatggattggatagtggagtgagtgaacctgccggctacggggagctcgccggaccaggtcttgttgccgtctatggtcattacctaagctcgaacacctgcaaacacataaatgtccatctttttttctgtgacaggtagaagatgatgaaattgaagtgttgtcaagtttctccgaggtgtttgtttttccgatggttaaagtgtagtacaaagtgtgcaaataaaatcaatgttttcaactcattcattaagtatccatgactacaaattattaggacttgatctagcctgagatagccaaggatcgattcattttttttcttttcaagctgtgctaatgtatgtatgttcagaattacataccatttgggttcacatgttcagaattatctaatctatgtgtcactagagtaacaggactgacattcatttatcacttctcctgtagtatatttgctgtaaatatatgaaacttgacacaaatctcacatcttaatagctcaaaatatatgtaacagtactcaaataaacttttcctggagttttctattgtgctttatgtattatagttttcagatattcagaacctattttatactgttcattactgataatatgggaagcattggtaagatgtacaggaatgatgattgtagatatacagacggtacaacaaatttgtctattaccaataacatgcaatttgatgattttgtgcagtccttgattaatgacatcttgaagtacatgaacagttagtactccactagaccttgaattatgtctcctcttttatggatatactttctttcattttaggtaagtatcattttatttagagtttgatttggaaaaattggagtaataactcttcctgattagagctaaattttgtacaaaatctttgagtagcagaattgttctgacctaaaatggagtcctaacatgatatcagtgagagttacaaattgtttgtaatgtctgagtacgaggaccgttctaatttggcaactttaatcaggcagtgtgaattatgcatttcttgtgttcatgaacaatatttgtttgagaagtgaaagatcggaggtatgttttgtcgtggtggatgaacagaaagcccggtgaggatggcaaacatggagtgaagagggtatggtgtatgctgtggcccgaagaagggcctcctatgatggaaattgtgagcaaggctggccctcgaatccttttttttcccctgatgaatatgtaatttcgatatgctgttggaatcggttgaaatctatttgtaactccactgtctcatttccgcatcatatatgtatccattgctgaaagaggtgtaaagaggtaaatagatagcgtgtacccgagcggactatgcatcattggattgtatctatgtttctgatggtcttgtgggtttgaggccttgagcttgagaatgtattttttttctttaccggttggtctttccgtcaccttgatggatgattgttactgcagtttttttagtttccttttacctaactcatttatttatgaataaaaatgtagttttaataatttacttattcaattgttttgggataaaattcttatttgcctctaaaggttgacatttaccaaatgctaccatagcattagcacagataagttactagtcaaactaatccaacctctggcagagactgccaaggcccttggtgctaactacatggataaaattcatcaaactaataacatgagctatgaattactcctagaaatcttggcacatatgaaatagcatgattatgaagtgaatcaacaattttgtgttactaacaatatgtttaggatagaaaaatacggatatatccctctatgtttagaaagaaattaagtgcgggcgtgccagtgtatctaaatatacaatgtaaaacaaacacaaaagagacacagaaacacatgatctttattaattgaattaacaagatacagtttccatatataatataaaatatgcgcgccattgcctgtcgttgaacagatccgacatcagtgatgtggtcttctgattcctggggtctcgagagactccccgttaattacctccgcagatttaggcctacaggagcacctcctattaagctgcttgtggtcgtctcatcgtcttcgcttcgcattctccatgcatggttatgatggtgatgtagatgtgggcgccggcaatgcatccacggccttgtcggtccgtgcgccgatgttggtgatgtagccttagggtcggcttcgcccgccctcgtcgtctaacctcatcggtcttgaacgacgtgtcggtgtagattgcttgaagaagacatgcatggaactgcgtagcttggacggctcgacgtcatagcaacagcatcggaatggtgttaaaggtaagatgagttggtgaagtcagttggtgtacacaacagccgaataaacatggctgggcatctcctgactagatgggatcaaacgaacgaagagttgacgaagacagttggtgtagacggcagccggattaaacatggttgggcacctcctaacccgtcatgcctcttatacaacagggacttgtaatgaagatgttgatgaagaagtcggtgtagacagcagccggatgaacgtggctttggcacctctttcggatgatggatcagcccataaaagggctctatgagggtgccgataacaacagcgaccttggaagaagtaaatgcctcatcggcggaacggctgagggcatttgttggagtagattcagcacgaacggttccctggcatcacagataacaccattctttcttcatgttgacgtagacgagcgacgctccaatacgcagatgagcgacagcattaatctccacgaagagggagagcatcacggacgggcggcatctcaccttggcgtaataaagtgaaagcatcacggatggacaacacgacgactccgacctgacgaggtgaagggcatcgcggccggatggcatctcgtagccttggcgcggcggagagaaagacatcgtggatgcacgaaacgacgacctcggcttgacgacgatgcacgggcaccaagcagtagtggcgctccgacgttgcataggttgagtagatgttgatgatgtcgcaatgcataggttgcgaccagcaaagtaaggacgctcgacgtcttgtcgacgtcgtagcactaggtagatgcgatcttcggcacgctccggctgggtggcgtcacaacggccttctccggcaggtggcaggtgatggttagttgacggagatgagctctgcttggcagcgcctcagcgactcagcgaagaatagtcatcgcggacggataatggcatcacaagtccggcgcaatgaagcagaggtgtagtagccgaacggcatgacgacagtgtgcgggctccgggtagcggcgctcactggtggagaaaccctttgtagtcccggttcgtaacccccctttagtcccggtttccaaaccgggagtaccaatccgggactaaagatcgctatctttagtcccgggtgaaataaccgggactaaagatcgagctgacctttttttttttgcatgaccctgttgctgcatggtttatatatatatatatatatatatatatatatatatatatatatatatatatataaaccatgcatatatatgtttcaatacatatatatgcatacatatatatatgtatatatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtagtcgctgctagctcagaagctaaggaccggtgaattgtgtttccgtcgtagtagaattcacccatgggatcaaggatttcttcgttgatgaatcccatgagttgttcttgaaccgctgcgataaattccttatgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtagtagccgcacaagttagttccctgcttttgctttgcgcactacaaataaatgacaaattaacggcgtgagatctaattaatatacagttgtatgtattaatttgaatcggagaaatataaatgtagagcatgtgtactcacaggaaatttgaacctccgcctaaatctttctctccagttgccgcggaccaaatgacggaaccgataccaagccctacatggagtttaaagatatgattcgtagtagaaataattaacataacaagaatttcttaattaacagagaaacttatgccagtacctgtctataagttcgaaaaccttgtcaaacatagactcttttttatccattgagtcatatacattgacggtgcaggccgacaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtacggtaacagtatgaacgtcttgtaatgctgcgccgtcaggagatggatgagattgtcctctgtttcctgcggatattggtcgagcattgcaacgtttactctccgagggtcgataaatccagtatcgaaaaccctccgccgtcgggccctttgaatctccattctataacgataaaagggagtattttattttatatagtctacttatatacaaggacctaattaattaaaggagacgtagtaattaagaattataattgaacgatatacttacaaagtccagcaactcataatagagacgtcgaaggcgtccagctggtatactttgtagatttccttgaaattgatccagagaatatcatctccttgcaagaagtccgggtccctgatcctcgctccgatcatctctctaccggtggcgctcatctccacgtacagctgatggaacttgtacatttgtgtgggtagggactgcaccagctcgggcttgacaagcggtttaccgagttcgtacatgtatttcaattccgccttttctattggttcaactcctagcaattgatccgtagttagaccggtgtcaataataaattcttctatcgtcatgtctttcccggtcaccaacggctcgatctcctggtttggttgctctccaagctgagagactggtttggactttccagaagatgctttcttcagcgttcgctcatagtccgatagcttgatggcctccttgacaggtgcagacatacccctgaagaagttcatgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccctgtgtgggcaggcggtggagctggggggcccttgactttgaaggtgccggaagaggagcttgcggaggagtaggtgtaggagcacgaggaggagtcgatgcaggatcctgaggaggagtcgatgctggagcctgaggtggagacggtgctggcggagtatgaggaggagacggtgtaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcaaaaaattatttttgtctgtaataaattaagtggataaatcgtaataagcaaatatatgacttataattaataaaaattccaatatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaatttatttatatggataatcaatacatccaaaatagtttacatcgtgtacacaataattacggcattacatcggcggtgacggttgaccgcacgtactttctcctcactattgttccctccttgtgatcgctgcgtgagtaagggatgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaaacagaggaaccttgagaggaccatagtcaagttcccatatgtcctcgatggcaccgtaatacgtggcagttgttccatcatgtcccatggcatcgacacgaacagcactgttttggttcgtgctcttcatgtcttgggctctcgtgtagaatgtgtacccattgatctcatatccctagaatgtcgcgattgacccagacggtcccctcgccaggaaggcaagttgttggttgattgactcgttacccatgagatgttgtcgtagccacgcggggaaagtatcaatgtgatgccgtgtaatccatgcatcggacttaccgacgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttctaggttctcatactcctcaccgtgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcaccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcacagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacatttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttccccacacacattttctctctcatcaacttacaactaaattttggagacaaaaaaaagtgtgcaaaacataggtgcaaatgtagtatgacaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtagttacgactttagtcccggttggtaatcggggggggcctgacatgacctgacagcattcgaaccgggactaaagcgggactaaagatcaaatatgcccgttacccttttgaaccggaactaaagatcatctttagccccggtttttattgcatccgggactattgtggaaatcggccgaccgacgaaagatggtttctccaccagtggctccgaccagcgatctcctcgagcggctcggcgacgagcgtgagggaaatggccaagtccgcgaaagcaagcgagcatcgatgatgtcgcgaagagactgcgaccggcaaagcgacgacgtcccgcgtctcgacagcatcacgtcgccgggtagagacatcgtgaggaagactgctgcgctggtgaggatgagtagatcttggcggcgtctaaagaagaggttgcggccggcaaggcgatggcgtgcagcgtctcgccgacgtcatagcaacaggtagatgcatcatgagatagaagccgcagccgggccggcgaggacgtcctgcgtcttggcagcgttcctggatgcgggcggctcggcgacattccggcaattcgaacgagacttctgtcgggcacggctcagtagtaaccacagcttgctccggtggggcgcgcggcatgatgatgacctccaaaaactagcatgcccgacgcggtacgaggtggtttgatgtagacggcagccggccatttaatcacagctcagcatctaattgaaaaggcttgaaatcaacaggatttgtttagccatcgcattgacaacttcttgtgcatggcactgaggcatggtgatgatgtgtcacccttcggttggtcggccacgttgccataacatgtatttgctgaatggagttggctcggcatgctgctgctttgcttcggcttgtgctcctgccatgcgatgtgtgtacatgaggccgccgatcgccggtctgatctgtagcctaacgatggcacgtttcttttagcttgggattattataatctaaattattgagtcagattataataagctagattattataatctgtagtagaataaacagttagttattttttttctagattattagagtctagattattgggtttgcaagtctaaagagggagttgagtggcatgatgggtaatttttcacctaataatatggaaaaagctcacctaaatgagcttatcagattataataagctaggctccagattataataagctactttaataagttgtgtttctttcatcttactcctaatattctggattataataatccggcgatatttgttgatgtagatcgataaccaccatcatctgcacgcagcgccgccgccatcgtgaggaagacagtatcgccgtcgtgagaacagtagcagcgccgaacatcggccgcgtcggggggaaggggctgcagccatgatttgatacgctgtgcgtggtggaagcaggagtcttggcaatcgacggtggctccggcgatcctggcgcgctccagcggagcagcgtcacgacgactccgacatggtcagtccgctccgccgcggtgaaacttgcagcaaagcgaggacgtctggcaccttggcgacgtcgcggcttctagtagatgcaccaccagcggcttaaattggcggcgtcgggtccggacgtctcgtcaactcggacgggcgccggcatcgatgaggcttctgtggcgtgtagatgaatcggccagcgcgactttcaccggcggcgaccatatgtgtagatggatgtgtgcatgttgtagatgaaagaaaaacgaaacaatcttgctagcttctagcttggtagccatcaagttccttcttcctcatcgaagtactccctcctgtgcttgccgatgatcgggtcaccgcgcgcgccctctcctaccagacgccggagctccggccgaagtcgctcgctgccgccggtgcgtgtcgtcgctggatggatcactgatgagaattgatggatggatgtgttgacactggtggagaaataatctttgctaggtcgacccaaaaccacaataatcccggttccaaaaagaaccgggactaaaaatgatctttagtcctggttgaaaaccccataggcattctatgatctttagtcccggttggtgttaccaaccgggacttaaaatcatctttagtctcggtttatcccctgtcagattgatgtcatggggccgaagaggtcctggttggtgacaccaaccggaactaaagtgggttggtgttctagtcctggttggtgttcccaaccggactggaactaaaattcaaagcg

SEQ ID NO: 49525 - DNA, 7296 bp, Oryza sativa
  unsure (1)..(7296): unsure at all n locations
ttcccctccacctcctccccttcctcatcccctcccctctcctccacctcctcctctcccctttcctcccatcctccccttcccattcggcagccggcggggccatgctcggcggcgggccggtggccggcggggccacatgcggcggccgtggcgggcggtggcaacggcgttgttttctctcttttttttaattcatgattcatatgtataattttgtgatttattggatggatttgagatgacctgtgatgaatttgatttgtgtataattttttaggatgtatttgatttgtgtgtatatgtgactttaagatttgtgatgtggatttgggatgttactttatttgtgatgtagatttgggatgttattttgatttggggatatgcatccggcatcccacttgatttgggagaaaataaaaaaaagaaaaggggaccatctaggactgccgctattctctctttactccgatttgggagaaaattaaaaaaaagaaaataaaataaaaaaagagaaaaggggaccatctaggactgccgctattctctctttactccgatttgggagaaaataaaaaaaaagaaaaggggaccatctgggactgccgctattctctttttactctttgggagaatactacttaaaaaaataagaggtgcttccatcgttcgtaaaaaaaccgggcgaaaaaaaccggatgaaaaaaaaaccaatctgtccgataaaaaaagggtgaaaagaaaaacaaactgtccgatcaaaaaaccgggcgaaaaaagaaaaaaaaaacaaattcgatcaaaaagaccggacgaaaaaaaccgggcgaaaaaaagaaaaaccaaatctgtccgatccaaaaaaaaaaaggcgaaaaaagggaaaggaaaaacaaatacgactacgtcaatgcagtaaaaaaagagcgaaaaaataaaaagaaatctaaccgggcgaaaaaaaaagaaaaaccaaatctgtccgatccaaaaaacgggcgaaaaaaaggaaaaaaaacgaatccgactacgtcaacgcagtaaaaaagggcgaaaaaaataaaaaaatatgtccgattccaaagaaaaataaattatatgggatgcttatatctctatctctactacttaaaaaagagatgtttccttctttcgtgtgaaaaaaatcaggcgaaaaaaatcacccaaaaaaagcgaaaaaaacgggagaaaaaaagttgggaaaaaaccgggcgaaaataaaatccgattctgtgtaaagaaaagggcgaaaaaaacaaaaaaaccaatctgtcctattaaaaaaaggaatcgggaaaaaaaatccgatccaaaaagaccggacgaaaataaccgggtgaaaaaaagaaaaaccaaatctgtccgatcaaaaaaaaggcgaaaaaagggaaaggaaaaatgaatccgactacgtcaattctgtaaaaaaagagcgaaaaaataaaaaaaaatctaaccaggcgaaaagaagaaaaaccaaatctgtccgataaaaaaaaggggcgaaaaaaaggaaaaaaacgaatccgactgcgtcaacgcagtaaagaagggcgaaaaaaataaaaaaaatctgtccgattccaaagaaaaatgaattacatgggacgcttatatctctatctctactacttaaaaaataagagatgtttccttcgtccgtgtgaaaaaaatcaggcgaaaaaaatcgcccaagaaaaagcgaaaaaaagggcaaaaaaaaagtcgggaaaaaaaccggacgaaaaaagaatccgattctgtgtaaagaaaagggcgaaaaaaaataaaaaaccaatctgtccaattaaaaaaaaggaaacgggaaaaaaatcaggcgaaaaaaatcaagtaaaaagaaaaccaggcaaaaaaacaaatccgatgtaaagaaaagggcgaaaaaaataaaaaaccaatctgtccgattaaaaaaaagaatcaggaaaaaactatgcaaaaaaaatcaagtgaaaagaagaccgggaaaaaaaacaaatccgattccttatacgcggtaaaaaaggcaaaataattttaaaaaaagaattatgtccaattcaaacgtggtaaaaaaatcgaatctattatatgtgaaacggtactatatatctctatcttctccatctctctctcttctctatatactacttaaaaattgaaaatgtttccgtcatccgtaataacaaaaaaaaagggtgaaaataacattaaaacaaaaaaaaagtctgattcaatttactttcgtcatctgtaaaaatcttatcttatcttaaatggtccaagccgcttggcgctcgtcaccgtggcacgcctagccggaccgccgatgccgtggcacggcttttcgccgcccttgggtgcctccctctcctcagccaacaaagcaggagccgctcggcggtcgtcaccgcacgcgcgcactagctcaccggggccgtcttcaccgtcgttccgctcgctcatcgctggagagaaatgggatcaggagagagggatttgggagctagggttttgcccctctcttccggttggcacttcaaccgacgcggggacgatcggagccatccattagatcggatggctcagatttgcccagcgttgggccgctgccgctgctaattacgctgcgcccaatgggccacggaagtgcatcggaccgtcctcatatatgtgggccgcgctcagctgctcggcttgcgggccgtcaaattgactcagctcgctgaagatgagccagcccaagtttgggtcggcttgggaagatctgggccgaaagcaaatttgatcaaacaatgtggctcagattttttaaattaatagaaaaaatgcccgcgcgttgcaacgggtgaagtctattttaatcttattagtgttatatggttctagttaagatgaaattcattggggattcgcttgaatatatatatatatatatataaaatcatgcgctgcagttaggagtctgattgtctcaagttagcatgtgagttttttttaaacaagtttattagataattccttctgtattactaaaagtgaacgatcttaaaaattgactcaaatacggatatgtatttccaaaagcaaacttacttaaaaaccgattcaaatacagataacgtaccaaagtactgaaaaaacatcttcaatttttatattttagattaaagtcgtcgaataaacttctaagtaggctcgaaaaataaatccaaaactaaatcctaaaccctatgctaattcatcaaaatagactcggttcaaactatttgttgatatatcacttgatttttaccgatctaaggttttcatggtgccactatcaaatggtgtttttcccgttgcaacgcacgggcactattgctagtaaaaaaaaaagaaaaggggatcatctgggactgccgctattctctctttactcccggttggttggtgttaccaaccgggactaaagacaatcgggacaaaagattcatctttaatcccggttatttgaaatgggactaaagatagcgatctttagtcccggattcgtagtcccggttaaaaaaccgggactaagaggggttatgaaccaggagtaaaaaacacttctccaccagtaaaaaaccggggggtcatgacggcgccggatgggagtcgatagatggatgtgtgttgatcgattgatcttccagcatcgaacggcacccggcgggccacacttttggtgtgccatgctgccgccggccggcggcgcgcacgttggcgtgcccttccgccgaggctctgtacttgttttctcttgtgtgtgttcttcatatgtgtgtagatggatctgcttcttctccgttgtggttctccatctctgcccgtgcatgcatgtgctgcaaaatactataagaagaaacaatgtaattagcgctcttacctcgggcaaccatcgagctcggctttcttcccatgatggctgatggtcagatgcacctcctcctgccagacgctgntgccgagcgtgggccgcgtgcaccgcttctgctccggcgaagtcacgtcaacaaggcttgtgccatagcgatgactgagtacctgctcgcgtccgggttctacgcagccgccgccgatggatggatcgatgtgagttgaatgattgtcgatgcccccttctggctgcctctcggtggctttatataggccgcggggccgccgcccgcgatctcaccgtcggttcacctccgatgccctccgggccgaaggatcacacagataaccgtttgttgcatcatcctggcgatggataaacctgcgtaagggagtacctatacatctttcgaaagatttttataatcgtataacacagatttttaatctttgtattaaaatccgatagatataataaaaagcaaaaagcaattaagaaacaccataatgaacattaaattaccatatcctcaagaaaaagaccaaatccaatacaaaatttaaaatttacaggtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaagcgatacgtatatacgcgtccaccctgcccgcttgccggagtatacgtcacacatacagccagcccatgtaaccatagcccatcagcccatgtgtgtgtattacgtagcgaccgattgagttgctgatggtttgccgccggccagctacccacgtccatgcatgtatatatatatatatatatataggcgtgtgaaataatcagcctcttgtcctctttgctagtttgctctcatgcatgcatacgtacatatatatagccaagcatgtacatatggttgaacacacacatatacgtatataggacatatagatggacatataccagtacgtgcatggctcatgcatgaatcaatgtttaattaactggcttagcacattggcatcgctagctaaaccggttcctgaaaatggccattaaaacatgcaatatatatgtagttatattttataaatatgtacaaaataccgtcaaacataataatgaaaaaaaaaatcatatgctaagcattagaatttagtgcttgttttaccaatgctgcaggaagagagcaccctcgcttttcttgcacctgtagcaagagcacaagaagcagcaagtgttaccacgctctgccttccccgaatctcttgtgccgcaattctcaacgacgcggccatctaatatgtgggtcatcttgggttgtaccatgggcgatgacacatgcgtagtccgatccgcagtgaagtggagatgtcaaactcaattggtaagctcagcggtattctgaattcgcatgtgattgcgcccaatggcgcatcccaaagtggcaccctgtctttcatgcagtgctcggcatcttctgcaatgagcacggtggtatcagcttctctctcccttccccttgcttgctgctactgactctcgatggcctggttaagagagtgggggagcaaaaaattggaagtctccgaccccaagatttcggagggatggcgctggtgactggtgagggggatcggtatcagcgggtgcatccggtgggtggaggttggggctagattgatgcacagacagggaggcgcagacctgtattgttgtttgttggctgctgccctgctgtgacggtgcaaagaggaggagggagcgggcagagtgagtggtgcatagcaaaggtgctgccgctctaccatttgtataaaaaaagttacaacaaaataaatgataattatataatttttaataagacaaatgattgatgagtaacatatgagaagatgagaagtgattcaactggctaatacaatataagtcattctagcatttcccatattcatattgatgacattaacatcaatatgaatataggaaatgttagaatgacttatattgtgaaacggatggagtacatgttttctcttacatgaatgttttttttcttttgaaacggataatggcaaaagacttgccagatatattagaataaataaagtagaggttacaaaagattacagtctctaatgtagcaggggcctaaattacgaaattacagagattgtgagccccccctaaacaggtctctacctcaagagagtctagagctaataagatggcctatattttcttttatagtaaaggccacttgcaactcattttgtgaaacatgttggaaatttttgcggtttcgctctagccagacattccaccaagtagttagcacgactcctaggatttgttttctcatagcagttggtgttatagaacttagggaatcccactaatctgctgtgctttcatgagtcatatgttgaggaaagaaggaactataacccatctagcttgagacatggtgccaaaccctgcttgtgaaaagacactctttttctaggtgatttgaatgttcaaaagcacttctacatgggctgcatatccaatcacatggccaatgtctcttgagaaggttttcagctgttagtgttctttggtgcaggatcagccatccgaaaaagacggtgttttggttcagaatgcgccgtccaaagagttgataaatttgcatatgttatttccccttgaaattgcatttgatatgcactatttgccgagtattctccatttgcagtccttccaggagatgtcgtttgttctttgtttatctagaacgacatcttgtattttgctccctagctgaaccagttcctcaatctctaaaatagatgtaatcaggttaagcatggcaatccaatagttgtctttcaattccatccggagattatttccctttcttttggcaagcttcaaaatagagggtgcaatgtgttgaggtgctcttccatcgagccaatggtctgtccaaaaactgattttgttcccatttcctatcgagattgtgggatagtattttgatgaaaatgtcggcgagcaaaagccggttcaatttttgctggtttaaaatctaaatacgtgggacccgctgcaatgtgagcaaaaatatattgctactatcctgctttgggacggtgtccgtctcgatcatgtatccctaattgtccattgctcgtcccgcttcacgcggatggacaagacgaattgaaatcgaacacagtaacagctgacaacggacagaattttgattgtacggaatcatctttaatttttataagaaaaaa

SEQ ID NO: 49526 - DNA, 4032 bp, Oryza sativa
gccccactcgtgctccgcttggaccaccgccgccgcggcctcacgctgtcgtcctcaagatgctgccggccggcgcaacgacggcccgcctctccacgatggacgccggtgcccacctctcccccatcccctccacctcgccgcgcgccgccgttcgcgccgagcgctggcctgcccccgcgcgccgctgcccatcgcatcccctcgccggcgctcgcctctccgccatggcgtgccggcgtgcacggtgctgcctgctgctggccgatgaagagagagaaagagagatggaggaagagagaaagagtgtatgacatgtgggtcccactatttttaaaaaataaaatgctcactagactgccacgtcagcaagtctatcccaaaaccacctaaaacagtgctcaggggggtaatttccccggtttcaatagttgagggtgtagaatgtctggtttttgagttcgggggtgtaattcggtcaacctcgatagttcaggggtgtaattcgtacttttttctttttataataggttgaaatcgaacacagctgacaacggatgaaaaattctaatgataatatacatttttcatgcataatcatgtcaatgataatgtttgtattttaacgagcgacttgtttttctataaacaattttttttcttgcgcgattttctcaaaccatttttaaaaaatggcgcatttctttctaacagttttttcctagcatgttctttttgtttttttactgacgacgaaaaccatgtttttctcccttttttgcttttcttttcacatgtgtttttttgcatgttttttctgacaattattttctcgtgcgttttttgcttctttttttcgaatgttcttttttgtttttttccaatacatgagaatatacgacgaaataaaaaccgtgtaatagatgacaaaaaaatcgatggatcctatccggctcaagcgtccatcaatttagcgtttattcgacggatttttcagagcgatttgtttttcaatagatgatgtttttttcttgcacggtttttttaaaccatttttttagaaatggagcgtttttccctcgcgcggtttttcttttaaaaaaaatcgatggatcctatccggctcaagcgtccatcaatttagcgtttttttctgacagatttttcagagcgatttgttttttaatagacgatgttttttcttgcacggttttttcaaaccattttttagaaatggcgtgttttttctgacagttttttcctcgcgtttttttatttttttatggaagatggaaaacctttttagcgtgtttttttgcgcttttttctaacttttctcatacgtttctttgaaccgtttttattgtcgtgcattttctctttttaaatagttagattagattagacatagcgaagagatatatactgattagaaatcggaatttggttcgcccttttcatttctttctcgcgcgcattatttattttatacgaaccagctttttattttttacgaaccattttttcttcttagagaattggacgaacttttttagatgttttttgggattttttttcatctttatagcaatcagaccattttttcctttttaaaggaatcagatctagcatttttttcaccactttttttttttgccttttataggaaacggatctacggttttttttgccacttaggagaaacggacttttgttgttgttgttgtttttctttctttttctttattttcttttattgtgcggtttttctttttctttttatgcacctttctgcctttattcttccccttttattattttttaataaaaaacgaccttaatatcttatttcaaacttatagggattgaaatgtaaatataaaaattacatggactcaaatgcaaaagtatagatccaaaaattaaaatcatataaaaatagaatgctctcgaccggtaggtttcgtttttgcaaacagatcttcaatctggcataacaattttatttttcgtttttaaggttgatttgatctagagtcggacttttttttccctttcttatagcaaatcggtaggagtcggacttttttttaaattttttttcgctatattttttgacggacagggaattggtagagtcggactttttttttaatttttggatcggactcttttttcgtccggttttttcccttggttttttttcgccagttttttttcgctcctttttttttggatcagacgtttttttttctccaggttttttttggatcggactctttttttcgtccggttttttaactcggtttttttcgcctggtttttttgacggacgatggaagcacctcttatttctcttattttgtagtagagaattgcactttgagacacctttttaaccagtcttgcatcttggactggggataaactaagcttttcaccttggaccaggtatttttcccaaaatgtttcaatttaggcttcttcttcctctagctccccctctctttctcttctctctactaacggtaatcacatgagaatcccgacctccccacccctgcaactatgggcatcagaagtagaagtcatgcttgagcacgttgccggcactgtacacgcttgagctctatctgcattgctgccgatatcgtgatggggatgttggaccagcttagcacgagcaagggctggtgaagatggaggtaaagccggatagctcgtccaatgatcttgattttggcacatgtctcagcgcgcctgatctcggtctggtggaaaatttgcggaaataattcgaatggaaataggagaggaatcaagcgaaggtaacatcaagggggagacaacaaaagaataattttattggccccttgctctctgctgcctttatcatcaccaagagccactaccttgccttacttcgcttcctctaattgaccactgagtggtgagtagatgagtgtgcctcactcaccaagacctgctgctgctaagtgccattgccaacatgaagcctgccacagatggaggagtttggtgattggagtttgggagaggacagggtgaaggagatgaagagagagggtggtctagactgcaacaaaaaggaaatattaactagcccaaactgaaaacataggtaaaggggtagttcaaagtgaaagcttggtaataaaaggtggtccaatatgcaatttactctaatttttataatagacataaagatatataaacatatcaataaatatatgattttgttgaagtattttttttagattaatctatacatatgagctctgtatttttaagataaatattttagaaattatttataatgaaagatttcaaagtttaacattaagcttatccagaacgataagggttattgtaaaatcaaaggtgttttttactattattctgtgatgaacaattgggcattggagattattggttttgttatttggaatttattcacgaagtggttttggagatgattggatttacaggtaaatttacaggatactgctgtgattttatgtggaccggtcagactgggctctggtagccggtcagaccggcgtgtaatgcgcggtcagaccggtgcagcccgcggtctgaccggccgacactgtgtcggtttcggtttcgggttgtttatttggatatccgagtttattccatgattatgacttctagatggatactatacgtatgtaatactattgtttgctgctaatgagtcaagttggagatagcttggtttcggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggcatacgatggaggaattgtgtgcgtatgggatgcggagtcgaatttggaaggagtccaaatttggtacgtttggttatgtaaagtttcttt

SEQ ID NO: 49527 - DNA, 714 bp, Oryza sativa
gcgtgtatttggccacctttccggccagagccaactcggcctgctgtttgttgccccagaggaggacaacatggagacgatcgtcgcgcaggatgccttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagat

SEQ ID NO: 49528 - DNA, 15862 bp, Oryza sativa
aatctctccttgctctttcacacacaaactttccggctttccccatgcatgcagctgtgataaaccggagaagccgcatgagcgcagaagaaacgccggccttttgaaagtgagggcgctatatatgtagctcttcagatcagacaaggctatggcttagctagtagtaggagtagaccattgcttgtgtgtttgtgactgttgcttgtgagatgagagagtgtgtggcgtgcttgtgcctgaggagcacagtgtgtgcgtcagggacagtggagctaagctacagcaagaacactgcacatctcttgcagttcttgggagaggtaaacggcagctgtagcaaaaccactagctcttgacaagtgagaaacgaaggaagaaaaggttaatgtggcttgatcaaacatccaacctaagctagcttggcaaaaaagcttcatcatctgaaagctagagagatcagtgtcatatggtagtggactgcatgctggctgctgtgagatactaccacacacacttcacaccattggagtagaagaaagtagctagcaccaggaacacctggcccctgccctgcctgtctgtgcatgcagctgagctgagcaaagctaagctttttcatcagagatatcatcagacacacacactatagctagctgctgcatgcatgctaatgaaatctctttccatccatcaatagatacaccaggactcatctaatctacttagtacaaatcttattcatgcagatcatgcaaaggtgaagtctctggagaagagatcttcactgggatctctgctagctctgacgaaccaccactctaataatgcgcgcatttctaaagagagccccctgtaaaaagcaagagcgcccccagaaaagcataaaagtcgcatgcatgtatgactgcatttgcatttgcatggcatggctgccccggcctggccatatctgtcttgttcaatcacacgaaaaggcggccactgtgcgtgcacaactccaaccctctcctcctcatctcagctcagctcaatctccggtgatctcagagaccagaccagacaccagcacgtgtagcttgtatccactacttctcttatgagatttgctctaactcaaggtagcggtaactcacggtattaaatcatttccgatcgtcggatatagctgggtagtatgggtattgttagatctaacgatccgaaacgatttggtaccacagggtaccagtaccttgaggtaacttttttttttttttggaccggagcaaatctccttctcttatagcttgcttgctagcagttgctagtactcgtcgtatttcaacgataagctaaacaaaaaggtacgagctagcactagcagccatggaatcgaaggagaactgaactgaactgctctctagctttcatgttccctccgtttcaaactagatggctttgaaaataggtcgccagtttcaaaatatagctatctcattgaatggattttttttttcgaatggaaaaaaaatagctatctctgtagttcaaattatatggctttggaaataggaccttcatactttgtcgttcattaaaaatatggtgtgcgtgtatgtgttcatatggatgaatgtacacgtgttatgagcgattacgtttatactgtgtttctaaaaaaaattgactttggaataggagcttcatgcttcatcgttcattggtctgacagatcgagcaaaagaacaaattaatgttcagagaaagaaaagacgggattcatgttcttaagctagctagcccggctatggagtggcaagacacacttgataatcgagatttactagtgtacgataattccaagatcagctgcatgttgtgtgggacgttttttgtcaagaatttctcagataatatgtaggtttagcagctagcagagtatctataatgcaaagagaggttggtgaatatatggatatttttacatagatacatatgtatatcacttaattaatcactgtaaacagataactcttaagtaattaattaggttcaggctttcttcttaccaatcctaataaaattcggtcggcctaattctttcagtcaacccggcaaaaataaaattcagttttttgtttttatataaaggtagtgcaggttttcgttcgcatgctgatcgaggctgagtaactagctaagtataagaagcatacgttaatgggatcaagaggtatatatagaacgagtgagacgcattgtcaaacattattccgacaaaagaactagcaagtaattacacccagctagatatgcagcgttcgttcaagagccataaagctttcctgaactactactgtagaaatttttcatagccagatcttagaaagaaaaggtaaaaattgcgtcgcctactgtcggtatcatttatttgttaggtgattgcaattaggatatgcttgaaagaaaaaaaaattagttctagctagatcggatttattctagcctaagaaaagggatttatcaatctactgaagaagacatatgctttgtcataccatgacgacaaaaacgggggaagacgaacaagaggaccactagtggtacagtttggggatcacgcatgatgctatgtctaattctaagtaaattaatcacttattagtcttgaattgcgacaaaactgaacagcaataacccacaaagaatcgcaaaaaagaataaaattaaatggagcagcgataatctagagcaagcaagaacagtagcagctagcagaattaagctgtgaagagaaatgaagaaattgctggctgacctgcatgttgttgtatcggttgaaggttttgaagcagacggggcaggagaactgcgtggggccgatgaggatctgcgacggcgtcgggatccagtactggcccttgttcagacgcccgatcggcgtcgacgcgaaccctagcggcgccgcggcgtcggcggcgtcgccgccgtcgccgtcgtccctgctcgcgccgccggcttcctccgcctcgtcctcttcctcgtcacgacgcgcggtggaggatcttctcccggctgctgacgagagccccgagatgaggtcggcggcggcggtcgggctcggcaggccgatgtgcagcgcgaccgtgacgtccgcgtcgtcgtcccccgccgcggcggcttcggcggcgcagcagccggagccggagccctccacgtccatcgggtctcccgccgcagccttggtgttcaggtcggcgaagagccgccccgcgcggcgacgacggagctggtggtgtctatcgccgcctccaccgccgccgccgccgggcgtcgagcccggcacgtcctcctcgtccgccccctcctcctccgcgccgtcgtcgtcgtcggtgcagtcctcctccccccgctgccgcgcacgctcttgcgccgccgtcgtgccgccgcgcgaggcgggggtgagggacagtagcggcaaggcctcccggagcggaggcgacggcggggcagtcgtcgtcggcggcgtcgcggccgtcgtcgacgtcacccccgccgtcggaaagaacgggaaggaggaggaggagtaagcgccagccggcgacggcgacggcgacggcggggtggagaagcagtagcggcggtggtgattcttgaggaagctcgcgtagtaggggttctccatggctggcaaggtagcttgcgcctcttgctatggagagatcgacacagctcgtgtgcgtgtgtggtggcgtgggcgtggtagttggcgaggggttattatagggcgtgtgagtgtgagagggaaggcccccgaaggggattgggaatgagtatatttactatttactgtggaggttaattagctaatgtgtgcatggaggacgtggtacgtacgtacgatgtaccgggagataactcttgttttttcggattactaagatggacgcacgcgcgcgcacaccattatacactctccaagagtcggaaaccaacagcgcatctctgatctcagtaaaaacttgttggaagcccaactgcatgtgcatagttttcttggacatcacgatttaaaccctggtgggtgaaatcatgtgcatacgacttcaacaccagattttctacttcagcaccgcaccagtggtgcttcccctcttggtttttttttctttctcgtaaggagggacatgttctttctgcagagtaaggcttcacaagctcgatgaattttgatcggatttcgggaatttggatcatctcgagttatcatgtttggagtttatggaaattcattcgaaatgtgtcgatttttctagattggcgaaaaatcgatgtctcactgggctcgaatttcactggccaatcaataccttgtgactttatcacttaaattttgtattttatatattcattaaaaggttcatgaatagaatcaaaatatagataagaaatatatgccctctttagggggcttctagcagccatagatactccgagaatctcggctagctccccaaacaatccaaatgtttactcaagattgtgacacttagtaaagctaaaaatccaggaattaattagtgctataagctaggggattatatatacttctctatattctcaccagctcgccagatatattataagaaatgttctttttatgggaaaaaaagatttgtagtcaaatttccattgatcgattcatttttccatatgtccttatttgaaattaacgaaaacccatttattgtgtgtgcccatagttacaagctagtgatggtacatgtactattattatgtgtttggtttataaaattttgatggagaaatcttgtccagatgggttttctttctttcggcccggtactgttgttccttatatatacacattattagcattttgttataggtcaatttgttttgtccggggccacaattcacggattattgatgctgctatttaaagatgagcaatagcttgtgtcaaaagacaactaagaacatcatcaccggtcttgaccaaactacaaacgtgcaactttacgagttcttacattaatttccgaaatattgtaataatggaaaaaagatgttttctgaatcggttaaaaaatgaataaaattaactaaattcaggatgtatgaagcacctagaatatgaatatatatggaatgagggatcctaaaggacaaatataggaatcgagacgagagatccgaggatgatatgggagcctagagaacaaatatatatataggacccaagaggataaatatatatggcactttagaagaaaactaagaggacaaatatgggactttaaagggaaggctcaagggatgaataagaaaatccggaggaagattctaagggcgcaaggccttgttagtagggaaaaatttttgggtttggttgtcacatcgaacatacggacacacatttgaagtattaaacgcagtctaataacaaaacaaattacatattccgccaggaaactacgagacaaatttattaagcctaattaattcgtcattagcaaatgtttactgtagcaccacattatcaaatcatggcgcaattaggcttaaaagattcgtctcgcaatttacacgcaaactgtgtaattgtttttttttgtccacgtataatactccatgcatgtgtccaaacattcgatgtaatgggtgaaaaattttgttttgggaactaaacaaccccctatatgaatgtggctacaaaataacacggatattaattcttacaaattttttttcgatatgcatctttggagcaaaacttttattacatatgtacacttgtcatataaattgaatatatagcaaaattataatctataaaatatttttgtagaggaagattcgcatatactgttcttgaatgactaatctaaacatttaaaatatcccatagtaaaaatgtcaccacatcacattttctgtacattagctatgttttagtgtggaatttgcgcttgtcgttccgaaatgatcacaactttgccctttcgagggaaggtgttgggttcctgtccatcgattcagctagtatcttcttaatggcaacatattcaattttgcttgcttgaaattatgaaatgttatatagcatataattataattaccgtttcaagtaccaaatgttgagaggctgatttaaatattctttccgaacttcaaaactttggatattacaatgcgaaactgccctatataaacacatagtatattgtaagaatatgaaaagggtgtaaaatgtgacatcaatatagtatttgtattttttggagaatccattttgctattgttaattagagtctagacgtcataacactcggtgagaaaaaaaccgaagtatatattgatgccttagacctcttcttgatggcattttccaagtaattgatttcatttactatataaacataatgtaaattctccttttatttttaacatggctcttgatgcagttactagtacttatgttcttaagaggatgatttggttggacattgacacagtctccaatacattttatcattactatatcaaactatataattataaaagataaattatgaaagagtttttcatgacacaagtatgtcaacatttttcatattttgaatcatgatacctttgaattaatctattaataacttaagattttgaggtttgactgcacatattttaggacgtttctaagaacaggacatatataagtaataaacagggaaatatatatatacaaataatgtaaattctccttttgtttttaacatcgcggtgggagatacctgctaattgagggagctgagagtaacctgatcccgcttataaaaagagctagctagactaaaaacaaattaacaattgttagcatgattaaccggcagaatttaaaacattattctcgatggaaatttatttaccttaattaatttggctacggtacgtagagatgtagagagaacatgtagcaagattttagctacggagaatgaatcagcaagggaccaacactgaattaatgtgggtttccgtcttttcgccatctgaaagcaaacggcgtacgtggttcttataccgggaccatttgtgaattgtgatcgtagtaaatatatggtcgacgcgaatgtttcgcactttcgctggccgcaccacagaaatcattggattataaggcacatgcagggatagtgttttttgcttacaaattgagaaaaaataatggaaattaatctttttggccatcaagttgtacaattccaacctgatcgtagacattctttggtacctaagtaggagtaagatatatttacaaaaaaaaactatattccttacgattacacaaccaacactcttaattccaacatgcattgagggcaggtcattactccattttattaagataatgaaaatggactataatgctatgacagattactacatatacatcgcttaaacaaattatagactaacaattcacctattaaagttattcggtggtggtctttattaataggttttctttctctcatccttagcttggagagaggtatatatttccttatatttgatatttacctctttgtgaaaggaggtatcataattaatcttatagattggagttaggataagattgaaacctcatatttatatactcactccgtttcaaaatgaagctatttctaccactcgatctttgattaagctatttcttcacctatctccttctctcaaccgatcacaatcattctctattcaattttttctactttctcttatcatctaatcttaacattccccaaattatttccacctactttcttaataatcgtatctagaattgcttaattgttttagacaaaggcagtatgtttttaatgttttcttctgtttttgagaggtatactacgagtatttgtgttattcatgagaaatataccttcggggtaaagttatataacactgactaggctgtgttcttttggagggattgggaacccttcccctccacacgcaaaacggaacgatagatcaacacatgattaattaagtattaactaataaaaacttgaaaatggattaatatgatttttttaaacaactttcctataaaaactttttgcaaaacacgcaccgtttagtaatttaaaaagcgttcgcgtggaaaacaagggagatgagttgggaactcaagggaatgaactcagcctaagagcaggtgcaatagcagactataagcctgctataaacacatttcgaggaaataagggaggagagataagggctacagatttgtagccagctgcagcacggactctaagatacatgtgtgtattggtgggacaaactataaatcatgtaatatatgtttataggtaactattatattaatcggctattaaattgactatagataatttggagctagtagttggctatactattaaacttgctctaacactggtttatctatacctctttatacctctcggaacaataattaaagtctcgtcattgtcaattgtagacttgtcttataattagttcaaccagtttatattttttttaccctcttaaacaataagatggttgcaccgttgcactacagatttcatttatatatagcctaattacctctgcccaattgtctgtaagatccagaatcatatatgattggccttttctggccacaactatgcatacatttaacacctgaaaagaagaataaatttaaaggccattattaattacacgtggaataggatatattcaaaccagcattcaaggagcgaacagtattactatagatataggcggccttaccagcaagttactgttcaattagctagtggcccgtgcaattcctgtagatgatcgatgtgagattgcgagtgagtgctaatcccaagccagtcaataaatcggggagcatggacagatccagtaccattcatgttcaataattatacatgcattgattggaaattagaggaattaatcttaattattgttcaggctaacctgaactcaattaattagcatagctaactattgagcagtacaataatactaataacaaaagatgctcacttggaaacttgccagtatatagaacaaacagaaacttgatagaactaatatagttaattaatgaaataatttcaaattaatcgggaaaaatcattagctcaagagtcaaaacctagttgttgctgaggaccaccactgattatattgactagtcaacccattccgtgttagtcttcctctagaaatagctccattaatatattacacttgccatacaatgttattattattgttacatttcaaatatacaaatatgttccatcctaaatataaggcacaacaattattaattatttatctagatcactctagtaaatacaatccaggtacccaatgggcttagagattttaagggtgccgaatttaaaaaataaaataaaaggagggagatgttctagctaattgcatgcatgcaatgcgccccttgtaatgaaaatggttacactttttattttaggatggagtagtattgtgtaagcgtacatagtattacctccctcccgaaataattgtattataaaaaaatagatatattagtacatataaataaccacagtaaccctacatgcatataataaaaaaaaaggtcgaggcagatgcgaatggaaagatgagaaggtagaaggcgggatacctccatctaaccaattggacgtgtttcaacttattataaatatatatttttagacagaattaatttgatagttaattacagatctactgtattaggatggacataattgcgccttgtatgactcgtccagttaattcgaatagctgtatataaacagctcacaaagacttaaatacattgtccacgcgattagctatctgtcatatagtatagtggtttctcatattctgccataatgaagtaacttattgcatgcatgtactttatagccaccctgcttgaacatttgatcatcgagatcacaagcaaataattggttaagagattattattgcattgggctatataattaagaagctatagacagatcgaattgtcggggaaggagcattgaaacccggtgcccacacacagtgtgtgcataggtggcctagctcgacggctagccgtctactgttccaattaattaggcagctggtgcgatctctgtacatagccggtggggatttaagaggtaattgatctgatccatgcagctagcctgaggaaacacatgcgtcttaatacatttgtgtgccgggtccactggaccaaaacgagatgccgccgtgtgttatcaattgggtttgggcattcattcatacgctatgcacacattgcaccacctgcgactgcgacctcttcgaattttgccggtatatatgttttttcttcaatttttgagaaggaaaaagtccaggagaaggtggttatattgctctgagtaattttcttgagcttttatcaacctaaaattgtagtgctccctctataggttctggacaacatcagctgtattttctttgttagcctagcgacggctagttcagtgctaaccttctcctaggtatttgcgttggtgttgtttgtgtttttttttggggggggggggggggtgggtgggttattttttcttcgtttttctggttgcgaccttctaaggttgtaatcgtgtaattttttttcctgctctatcaatataaactttacaatgtctggtttgagtcgttcaaaaaaaattgtagcgctccctgtagccaaatatttttgatatggagagaactaaattctattctcccaacgttaaataaattagcccagaagtagctagaactgctgtatggccaacaagataagttttagtagtaattagagcccaccgatgggcgatggtctgtatcgcagtgacttaaaaacgatatggagccactaaatttctgacagacaacatgtttgtaaagaaggaattgttgtgggttgataggtcgccaaacagttatagtgatatatagtttgtcagtataatagattttctctgaccaatgacatatggtaattcttggtcatggtgtagtgtttgaactctgtatttgtacggtcttacataatttgtattagcaatagggttattatcacttttcttatgtagtactattatggagtacgtcctattccacaaacataattattagctaccctcttcttcaaaaagttgaaatgagacagtctgccttaagtatatatatttattttgatttaagcatggcatccaatgggcatgctccatgcaatgcattaggtttgagaggtagaagatcccagcagacagagtgggttcaaggtataagcaataaaggacccaacagtggtggcattgaattggaaatagtggccagagaacaaggggtgtggtggtgtgatgcgtacaatagtaatgtggttgcacggtagggcaaatgggtgtgtgcatttaatcaaaggacatggaaaaggagaggggagaccatcgatcacaatccccttccccggccgtcgcgatccaggcaaatttcttctccgtttctctccggccttttctccctttttttctgcatggtagctaccaatacctgcctgcaaatcggtttctcatgtgaattgaatcaattggattatcatcggttgccctagccttgagggttatctggaggtttgtgctttgcactagccaggcatgccgatatatacaaatcttgtcggtgttgagacagcttcatatatggtctaactgtagaattcgctggcatgcatgcagggagatgatatttttagggttaatttggtgatggccgactagatagaaatcgacgtatttgacgtgacatgtagtctaaggcttcattcgcgtgtgtggtttggttgaaatttttggtgacacgcaaaatgagaaaggacattgttgtatgattaattaagtgttcactgttataaacttgaaaatagatttattttttaaaaaacagtttttacataaaagttttttttacccaaaatatgttatttaatagtttaggaattagctagcgcactcacaataaacaagaaaaaaaatgagaaagtaatccagccaggaagtttagaatccggccttagctagctagaatgaacatatcacgaacgagttcaggggcaaaacgccacatcaagcacgtaaaacatgcttccttgcaagttgcaacattccaagaggataaaaaaactcgtttaatttactgcatgtgccagaattggaggatgggaaattgaccccttttaagctagtagccgccatgatctattcacggtttttactttcttccaggaccattcaattcccttttctacgtttgctggagatcgttgatatctgaatttttaaggtgaggggcaattaatttacagttcgcaatacctatttagatgtgactaaaactttaagaaactatcacatcggatgtttggacactaattataaatattaaacgtagactattaataaaacacatccataatcttggactaatacgcgagacgaatctattgagcctaattaatctatgattagcctatgtgatgctacagtaaacattttttaattatggattagttaggcttaaaaaatttatctcgcgaattagcttttatttatgtaattagttttgtaagtagtttatatttaatactctaaattagtgtctaaatatagggactaaagttaaaattagtgtctaaatatagggactaaagttaagtccatatatctagacacccctgtgcatttgatactttgactgatgagtagatgagtctgccggcagaagggcacatcagaggaacatgctctccaggagcattccggaaagagaaaggattactcctattactgtactgtggcaaaagtatacttcagtgctttaatagttagccgccaccatctattcacggttttcccccttattccaggagtatttccttcgaagtttttagtagttagagtatcatattcatcgtgaagtgtggatgatacagatgcagaactatgtattctttcagtattaaaagatatcaacctgaacttgctaaccaatgataatcaaagcatggtcctcgctttgatgtaatccaatttgattgtaaatgctcctctttgttcccatgccatgttaaatttatttatttttactctggatctctatttttacatggacttaaaaataattatattcattcatcagtagtaacttccgaataataaaaataattgttcccttaacatgttaaatttatttaaaggtggattttgttttataaaggattgtgaattatgtcctctattacttaatagcacacttgttttgtcctcccctcacatgcagcgtgcactcgcataacaaaagaaaattcctagataaaaaacggttgtttactatttaaaagtggagtcgttggttccttcctcccctatttcccctcgtgcgcaacacactctctcgcataataaaagaaaattcccagataaaaaaggttggttaacaacaaaaaatgtgatttaggttcgatccgcacctagatcattcctaatggtataggtcagttgcaatgtatgaacatattactagtatatgtaaaaatgtatctccgctatttttcttcttttttcttatgatggttctctagttctttcagcacttgtttttacaattaaatatcaattgctagctaacttaagatacataattaagattcaaaaatatctaataaattcgatatctagagttagaatagctgctctacatctaacagaatgatgaaaaaaaataaataatctaggcaataatcttcaagccgcaagttctgtataattctgatactaacaccaaacttgcccaatacatatatgtagtcagcaataatcatgcctcttccccttttcttttacttttaagtaaacaagtgtattcatggatggcacgatgcacagtcactccgtccggacgcagcgaacagtaggaggagcacaatccgatcgaaatgaacaaacataccccctcgataaacaacaatcctattccattattgcccatgccattgcccataacggcttcggcttccatccagcagcgagctagcacggcatgtgatgcatgcctgcacatgctcctctcgatctgctctatatgcctcctctatcacatctgtcagttactcgccatagtctgcatcaccgatcgagtctgcagctgcatgcttctactcgtgacaccccccccccccccaacccccaaagaaaacgggtaataattagctcgttcttcctctgttacaaaataaaacaactttttttatataaattttaacataggtgaaggagcagtacttcgaccacgatagctgaaacaccttagcacgtcgaggaaatcaagcgtacacaccggccggtacacagatccaccgatggatggatcggtgaggaaatgaagcatgcagcagcagcagcatctgctgactgcaatggccatggccgatggctctgcatgtcctgtgccctacaacaccctgcatctgcatgctagctagctgcacgcgcgtcgttgcgtgcacacacacgctatgaatgcgttggtgcatggcgtgttaattttatccggagtccccacagacgacagacacatcaattatataggatctacagtgtatcaatcgatcgatcagcagacaaaaggaacaaattaagtacgcgggggagagagtaggtggctagagaggggcttcgccttcgctcctccccttcgcatgtagtatacgtacacacatgccgtctcgcctcctcaattatgagctgaggcgtgtacgtgcgtactctgctgtttgctgtggactctgtacgtggtggaaggcccacagacaagctcggcaaccaattaacgtttacatgtacgtatctatagttgatcagtccagatctccatgtcgatctggaagatataattagccctggttttgttcctaaattttttttccaaaaaaatcacatcgaatctttaaacacatatatataacattaaatatagattaaaaaactaattacacagtttgtatggaaatcgcgagacaaatcttttaagcctaattagttcattattagctataagtgttacaataacccacatgtgctaatgacggcttaattaggctcaaaagattcgtcaagcggtttcaaagcgagttatgaaattagtttttccattcgtatccgaaaaccccttccgatatccgatcaaacatccgatgtgacacccaaaaattttcttttcgcgaactaaacagggccttagttgagtagtttgcataggtgttcagcgatgtggagattatgggtaccccatatccacacgacatggttatcctactaattttaggggataacttatatctatgaaatatgtaacggatcatgacttgagtattacgttttcttgtatattacggaacggcctaaagttttggtttggtaatagatttaggaaaccgataccatattggttacattttttatcttgtaatcctaccccccattctatataagacgggcaggaggccctctagggcaagatgattcacaactgatcatcagatcaatactacacctggcggattcaaatccctaaacaggagtagggtattacctctcattgagagggcctgaacctgtctaaatccttatctccgcatccatccacttttaggtctcatgcactacccctgtatattgccgaaatcttgttttgaca

SEQ ID NO: 49529 - DNA, 26296 bp, Oryza sativa
ctaactgtattgtaactacttttttttatactagaagaacatgagttccccgtatccattgaaagaaatgcagagtttacaattgtattataactatagtataaatgcattgaaactacgctctaactacattgtaactacgatctatactcaactatgtgtcgaaacatgaattcggcaataataaaagggggtagcgtacgagacttaaaagtggatggatgcagagacaaaggatttagacaggttcaggccctctcaatgagaggtaataccctacttctatttggggatttgaatccgctgggtgaattatagatctgacgatctagttgtctcatgccccctagagggcctcctgctcaccttatataggatggggggcaggattacaagatagaaaccttatccaatacggtatcggtttcctaaatctactttacaatcttatcaaaccaggactttaggccgttccgtaatatacaaggaaacgtaatacccaagtcataatctgttacatattccatatatataagttatcccctataactagtcggataaccatgccgtgtgggtatggggtacccataatctccacagtagcccctgagaccttcacaatcgaaaagataatcttctctcgaactagattactccaaagccgagtgcttcaatcatctttgccatggtctcccgagtacttttaccaaatctgaagactgttaagggctgaaaaataaagtcaggtgcatcgactagatgcacctaataggtgtagccctcgactatgtggttaattgaacaaaccaagcatatagtcaagtaataaataatccaaccaaccgagtggcttcgataattatagtcaaccaagcgacttgatattaatatgtagcatatgcggtgtgaatccctgaataacatgatccgagtgatataccgactgttttgtaaaatatgatgagtgtaacctaaagttggctacatcattgaaaattcacatagcaaaacagctataaagaagcttatatgttgtgaataaagaaatttccaaagtattgggcatacgccatgtgcacactgctttaacagatgtgcttaagtccctagaagacacatggttccaccacacctggaaatatatggcatatgtggtataaaatccgagtaaataaactcataaaggatttaccaaccgcctggaaaatgaccaaaatatataatcagcctaagccataatattggtcaataaaagtgcacacttacgtggcaaaaagcaatgatattgtatccaatcaattgctttatgaacccaaacaacaccttgacttatataaaaaagtcagtggggagctatataaagcattactgtttggcaccttttaaaatgcattgtaccaactcctaaaaaattgagtaactgcggtataaaaggattttaaggtattgggcacataatcacgcgcacttttgcctaagcaaaaagatgcctaagtccctaaaagaacgtgacaggccacacctgaaaatatgggctgcagacatattaggtctaggccaaaaaatatgccttcgacaccctttaaaggatgacgcatgtaacatgctcctgagtaataaatctttcgggtgatatagaccaagtgtaactcatatgaatagcttctgatctgagtgattatcctttatgggatactccaaaatagatataacaattgaattccgactagcgcaagtattcggttgataacccttacggggaataataaatagtccagtctttgagcatagaaaatagacccatgatcatcaaattcatgttgcatgtatccggaacaagtccaaattgaaggtatgatacttgtgtttgaggtagtaagcccctgagtatatagcttgtccttctgtcgtagtcacaattgtccattgatggtagctgacgcggttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaacagtcaggtcagccagcaatgaatatgaaggcgcccagcgataaagttgtgtagccatggcagcgaaataatcagtcggtgacagacgatgcagctggtgaagaagatgaagatgcccattagtggcgacataataagccatccatgaaggcgaggataccggtcggtggtgacgaaagcaagccgatggtgaagatgtagacacgcatcaaaggcgatgacgaaatccaccaatcatgaagatgaagaaaatagtcggcgacgacaaatgcaaccgatagtaatgatgataagtagcaatcatagatgatcaaatataatgacgaagttgcccatcaatagcagtagagtgggctatgttgaagaggcttgacaggatgttgatgaagataacgatgtcggtgatccagtcgatagcaaccgtgaaagtgaaataataagtcggcgaagacatagttatccattagcaacagagttgatgtcagggccgatgaagcagaggtgttggtgatgatgtcagtgacaataatccatcaaattgatgttatagctgttgcagatgcttcacttgaaggaaagtagatgatgttgtccaactcgtcgaaactgagctgattggttgataactctgctctaaagcaaagacgaagataatgactcctggaattgacttgttggctgattaattgattgcttcagcttgtcgaattttgagagtcttgtatttgtgtagcccccgactctttggttagttgggaaacaactgaacatagagtcgagaactgtaacttcttgtcgtcgagtagtcattgcttgagtgaagataaatattgaagattggaacaccacttgttgtaataaaataacacggcatcatatttggtgacgtatgccaaggtgttgaaactcttgtagtcgtcatggttggtgaagtagcaaagcttgcgaagtagaggcaatagagtttgccgatgccgaagataataaaaatgaagttgctccaccatagtgacaaagttgcatagccgtgatgaagtgaacatgagttggcggcaacagaagcaaaccggtagtgaagacgcgcaattgtgaagataaaagcaccagtcggcggcgacataaccagtcgacgacggaagacgatgatgtccatcagtagtggtagctgtataaaccagacgtagaagcgagggcactagtcagcagcagacgagacgaccggcgatgaagacgataaggccaatcaacactagcagaatcatgcagccatggaagtgaagaaaccagtcggcagcagacgtaggcagcttgtgttgaagatgctgatgcctattagcggtgacggcgatgtagccagccgtgaagaagatagcatcagttagcgtcataacaggccagccgtgcaggcggtgacaccagtcggcgacggatgaggcagccggtcggtgaagcggccggtcggtgaagacgtagatgcccaacaaaggcggcataataggccagccgtgcaggcggaaacaccagtcggcggcggacgaggcgaccggtcggtgaagacgtagacgcccaacaacggcggtaataagccagccgtgtaggcgaaaacaccagtcggcggcggacgacgcggccgatcggtgaagacgtagacgcccaatagcggcggcataataggccagccgtgcaggcggaaacaccagttggtggtgcacggcggaaacaccagtcggcggcggacgaggcggccggtcggtgaagacgtagacgcccaacaacgatgacataataggctagccgtgcaagcggaaacaccagtcggcggtggacgaggcggccggtcggtgaagacgtagacgcccaacaacggtggcataaaaggccagccgtgcaggcgaaaacaccagtcggcggcgaaggaggcggccggtcggtaaagacgtagacgcccaacaacagcggcataataagccagccatgcaggcgaaacaccagtcggcggtgacgaggcggccggtcggtgaagacgtagacgcgcaacaacggtgacataataggcctgccgtgcaggcggaaacaccagctggcggcggatgaggcggccgatcggtgaagacgtagacgcccaacaacggtgacataataggccagccgtgcaggcggaaacaccagttggcacaagccggtggtgatgttctgactgatccattcctggagcgtaagagataagcttaaagccatgaatcccttttatacatatctggatctggatcctgcagaacaaacatataggatgagtagtatctgatataaatataatactcgagaaaaattcaagtattttaaaatatttataaatatgtatttcttctcttgtcaattttgatttccccgagcaaatgactcattacgtttaaacactctgcccgactagtcatagccaccaagcaccgggagtcggcctaagcacttcccaaacatgcatatgagtgacatgagttcgtcattaatggaacaaagtttcacgggtcggagtttactactcgggtacttttgcaattattaagagcagaaaataaattatcttatctctatacttttgatttattccgaataatacttagcaccttgcattattcggtccatccaacaagcccccgggtgctaggaatcggcccaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagcccccgactcactagtcaacggcgaaccagttgatgtagtgaggcaaaggaaaaggcaaaatatcatataaagaataaaaataaatgatgacttagctttgtcgtatttcctcggtgacagcaaaagtagccgatgtgggaacgaagcagtccatcaatggtgacaaaaacaccagtcggcgccagtggaaccaagccagtggtgtagatgatggagcccattaatggcggcgaagtccgccaaccgtataggcgaaaacaccagtaagtggcggcagaggcaggccggcggtataataggctagctgtgcaggcggaaacactagtcggcagcggtgaaggccagccggtcggtgaagacgtagacgcccatgtacggtggtgtgaccaaccaaccgtataggcgaggacaccagtcgacggacacccaacaacggcagcatataataggccagccgtgcaggcggaaacaccagtcagcggcgacgaaggcaagccggttggtgaagatgtggatgcccaacaacggcggcatagtaggccaaccgtgtaggcggagacaccagtcggcggcggcgaaggcaggccggcggtgaagtcgtagatgcccaacagcggcggcataataggccagccgtgcaggcggagacactagtcggcggcgacgaaggcaagccggtcggtgaagacgtggatgcccaacaacggcggcataataggccagccgtgtaggcggagacaccagtcagcggcggcgaaggcaggccggcggtgaagtcgtagatgcccaacagcggcggataataggccagccgtgcaggcggtgacaccagtcggcggcaacgaaggcaagccggtcggtgaagacgtagacgcccaacaacgacggcgtgaccaaccaaccgtataggcgaggctgatttgcatgtagattcgtctctctgattttgttgacattatgggcttggtgcagctaaccggccttagaggttgcgtgtggcatgagcaaacgctacatcggtagtcgagccacgcactatgtcctggtgtacccctctcggcaacatggtagcagtgggaagcattgcaccgacggccgtacatgcaataaaaaatcatgagaagattagtatacgttagtaattaatctaaatatataaattacaaggaggttaggaaccggcagcacagccaaatcccatcactcattaaggaacgattttttgatctcgattgccatcctgtgcatgcgaccaaccatcgctccagtatacatgcaaaacaaacagatatagtttgattagccttaaaatattacacgcttaattgtgtaatgcatatatcaagctagggtttgatattaacccgtgcatatcagttgatcaacacatgcacgtgaagcactcagtcgctgttgatcccatggacatgaattgtccccgtgtcgtatgaaggttacgccggcacctgtacagatcgtaccaggcgacgagcagacacaccgggacttcgtctcgatctcagccggtgcgtgaaaacaagaaaaagaaaagtaatagaagattagtctgcagttagagaatgatctaactagtgaaaacgacaaagccaatgatattaattggagatcgaatcgatgaaattgccgagattgatcccttcgactggattgaatccgagacgaaaaagacatgcttgatgaatccggcgatgtcggagattggttccatcacacttgtgataggaaactcgacgaacccctacctggcgcgccaactgtcgaaacatgaattcggcaataataaaagggggtagcgcacgagacctaaaagtggatggatgcagagacaaaggatttagacaggttcaggccctctcaatgagaggtaataccctactcctgtttggggatttgaatccgccaggtgaattatagatctgacgatctagttgtctcatgccccctagagggcctcctgcccaccttatataggatgggtggcaggattacaagatagaaaccttattcaatacggtattggtttcctaaatctactttacaatcttatcaaaccagggctttaggccgttccgtaatatacaaggaaacgtaatacccaagtcataatctgttacatattccatatatataagttatccactataactagtcggataaccatgccgtgtgggtatggggtacccataatctccacactatggtttggttgtctagcacagagattgatgtgatattcacaaggggtttttttttacatatatatatatatatatatgccttgggctaggtatttttgaaggctcaatatttttgtagtcaatagaaagaggcagtcctcacgccctcttattgggaggggaaaaaagtactaattccatgtctgcgcgtttgggctcgcatcgcaggcatgcaggaatcagccggtcgtccgtcgtctcggcgagaagagcggatcgctgctctgcatgccgttgctcttatgatctgctcgatcaccagagggcagaagccatgcatgatactgtacaacgcctgctagcttagctgccggcctgccgcatgcagcattgccgccccaagaaacaccggaaaacacatagccagaccaccaaaaacgttcgtgacattccgccgcgggcatcgcggcggtgcgcggcaggcatatgcagccggggcatcatggggcatggggccgcgcgggccggcatatctcctcgccccgaaccatccgcgccgcgcgggcaattactcggttcatttttgccacgatccgcgcgcgcatcggtcggcatgggccgcgcgcgcggcgcgcgcaagcggcaacacggcaacgccgcccaccatgtcaagttggccgctcgcccgctcgacctcacgcgtatgcttcggcgcaacatgtccaattgtccgtgtacccgtcgtgtctgcttcctgatcgttacggcgtgcagcgggcgccggtcgatcaagtcgagattcgcggttgagtccgtgccgttgatctgtgttttcggtagagcacggtggtatccatgggaagaggaggaatcacgttgtacttgagtggccagattgcttgacatggtttgggccttttaagctggttgtgcttaggtaggacctctgggctgaaagggaggtgtaactaaacgggcttgcccgtggcaccaaccccacgtttttggagtcttggacttttgtttggcttgggctgagtggacgcgggatgcacgtgggctgcctctcgcaattgacctccgccagctgcgacgccacctacggaggcgcttccaccttgcagcgaagagtgtaagtggatcgatccacgaaaccattaaataaggctcggtttgattcagcttaagattattataatctaaattattaggagtaagctggaacaaacaagtagattattatgctagattattataatatataagtcagattactataatccaataatctcctttagaggagctttttccagattattgagtggctaaagacccattacccttagatgcctctaataatccaaataaacaaacaactcgtagcttatttttatgtcagcttattataatacagcttagagtaatctgatttaataatctagattacaataatcttaagctgaaacagacaggacctaagtggataaatcattaagtggattcgtggatcagctcgtttgcttgtggcattccatgtagactgagaatagagaggcagtggcggagccactttacgggcaggttgggtgaccgctcggactctatcgtcatcgtcttcattgtcaatagctgccaaaacatataaaaattaatcgatcacgggaaacactaacagtcgcctgaacttgacgacgctacatataaaaattaatcaatcacggaaacactaatagtcacctgaacttgacgacgccgctgactccgtcactgggcccatcgatgcttgtcaatgacctgtgactccaacctccgactcacaaccacaagttccccgatcagaaccgggacaagagggggacaagaggcataggggatggacttagacagcagcgcgagtaacaggagcaacgaccagaaaagcccgtgcttgattattttgagcacatgcttcttcagtaaagaggaatcagacgattcaagtggaatttttttgtaacgtatcaataagatagagctatgctgcgggttgtctcaggtcctaaataaacgcggacacttaaaaaatctgttgggtaggcggattcgcatctcttacaacccacacaatcttcggttcttggtgcggaagcaatttgcttggctttacatccatcccaaggtatcatttgtaatacatttattggacaagctcgtgcacattgagtgcatcctatacatgtatcataaatttttacggaatgtgacattagatctataattttttcctttcaacataaagattttcgacctggtcataatgaaattagttttcgttttttttataaggagtgtgggggtagtcatggccatctaggcgtgtaggatagcgttgttgtgggtgatgggctgattggggcaagggctcacgggtagagtttacaaaaccgtacgtgcggttatcatttgcgataaccttttcagtttttaaaaccacggaataactcgtggtacctgcgcggttcagctggctcgctagcttgtggactagcctgagttagcttatcttaataacgagctaaaatgctatcttggctcattacaagatggaaatgagtcgacttgagtcgagcaaactaaccaaacacgaatttttgcccggccatatgtgcaggtcatattttatccaggcacttagcattgtctagatcctcttggagattctgcagctaagagatgaaggttcgtctccactacgacacaatgacacataacttatgactctgaagtctggagcatgattcttgtgggagatgataaatcacttattcatgcgttcaaaatgacatcctcaatagcgtgatgacaaagaagtacctttttttttctttataatgggcagagaagtacttgatcctagaaaggcaaaagcacatgtaggtgggtaaagtacaaatattctaacaattgagaatttgtaagtagaggctctaatatactgtcctacttggaatatgatacagagaaaatatcacaaattttttataggagtagctagctggatgataaggtccattgcatcattccaattgtggcaatgttgaaatgactaggcaactggtcaattataaagggatagtttaggactttctgcaacttgcccctcattatgcagttgtttatagaatgagcaattatactgtctgctaagctctatcccaatttccctgttctgctctcctacttttgtaaccgaaaccaattttcccttgttatttaagttattcttcagacgactcacgtgtagatcaaaatgtcaacatggggctacgatgtcgaaagatatattaacatggaacaactcaatacaaatacaacctatattgactcaaagaatatgaccccatgtttttcatgaggcaagacaatgggattgactacacgctgtacaacaatacaacctatgcaacttactactatattatccacgtaataacctacagcctacaaattgaaatattcaaaaaacatccaattgaactttgactaaagtttctatagcttctgatccatgccaaaaacgacggatcctgcatgacatcaagaaaacaaatcagtaagttttttccttcgcgaaaacgcaaaaggattgtacgtcaatcagtaagttaaaagtatgatacggcaagtattttcactgtctgaattctcggttgtgtagagactagagagttgtcacttgtcagttaatttacctaacgttggcagtaggatggtgagagctgcaaccccgacaattttcaggggcgttccggcgatcaccatgtccttgatgctgatgtagcccgtgctgaagccgacgacgttgcccggcgagccggtgggcagcaggtaggacagctgcgcgccgacggcgccggggaccatgaggaggagcgggtgcacgccgatggacttgcccagctcggcgagcagcgggagcaccagcgtggcggtcgcgtcgtcggaggtgaactcggtgatggcgccgctgaagacgcacgccacgggcgcgatggccagcgccggcgcgccgcggaggaagccgagcccctcggagaggatgtcggtcaggccgctcgccctgaagccgtcggcgatggcgaagccggcgccgaggaggaggatgatgttccactgcagcctccggcacttgccccagtccatgagcttctcgccgtcgttcttgccgctcgggattatgaacagcagcgtcgccatcatgatctgcattgcgagccaagttgttgtcccgtgagatcatgtgacaaatcgtctctgagaaaacaaatcagaatttgttcgatccttggtgcgcttacagtgacagttccatccccaacttcgccgtggaagagtgatccccacccaggaatatcatctgtcaggctcctcgtcatccataggacaatcaaaccctgcaagaatcaattatggatacattaaaattttgtcacactataacgaacccctccatgatcgcgtcataataacgaacctgcacaaaattagttgagaagggcccaccagtgatgatgtggcaaattttaaaattttgggaactaaaatttcaggcatctcttggagaagggggtgttttataggccaaattagtttttggctgtccccaatataggatttttggggctttaattttagccctttgttggagatgctctaaccgaacactgtttccaggttgagataattgctataaccccagaaatggaaacggaacttaccccaaaaacggctagaaccatcttctctgcaaaagccataggacctgtcacaaatcaagatggacaaccgaatcagaatccattatggcaataattatcatggcactgatatttcaatgagtgccactgttatggagaaaaagaccaaaacgaggtccatttcagagttacccaggtttcaggaaatattggccgagaagctgtcagagtttcagagataaccccagaataacattgaccacgccattgatgagcactggccattgccgtgaagtaacaaacaaacagagcaagaacgagaacctaccaagcaagctgagctccctcctgagatggctcctgtccaggtaagctgagagcgccctcccggtgttcttggagcagtacaggacgcagagcgtggcccagagcgcgacgaagaggacgagcgccaatgggagcccgaacgacatccacgagctgaaggtgatgggcggctgctccgggaagtaggtggaccacatccccaccaggatgatgttcacgccggtgcccgtcagcgtcgccatcccgccgatcgccgacgcgtacacgacgccgagcaccaccgccttggagaaccgctgcacctcccgcgcgtccgcggcgctgctcgccgaggacgacgccccgtcgacgcgcgggaaccgctgcaggatccccgtcgccaccggcatcatcatcacggtgcacggtgtgttgtggatccacatgctgatgaacatggtggtgccgcagattcccagcagcagcagcggcggcttcaccgggtcgccgcagaacagcgacgtgatctgcaacaaagttcgcgggttttccttggattgttagttgcacggttcggacgaacgggcttggtaaagacgggctcgcggcgcggatcacgtacgttgagagcgaggcggcggtggatgttgtagtgctcgatggcgagcgcgaggatgaagctgccgaggacgagggagatgacgtcgtccatgtaggccttggcgacggcgtcggaggaggagatgccgaacacggggaagaggaacagcggcgccatggacgcgacggcgagcggcacggcgtcggtaatccaccacaggaacacccaggcgagcaccccgagcatgttgcgcgcggcgcggtggccgccgaggtcgacgaggccgcagatcagcgcgcacgccacggggcccgacgcgaccgccaggtacttgttggcgagcagcgacctcagcgcggcgcaggagcgccggcccgccgcgccgtcgtcgtcgtgcagcgggagcagcggcctcgtcacgtcctccgacgagctctcccagtggctgcgcctcggatccatggccggttacaaatttaacaaaaatcgttacgcgattcgcctcttccgcccgccgcgttcgacgacgactgattggttttgcgttctcgtcttctccagctgcagcgtcccaaaaagcttggcgcttttatagccggcgcgggaacagaaacagagaaactgtttgtaaaactgaaaagtacttgttgcgaacttgcggttatcaggttgtgatcaaatgatcatcgatcattcgtggcgcgtcgaatcaaggcgccacgtcagatattatttaaccaggaaaagccaaattagtaacatggaaatttttcatggctatccaacgaccagtagggagcattaatgaccttttttaattaacaagtcagcatccagataagcacggtcagcagtacaaacccgcggataagactccagccatcgactgctgatgtgtcctccgccatgctcgtgcccccatcttgaaccagcccttgagtggacgaagagctggccgaccgcggttggttggtcggacggagacggggcgacccgccgacgcacgcacggccgtctcacggcgtcgagcagctgcaattgatcacgtactactacggcgcccgggtcttatccggacatgtcgacacgatccatcggctcagacgacacggacgcttccttgcactcgctctcgcggaatcatctctagctgctgctatccacgcacgtcttgacgtgggcacacggccgcccacgccgcgcggtggcgcgcgggcgatctgcatcggcggcaccgagtgtacgagcgcgagcaacggaacagcgttggtttggttggcagcggcatgtgcacgcgtcgcggtcgcggtcgcgagggggtggcgcctccctgagatgcacccgcgcgcgcttgcggcggcgtttaatcgttttgtgtttctcgcgtgctcgcgcggcggttacaaataatttccacggttcggggggctcgaaagcgatcgatcgatctcctccgctactacgatcgatcgagcattatttgttgggcggctggtggatgcattcgcggcaagatgcacctgcacatgaggagggaggggggatcgcggcgtgtcgtggcccggaagcccaccgaagcagcaggggacgtatctctttcccgatcggtgcaggctgtctcgctataatttgttttgggtccattgcttcgttccgttacttcccctggtcgtagtagatggataatgtcatcaggtacgtacgtgtctgccatcgaacaacttactctggctggggatgagatacggatcctgttgttgcgtgagggatctcgagttacgctcctacaagcgagaggcaaatggtcactgcttactggctaaagcagtttaagcgaaaaaaaaggtctaattactggctgagagggagaaccgggaatattgactcctgctgattcatatcgtcatatcgagctcgagtcatgtagctagccgtacacgttataagcttgacttgttcagtactactctattcgcacacataaattcaggcacatgcatgcacacggctagctcacattcttctgtcgcattcctagctgcttccgtagcgcatgacgtcaaacctatagcagccgggtccggcgccgtctattgcttctctctgttcgcaatttcgcaggcgattcgatccaaaagttggttccaaccgagtcgaaacagggacagaaggtaccaaatcttccttttaacaacacgacctgtctgctaaatgaatattcggcctcaatgattgaatgtcgatctgcctctggcttgcaatcgtgtcgaaaccaacacttcgaaaataacgtctcgtggccgcgtagccgctagcttagcttgggatcgatgacgacacagagtggaacacgcgaagatttacacgaaaggcgcgcctgcctcgcattacacgtaagtagacgggacgccacacgtagacacaatcatcgttagtccgattacgcgaggacaggacacgagtaccgagtatacgtatataggagtacgacgtacgtaggtctcgattgatcggtcggcggcgacaatcatcatccagggcagccgcgatcggtggacgacgagtccgaatcgcatttctgtgcgcgcgccccggatgcggcctgcccggggtcgcgccgcgcgccgtgcacacgcgcgcgtaaaccgtttgatgatcgctgcctgcgagcaatcgagcaggagatgagcaggtttgctacgggagcgatagctcgagattccaaccaaatttcgggcgaaatcgcggctgccacgtgacgtgactagctaaggcgaggtttgcgataggatgagcacgagatcagccgatcgaccgtttcacggtaacgggtttattaaccggtgactagtcttttctcgtacgtgtgtgtggtcttcagattccgtgttagaaatcacatactatgttgcttatgtttggtgacggcctgactgaccaatgatcacaaccacacgttttttatttctgtattttcaatgtctgtcatgatcaaaccccttccgtgtggaaattctgtgtcttgtactcttgtttgttctagagaaaaagaaaaaaaaaactttgtgagctagaaccgagagagagagagagaggaagatcagaagttcagaacatcttatcggagcgtcttcatttcattggattgtgttaggccgaatcagtaaaggcccaatccgtcaccaggttggatttgtgaggttttccatacctgaagccgaaaaggaccaattagactcagttcaaaggaaaaagtttactttaagtctctcaatttgtcacacaagtttgaaatttggacagtgattttggctgacgtggcgcctatgtgaatggtttaacttgttcattgtcccacttgacgttgacgtggcactacaattgagattaaaaaattaaaataaaatatatgggcccaaaagccagtcaaataaaacaaaatttataatgggacccagatgtcggtgggtcccacttcctccaccttgcccctctctcctctccatcccctcctcctccctttgcttccaaattccaagtgagtgtgcggcgacggcggccggcatgcaaggcagcagcggcaaatgaggtgagtcccgtcaaacatcctttacatggaccaaaataaacaacccatataaggcccatattacacgtcgatgatgtattctgtttctcaggcccaacaaaggacagtcttggacgtcgtaattttttttttccaaacgaaccgcatagggaagtttcgggcgttataataattttccaaacgagccgcataagagagtacgatattttatatatattgatagagtaagaaaaaattataaaaccatagcccaaacgaactacactctacgcgcctacatcgcaaactgtcggagcaaggaactcctctagtgggaaggctagacacccttccttgagagttcggccagagtgcaagcatccgtgctcatgcttaggtcgtgcgagagtacatggacacatgatttatacaggttcggatcgctgggaagcataatactctactcctatggttctaggactatatgatggagtttacaatgagttattggtgttgttttaagtgggagagtatcaacccttcttcactataatgtggctagaatctaacttaatcagaatgaatcaaactgattgaaccggaattagaaaaaaaaattctcaatggcatggatcctcctttcatacatcaaggggattttacatcgtccatgcatacaataaaaaacggaccccaactccgcaggagatggtaagcttagtcttgtcgctgtccctccaagcaagctaaccggatgtaacatgttcacctatcatctatgtaacatcctggtccaattagaatttatcttgtgtgacccatgagagctgtgtgcgcatgtttagtaccaccttactggtttagcaagggtggaaccaacttataaggcttcttccctccaaccatacaactctcgggttaacccttttacacgaatcgagtatgaaagtgtaagtgggcccacacgtcagatgggctggttacgcggttctagagagagtgttgttacaacctaacaagtggagcagggtagatgaagtcttcgtcccaactgccaatgggccctctcgttagccactaaggctgataaagggtgggccacatcgggtgagcaaggagcatgcgtcgcgtcgcccaccttttctccagggcaacgtgggcaagcgaggggatgcaattatgatagggcaaggctacacacatgaccgaatcaaatctccttgatgatgtagattcatctagagagacatcaggcctcgatgccaacctcgggtccctatcctacttgcagtggtttcgtgaacggaagctagcttggccccgagctaatgttgacatcgagtcaccttctttggcacttgggtccctacattagtccttgccttgaccatcgtgtgccccgtagtgccccaagcagctgatggagtgggaagccttgtttccacttatccgacacaagcacacaaacaataatcaggagcatgacatcccaacacactcaactcaagcacacattgttaaacaataatcaggagcatgacatcccaatacactcaacttcatctatgcctttgggtttatcgggaagaggacgagacagaagaatgaatctgctatctctcgcgaggcgtgcaaaaatgtggtcatcttgtgatggcaagggcgttgcgacaagaggagaatccatctaaggtggctaatggaccttcaaaaaaacacctctagggaggttgcaccgccggaaaacatgggttatttttccccatcttgcgcgcctggcgatgtttttttttctaattatcttgtataatctaggttatagtagaaaaacatacagtataaattttgaaagttatgttgcaaaatttactatgtaattacaatattactgtacgtaatctataatgtaaaaaatgtacaatttttctttttataaaatatgacgttgtaaacataaaaaaatgtgacatcataaatatagtcccatacggcaaacaagcaaaataccatgatatgccaactttcaagataaatttcactggtgtgaagtgaatggttccaaatcaaatcatatatttgcctgcttttaaaaatgctacatatacaaactatctaaaactaaggttaatactaagaaattattgcagtacttataaatcagacacattgaaaaatttcatggggctcggtgggacatgctacgtagaaagggttgcttgtttctggtttagaaaagataaagtttgtgtttctccatatccggataccaacaaaaagaacagggtagggtactgcacctctggttggccatcttcttgatcgttgtgcgcaactaaccccctgatcaaatcttattttttggaaggggtctgcacttccccgctaccggagaatcgccactccgacggccaactttgaagataaatttcacaggtgtcaagtgaatggttccaaatcaaatcatatctttgtctgcttttaaaaataccacgatatgccaacttcttgacactttgaccgttaatactaaaaaattattaccagtactacttctaaaatggacacatttaaaaatttcgtcaacataacatgataaaaattttaatcgaagtcgtgcattagagttctataaaaacaaatcttgcattagacacagtgaaagtccaaaaggacttgtttatgaacttgtggagtaagtacatgatttttagtcattgggccgaagatttgaagcacctgcctaattgaaaagcaagcagcaaccttatgccggatatgtacacaaagtgatcgctatttgtttggaagagaaaaaaaacaaataaataaaacaacctcgtatcatgagagaaagaactattccattttttttcccttcgttcagagcatatgtcgacatgtcgtgtcgtcccatggttgcaccctactactctaagcccagcgccaccagcgcctgagacttccagtgcttggccttctcgaagccattgatgctgaactcgaagtcgttgatggtcatgtcgatctcctcctcggtgttcatgacgaagggccccagctgcgccacgggctcgccgatgggctcgccggcgatgagcaggaaccggagcggcttgtccgacctgttccacacctcgacgccgtcgccctggccgagcagcagcaggtggtgcgccccggccttgtcgccgccgccgccgccgaacacgccctccccctccagcacgtacgcgaacgcgttccacgtcgcgcacaccggctgccgcgccgccgcgtgggggcggaccgtgaagtccaggtacatggtcggcgtccgcgtgcgcaccggcgaccgggcgcccatcgactgcccggcgatcacccgcaccgtcacgccgtccgacgtcgtgctcgcgatgtccttgctctgtatctcctggtaccccggctcgatcctgcacgcaccacacgcgtgtcaaaccaccatgccaatgcagcgacacgacatccgagagtggggaaaaaaaacgaaggagatgacaaggacgggtcgtgacgcacatcttgttgtgggaggagaggttgacccagagctggaggcccctggaggtgccgggccccgccggcatctccgagtgcacgatgccgcgtccggccgtcatccactgcacgtcgccggccttgatcgtgccacggtggccctcgaagtcctcgtgcgtcacggctccctgaaaaacacccaccattcacgtcagttccaataagaacacggtcaatgcactggcctaagtagcacgtagattctgagtttaaatttttataggagtgaatttcagattaagttgtttaggctaagttcccaatttaaatggtttcatattttctgttggatgtaaagaccggattaaaaatactcctctctttttttttaaaaaaaaaagaacacggtcaatgcaaaaccaaactatcaaggccatcgtacgtcttcctgtagaaattgtttctttctatttcattttacacggcttggcttgactgatgttgggtttaggcgaagatatatattactaatcgatctgccaatgatgagttcaaggtgtgaagcagagttttgagcgcggaaaagtatatgcgacgcgaggtggttgacgtaggaaggctaccaaccaaaggcagagcaaggcaacagggcccgtttggatgggttagattcttcaatttgacggaaagaaacgttctgaatttgctaaaaactactactccgtatcagcctatcaggtttgcgttgttgacaaatgaaacgcgtttaattcgtttctgctgatccgtgtgatgtggttgtcaaaagacgctgctgtctgtacgtatcactggggattaagcaaggaattttcatggccgctctatatgcagttggatgttctactaccgacgaacagaatgtgaactgtggtaaaagactctgcctacctcgagcatgtaagtgacggtctcgaaacctctgtgtggatggtcagggaacccagccggagcagacactgcacaggattcgatcaagaagacgatcaaaaaatgcaaatctctatcactctaaaccagatgatcaaaaccgagccagaagcaattcactcacctgagaactcgtccaggacgaggaacggatcgaagtacctcagctcaaacctcccgatgctccggcgaacgacggcgccgacgccctcgtgctgcggccgcgccaggaacttccgcaccacctgccggggcttctccatcgacgtcgtcatatatagtactaccagttaccacctttgccgtcgccggcgaacgatcgacttgatcagaaattcagaattcaagaacacctcgacgaccctttcttcttcctccgacctcccttgccggcgatgcctatggtttgtagtagggtatggtggtttggtttggggcctattttcttcctctttatatagcggcaacacacctcgattccgttacgccccgatacgccgccgccgctgctgctgctgctgcttcccggggtcaaaagcgacagatggtttcttggcgttttttcctctctccgctacggggaaatatatataaaagctcgccgcatagctcgcgttttcaacagaaaaagtgtttcctttcgaaacgctgtgccagctgctgcagctgttgcggccggcggcggtcacgctgacgccatgcgcacgcaagccgctagccctagcgcccccgtcgcgctcgggctctgcatacgtgtgccttgtgacagcgtcgcatcagcacgcggggtggacgggtggtgacaggtgagtgaatggaagaccgaatggtgattgggtgatcagcgaactaacgcctcgctatcaaaacgccacgtttactggcttactgccgtgatggttcagctgcttttcatcttatttaccgaattattaaaacagatataactcattattgaaacaaattgtttttctgttgcattatttagactgtttgatttaagttatttatactaaattaattttataatattcaatttgtatctacaaccaagtcaatcatccgccgtaataatcctaatccgcccagtaatttaagtcaaaggagtcttttatttagtagtaactctatcgtggtgtttgagatatattaaaatgaagatgaagtcagcataagacgagaaagtcattttgatattttaaagtagaaagttttgtaagaaatatcatttagcagtttaaaaaacgtgctaaaaattgagaaaaaatgggtgaaaatggagcggattcggacggatggccttcataccatatcctaaaccatattttttaagcggattcggagcgggtgcggatagtgtacggatgcggatgcgaatgcggagcggattgtttcggatgtcggaaatggtgcggagctggtgtggaatcggttcggaaacggattaaatttatcgggtgttacatgtatatgcaatcaatacaacatcgagttagcaatacaaggaacaataatacaatagttaataaatgacccattgtaataattatgtacttaagtgctgaacaacataaatacattatgtctataatataaaaatatagctacgcaagtgtgacacgagacaatgaaagccttaggctaataaatctaggttaattgataaattaggtcattggatgaaccaacttatattatatgcaatatatagagtggttacatttgttgataattttggattatctgacaaacggcctatcggataatccgatagaaatgtcggataatccacattcgctggatttctaaaagtgcataccatatcctcgtttcggactgattcgcccctagatcataaaatctactatcttaataaaggaatagggactataaattaccacatggtaaaaattaagggcccctttgaatcaaaggaattatgaagaattttcataggattgaaatcctataagaaattttcctatgtagctctttgatttaaagaattgaagtttcccaaatcctacaaaattcctatggaatggcttattgcatataggttttagaagaaacttagcaagaggtccaacctcttggtaaaaatcctttgagtatatctctcttatccgattcatgtgtttttcatgtgatccaatcaaacaaacattgttgtgtttttcctatgttttgcaatcctctattttatacttgcatttctatcataattctatgttttttctattcctccgttttttcattcttacgattcaaatgggccaaaaaggagttttcattttgcgggcgtgaggttaattaatttttagtatttgggaggaaacggggcagagaagacaagatcatggccctgaggtatttttaccttccaagcgacggctccatgatcctcaattcagttcatggctctgacgtcgaaaggtaagatttttcacttggctgcaggctggtgataacatgacgtcaatgtgagctcactccctctccctctgacctctcacctctcttcgccttcgtggtgctttcgcctaatcaccatgtgcctatgatacgtatcatccacaaagccaagcgttgacctcgtggataccgtcctgatcaaatcattaaaaatcccattaatgagcaggttctaaacgccaagttctgtagtactaatgcgcaggccggccggtgaaatatctaactgaattgtgcagggtccattacatctttttttttataaagcttatgacctaattgagccttaaagtggggaacagaaactataattagtagccggtagaacccttcttttctggccaccaaacggccccgcccacagattaattagtcatgtctacttcctttacaacatcctggtgaacttaatctacgggcagagaaaaaagcagccatgaaaagacaccgattaggagatatctcggaggattttgattggaacgtgtaaaaatatcgccacaccgtcaagaggcaagagcccacaatcttgtgctgtacacaaaatcaatattttgactgcagattgccccattttttgaactcaaaataaaaaaacagcttggaaggtgatcgcaaacatgcctcgatgtgacgccatctgccggaccatgacgaaatggagtggacaattggcaaattggcaaagaaactagctttcctggagacgaaaatgaaatgtaattcggtgggcaaagttgatcaaagtatatagtacgtgttcttatcagcttacccgataggcaaagagtcttgacgtatccatgagtcatgcctacgttctcagcttcttatgcttggatgcaagaccaaatagaagaaattaaattggtacttgcagagaaaaataatgcgaaaggagagaggagaatcgtaaccacccaacaagtcactttcattcagggagtcccacatactcctcatatcttgttttggatcaataagcaccctgcaagtagtttccttgtgttatcttgtctcctctggcaattttatcatttcacctttttttatcctatcatttgtggccattttattttccaacctgacacatgactctgtttgtactttgtgtaagtgctggtagcctggcatggctggattccagcccctacctctgttggaacagttaaccaaaagcccatgtaatagggaataatttatacgaaaacatcaagatatctataatacgaaagggttatatgtaaattttagtaccaccttactagttttagaagagagtaacaccactttaaaaaagattatctcttcttactacttgagctatgtgtgtgagagagaactagagaaacacacgagctcatttgtttgcctcgccttctgggatgcaggtgcaagtatatagaacctgcatgaatggttcatcaaaattggttttagttgcttgtatggacgtaagttccttttgcaattttatttactacattggagtagtgaaaaatctggatcagttacatgtgacttgattacatttcctgatttctctttaaataccgagtcatggtctccacataaatttacggtaaaaaaactagggtttgccttcatatgtactacaccatcacacgtcgtctgctccattatgctaacaagtgtgtactagcgatcgggagagcaggtctttggaatcatcgtattcgtgatactgcaacgggagagcgcaaataaggttttttgagagcatgggacgcaattggtcactgatggctgctcatccaccgcgatttgtctacatcatcacaagagcgtcgctcatcgacgtctacgtctagtactacaagtcattatcacggtacctgatatgccggttgctacgaacttcccgaactgaatcctcggcatgccgctttgactatatcgagtatatttgatttgttcgtatgtactattttatacatatgtacaatatactcatactccctccgtatcaaataagtttaattttggaatgaatggaggctatgttcatattcatgtatataagtgaacttatgagacaaaggaagtattctagttaatctatacgatgtcatcttttatttatagaacaacctatatatgcttatactatcaacggccttatcctcgagcaccatctgtatcaaggctgcatattcacaaacttcactattgatcgatcacctccacactatctgcttgggagcatgcgatcaaaaaattgtcaaaaccggaatttttagcaatgccaaacaaatttgatttccactagtttaattggtgtcgagttttttttgtcacattctatttagattggctctctacttcattttgtggataaaccttacatgtctgctctttgacaacatgtttctaatttgtttggtatccatgtgtaactataaccctacaccttattgttgctaggcgtgccaacattaattgttaggtgcaccgatgcttgctaatatctgatgctggtgtacgtaggatgagtatgaaaaccaccatggatgaatgcaggcttgcaagtgtggaaatgtaggaaaatggaggtagtggcaagacccaaggtcccaagaaagagtaattttatggttcttgagaaggtaccataaggtaccaaaaatttaatgtaaaatttagtacatcatatttcctagctactaaattacaatagaaaaaatggtaccttattatacctcctaaatacctccttaaggaatgtaaaattactctccaagaaaaccacctataggatatagttgaaccaaatatacactagagggacgtcgaatgaacaatataatctctagaggtttttagattttctcctatcatgaaaatgatgaggtgaaacatcaatatctactaatcatatgtctttcttctgccaaaacatggcgatatagtgactaattagcttacttaaaagggtaacagctagcagtgttatttttttagagacaaagacattatgtatgccacttttgc

SEQ ID NO: 49530 - DNA, 17195 bp, Oryza sativa
  unsure (1)..(17195): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttttactgttccattatccatgcagaaatgagaggcaggaaaaaggtgagcaaggaaaaaagaaaggcaggcagtgtggctccctctgcttttgttggtgagccaacaagagacaaaaacatggccacactttggagagtttgggagggtggtctctcacggcataaagtcctaaaaaaggagggaataggaggtgatacggttgggtttgacaccggctgggcagccaagaagcagccactagtcctcccagacctggccaggagggtcttcatcaagaggttgaccctgccacttggatgatgacacaatcagttccaacatttcgttcatagttgattataaactaaaatgcttattagacatataaattaattataggtaaaacttttatatatgtgggttcttcacgatctaaaagcaaacgctgaaaaaaattatgataacaaaatataaaaagacaacttaaaatataaattttgattgggacggataagtaaaaacaaacattagggatagataataataggacataatgctacactagtatttcttatgcagttttatacagagttagattttaaaagtagaaatagatttgatgcgtaacccttactctctttatatacacaatttattttctatacaacattattgatcaacctacatcattactagatttaccacggccaacgtgtgtatgtctctctgatttttgtcaagtaacatatgatgtttttatgcttctatagtgaaaatgggggctctttttagcgtgctctctctctctctctctctctccatagtacatcatatattgtgacttgattcctgttctctttttttttaagtcggtgattattcccatccgtcttggcatataaaacctggcgtgttaacacactcccatgtagcaagtgtcagcagcatgtgtttttgagatatgtcaaatatgaatggaataggttcaatttggcatgcaagataaggtaatatgcatgtttgaagtcggtatatgttcatcctatattatacagcctgttttggaaaaagttgccatgtttatttttagttcgctgtagatcgtatacttttttactctgtttccactttcttgaaggatttttttttagatgcactttcttgtagcagttagaaagcttcatgtaaattttacataggtagaaattgtattcggatgttgccaagctaagatcgaagacccttgtatcatccatgaactaacgttgacatgtttgtttgttcgataaacccaatcttcaaaggtgctcataaggatatggaaagatgtattcaagggtaagagcgctcgcgtatatatgaatgcccgcacttgtaatatatttagaaaatgtattattatgggcatgtactaaacaataattctctttatgaatctattctcgagaataggcgtatcaagaatcgtgtgctctaatattgataaagtgatgaaccatatccgaggatgctattcctcgagaatccaacggcagtaaaaggtcccccaatgcatggagtcatggagtgtatgtgcgtttgtacataaaatggcataattatcgtgataaggatctcttgatggcataaggtatctttgatcaaacgagaacgacctcaccatggatgaatggatgaaggtgttgcaagcaagaaaaatcttctgaagttatctgcaagaacagtggataataccaatataccatctgcagattagtgccaaaggatttgtgaaatgtatgtgtcgccatgagcgcttcatgatcttcacgagaacttggccgtttctggaacctaatgttcccattattcctaccggtggaaattcctcaataatgctcacattttgttcgaatatacagaaggatctatgcattattatctgaagcagtctataccatttatgtactaatgttctgtgatatattcccctgagaataatctcctgaatcctgacagcaattgcaaatttttatgtcttagaaaggtccaaaggaaggtactctcagcagccaattaccaaagtgatcgtggtgcaggaacactattcctctcggtagctaaaatcacgtcacattattctttcattgggataagcttcacattattggcacctttggtcagggcgtatcactacaggagcatgaaaggatgaaaagacaaagataacggaattatgtgtaaaggttgcatggatatttattttgcaaaaggaattcaattagttagtgtggtggtctcaatattttgctgtccaaataataatattttcacaacccggtatcagattctaacacccaccttagataatactcccttcgctccataatggatgttctagttttgttctaagtcaaacttatctaattttaattaactttataataaaacataacaacattttcagtactaaattagttttattaaatcaacattttaatatatatttttaaaagacatatgtttcgtgttggaaatgttgctattttttttctataaactttgtcatacttgaagtttgactttggacaaaccaaaacattttacattatggaacagtgggagtataatctttttttttacactcaaataaccattttttctctcttaattacttggacgctagtgcatggctcttgcacaaatttagttaggtgaaagccctctacttctttgggggacagggaggactccaatctgatctctgatctgaactgaatgcccacataaacacatgagagttagacaaccagcccagacctgagtagcagatgccaagtccagtttttattggcctttcaatgcacaagaggtggtagctgcccacgtaactgcagggcccccgtactgcatagatgtgagggaagtgaagccggagccgtacggggaaacaccggcccgggcaggcaagcatggcgcaagattgagatcgccagccagcgctaagcttccctcccggttgacacaacagcatgaggctataggatctagcattctagcaccagtgcaagccaaccaccaccaccaccacgacgacgacgaccgcggctcaggtgggtaggccggtggccggatacctcacagccttgaccaaagacggcgtcgccttgtggccaccggccggctcacgcggcagagaggtttgcagggtaagcaaactcaagctgcttgcagccagccagggtgcatacatgcaagtttctttttgacatgtactacaagggaggctagtgcaaccaaaatagaagaagagatggattcagcggttggaacttggaacatcgcagcattttaaatttgttgagggtagattctggttacatttggacagcaagcgtactgggaaaagaaagggaaacaaaggttggttcaaaacttactgtttggaatctgagctccaaatgttacagccttgaccttggaccaccctttcctggtatctgtagagcgtcataatggccaaaaccatgaaaaagaacttgaattggatcttctttcccgtactcctgaccatattctgcaattgctattaaaccaccagcttccttatcatgcatgtacacagtaattggcatcctggccacattggtaacggcatattagagcttttgttacttcccgttttcagaaggacaatacaacaagactacacatatatgaaactatccactattgctgttgagctacattaataaactttggtcaaagcctaacaaaatggaatattaatgacttttgggagttgtgttttgaaaaaaaaaaaggaagatccccgcaaaaaaaaaaggaagatgcttaacagtcataacatgacaaaaaaaaacaaacaaacaagacagtataagtggacaaacttatcccaggaatcctaaaatggattaaaagcaaaccaactaaccatcaaccctatataaatatgaccaagagggcataagtattctaacaggttactgcacaaatgtatactgcatttgaaatggtgagagtaaaataactccaaacatcatggctaattctcaccgaagaacatgcgaagccattaacagttctggttcacctccccacacatgtggcttcctaatccgagagacatatgcatcgaagtccccctcaacaaacctgtgaattaatgtcatagcgaagcataagaatgcgtaactcaacaatatttagatgcagagtaactaacagaataatgaggacaggtagaactaaccattcagtctctgcccgtctcttgataaattcatcggcgacctaacagtgacaccatttaaatagatcttttacatgataaattcaccagaaatggttgcgttgcttccagagcaacatttagtatctaagaacagaatggatcaacagtagtacatcagcagaacattacaagcataccattgctcttaagtcatcagccatctttctctggagatcatcatcaggtcgcttacctgacctaatacatgcaccatgagccacagatcggaacaagcaccttccatctccaggaatgcctgagggttaccatgtgaatcaaacacaagtgagcagacgatgcatgctttaaccaaatgcatattgtatagtaattagaaaaacacgcacactgtctcaccagtaacagaataatccgtgcaaacttttttcccatgagcataactagtggacgattcagtagtttgggggctatcagtattattgtccacaggaccctcagcatttgccttcgcaggaactgcaaaacttaggaaaagtccagtgcctgtagctccaactttgtgtcctatgcttcttgaatcccagagaatactatacaacttctgacgtgagggctcatcaagctttagctttagaatattatccctcgcaggttgtctgccacacaactgtttccccgaactggcaaaacatgttcgcagtgattttatgttcatcttaggaggcaaaccaactaatctgatctttacatgataaccgactgcttgtgaacgagaatacttccataatgccatgccctgtgtcagccctccttgtaactgacaagactgagaatacaagctataagtacagcgttgtaaacagacagtaggtgtgtagatagccatctgcttcaggcagcaccgcgccaccaagtataagctgaaaaacatgtttcgatgaccaaaattaagaattagtggaacatgagataattcttacgaaaatcaaataaagcaagccaccaccacaatgaagtagaagatccaccatgacacaacggacctatgatagatatgattgatgtcaacattagtatcaattgaagaggattaaattatttttcagcacaaaaaatagtttcatcgttgacatatccaggaaataaatgtgtggcagatagttattagtgagcataaaagactgaatgtctccaacctctagcaatcgaccactttctgctgagattcgacaaaacaatgggaaggatgggcatgctaaatcataagcgcacacttgctagaacaaaagcaatttgtcctccttttctttgtcacacttgcgtagagaatccatattatcctcgtgaacttctcaggatgtgctacagggagaaattgccctcccaaatcccgagcattcgagggcatgggcagcagcgaatcactagaaaactattctcattaagattatttaagttcctgtcttggccgcgaagccgagatttcgtgctaccaggccattcccatgcccgaattcacaagactacaaccctaagctggtggaaaataatgcattatatgcacaattgaattcagcaagtgccaatgcacccaaaccattcccctcacccgggagagcagataaattggaagatagtagtaactcaaattagtcacaaattgcagaggataatgaagtaaaatccgcaccttagccttcggactgtccgaagcgagcggagccgaggagagacgcctgcaagaatggagctgacgaaagcggaggttattggggacgggagcgtgagccgaagaggaagggatagtggtggcgggagaggctttagacctccgttcccgcgaggggattcgccggtgcacgccgccgccgccgccggcgcagagtcagtcacggccactggcgcgccgccgccgcacgcgaggaggaagacgatgagacgacgcctaatcgatatccaccgcgcatggtagatcggacggttcaggtggacccttcggatatggtagcgatcctattccgaggaggcccacacggaggcccagctttgtttggtctttggtggcccgagaagagaagaggctcgattttgttcggcgggggaaaagtctaatgtgagttctcatataggagtacatttcaagtgcaaaacttggtatatctagttatctaccactttaattattaaaatattttaaaataacccccttgactgttttgaggatagttttcagtgatttggcatctaatggcagtctagtcataagatgaaccaaaaatagatagaggattcaagtgtaagtggtacaaaagaaagtaaacaactgtggtgcccacttgtcatagcccactcttattcttctctttcttctttcttttgcagatagcagcaggaacccgacaagcggtggagacgaggctgatgagcccagcactgatgccatctccctcacttccacacccttcctctctgcctcatggagggccaccgcttgcctacctcctcttcgtgtagctacctctacctcctccgtttatcatccctcttctccataacggcagtggcggggcggcaaggtgggaagtcagagtcgatgtaggattccccaagctctgccacccttgctgttttggcctcaccggccaccgcttgttgtccacccagagctccacaccccatctccctcaacaccgatggtgatgcttagggtatcgatggggaggggatgaggtcctccaaccttgccgcttccagggctccgtcgtctctccgggtagggctcttacgaggatgcgatggcgacaataagggatcgataagggcgccgacgataaatttttatactgcaacatgctcgcctgctccatcgagatggcctcttgaatgtaccttaacgtcatctacctccttaccggcatcgagcgtctgctccgaaagcacctcgacatctgcaagcatctcaagattaccaaccaccgatcccgcaagttggggaaagaaaaaggggagaaagaaagagaggattgttgatgaggagggcagaatctccaatttatgaggattgtgctacagggaagctattcactcttttattataagcatgttttcccatattgctaaatggtatttttttttcaaaaccatctatatcgacattttttaaaaataaatcaatttttcaagtttataatatcaccaattgtgttttctgtctcggtgagttgctactacagaaactcataccattcaaagcacggatgactggtcatttcacccacaactagggctccatatcaagccagttcagctcggctcgttatcctacgagccaaaagcctcgctcagttcgaaccaacatcatttcaaagttacaaatgtttgcatacaatataagtattaaatcatcacaaatttagcaaatgcaccattaatttcatactttcatataatcatctaaagtcagtctaaatatttaggcctatgaccaagtggagtggtgtgacaatgagtggatgggggatgagttaagttgagatttacgagtaggttaaactttagttttgacttgttaacaaacccaaacaagccgagctgtgcgagctaaagtgccatcatccttttttccagccctatccacgacccatccaacctgtgcaaccttggcaccgcattctctgatgttagaaaaactatgttagagggcagtggtgtatcaattcattgtcctccgagtatggaatgctccaaaaaaaaaagccaatgatgccatcgctcgcagtcactatcatgttcgctagcgtgcgagcaaggacaacattggatttttcttgggagcgttccatatttgagaaacggtcgatcgatgggctactgacgtactctctctgttttttttaaaaaagacaacctctgtatccagattcgttgtaatatgttgtctttttttagaatgaagggagtagttttcccaacttcagaggatctggttccgtgcaacctcgtgccacaactctcaaacttgtacaggcaaccaagaacacctgtgatctacattttgagatcaggtagtatgattgatccatgaatcccattatccatcatcctcgagtgagagtccagcacgaaagctgcagctaccactccagcttatccatctcatcatccattcccctcgcaacgaactccctgcctctcgctccgatcgtccgcgccacggcggcgacacgatgaaaccccgatccaactgacaaaattcccaagcgaatcctgtgcagctcgagtagaagagaagagagagtgcttcttggcgagcgagtcaacgtcacaatggcgtccccgctgctgctgctgcttccgctcgccgtctcgtcccttctgctgccgttcgcggcggccgcgcgcgtcttctccgtcgcggactacggcgcggcgggcgacggcgcgcggtacgacacgggggccatccaggcggccgtcgacgcgtgcgcggcggcggggggcgggcgcgtcctcctcccggcgccgggggactacctgacggcgaccgtccacctccgctcgcgggtggtgctcgacgtcgcccccggggcgcggctgctgggcgggaccaggcaggcggactaccctcccgagtcccgccgctggtacgtcgtcctcgccgagaacaccaccggcgccggggtcaccggcggcggcgagatcaacggccagggcggggcattcgtggtcacccccaacccgcagaagaacatcatggtgagctggaacgccaccggcgactgcgagggcgacgagtgccgcccgcggctcgtcggattcatcgactccaaggacgtcacgatccacgacatcaccctcaaccagcctgcctactggtggtgagcatttcttgatacctcaaatccattgctcaattcgtagtagaacagccaaaacatgacaacatttcccttgtcatttcatcctaaagatgataaatccggctaatttgtactccactgccctagatatcatctgattagcaaaaattacacagcatttgtgtagtgatgaggtattcagggaaagttaacaggctatatgcacttgcattccctgcagtctgcatattgtcaggtgtgacaatacaatgatccacaatgtgtcgatatatggggattttgacactcccaacaacgacggcatcgacattgaggattcaaacaacacggccatcactcattgccacatagacaccggagacgatgcgatatgccccaaatcaaccacaggtcctgtttacaacttgacggcaacaaactgctggatacggactaaatcttgcgctatcaagtttggcagcgctagcttctttgacttcaagaagctggtatttgacaacattacaatagttgattcacatagaggacttgggatgcagattagagatggaggtactgacctgtacttgctgttgtgtgtattgccattctgtgatattaggtagtacttactattttctctagcaagctataagatttccgcagcaattaaaatatattagattgttttcacggacatttttttaggaaaactgaaccttatgctgcatttgtaccccgtgtttatatagaatttataaattgctttagcaccatgaaatttttatacagcagcgaacctatcctgtatgctgaaatatttctattgtgaattttcatcaagtaaaaactgcaccattaaggtctttggtctagaaatgagatttgctttaagcctcttctaaactggagttttcattcctgcaggaaatgtgagcgatgtggtgttctcaaacatcaaaatgagcaccaggtactaccatcctttatggtgggggagagctgaaccgatctacatcaccacatgtccaaggcacccagattccaaagaaggcaccatttcagacattcagttcatcaacatctcatcggtatcagaaaacggagtattcttggctggatcgaagcacgggctgcttcgcaacctgaagttcaagaatgtcgacctaacctacaagagatggacaaactactcgggagggctgtatgattacaggcctggatgccaaaagatggtgaagcaccgaaccggtggtatgatgctggagcacatctctggccttgagatcgacaatgtgaggatgagatggtcaagaggaagcctcaaaggctgggatgttgatcctctcctcttccagccatcgacagtcgacaagctgtcattccatgactggcaatcgctggctgtcagtaggtaatggaagagcaagcctactgaacatcacatttgtacaagtatctgtatcacaatctgagtggtgattcttttctgaaacgtgtaaataaagatcacatgaaaggcaatggtcttaccatgttgataatcatcgcttgaatggcataaggttcttaccagtcaataaaaatcctcaagtcccaactccctgtaagcttcagcgaatgggcgagaatggctgctgaattgatttctgagtactgaactgactgaatcagatacaatcaaattcaatctcaattgtctataataaacctatgctgtcattctgatctggatttcgaattttaatgttcttgtctgttcatatttctgttccaacttcttgtttgcctgttaccttgcttactccataaagcgatgttgagttcagtgagtcagctgcgctgtgcattctccatggtaagcgcaaacacatcaagttttttttgaaaaaaaaacacatcaagttccatggagtttcgtcattttagttccagatcttggtcccgctgaactgcaaattttcccaagaaaataaaaaatttctccatagctgctgtcaggatgtcaaaattttcaaaaatccttcgttccaaacagttcaaattttctggaattaggagataactactaattccaaccttgcatacaaaaaagatctcattttttcgcttatacttatgcttatgcgaactgcttattatagcaatttaaaaataatttgttagtaaattttatgtacgtgttcttcataagaaaatgttgtaaaataaactacgatgaaaaaaaaccacaaaatcaactctaaaataaagttctaaaaattaaaatttacttcctccgtttcacaatgtaagactttctagcattatccaaattaatatggatgttaataaatctaggcatatatacaaaatatatactctctcattccctaaatgtttgacaccgttgacttttttttaaacatgtttgaccattcatcttattcaaaaatgtttatgaaatgtgtaaaactatatgtatacataaaagtatatttaacgataaatcaaatgataggaaaagaattaataattacttaattttttttgaataagacgaatggttaaacatttttaaagaagtcaacggcgtcaaatattttaggatggagggagtacattaatcaatgaatcaatctagataagaccaaaaaagtcttataatatggaacggagggagtagcttataagcgtaaacccaagcgaaacattgggagcttcaaaatcgagaagaagagtccaaacctccaaatccggcccataatgattattaacccgaccttttcagcccggcccaatgtacttgaccaaagcccagcccattttgcaactcctcacctctgcattgtctccgcgtagctgagcaactcttcccctttctcccccaaatcggcggcgacctctctccgatctccaccaccaccaccaccacgcgggcgcgcgcaccaaccgggggggcttcgatgcgggcgatctcgtcggcagcgggggggatgctgcgggcgcggctgcgcggcggggcgcgcgtccgcggcggcggcgggcacggggaggggggcgggcggtggacgaccccggggcacgaggagcagcccaagggctacctattcaaccggccgccgccgccggcgggggagtcgcggaagtgggaggactgggagttgccctgctacgtcacctcgttcctcaccgtcgtcatcctcggcgtcgggctcaacgccaagcccgacctcaccctcgagacctgggcgcaccagaaggcgctcgagcgcctccagcagcaggagctggcctccggggaggcccaggccgagtgatctgcgcgcctcaggtcacctcgaaccctagaatactgcatctgttttactcccaataagatgtttgagatgtgcgggatgaacactgtgctcttgtttctgtttttgttctgtttcctcgtggaatttgtccaatgatggcgaatgccctgaacattttgaaatgctttgtaattctattattttctcttcctttagttgtgctgctctgagagttttcgtgaatttcacccgttcccaactaactcagttgcagatcgcatgttggggttaggttgagcaaatagttgaacgttgcttaagcattatcttattcttgatgaatgctgaatccaaactctaaacacgaataactatccctcttaccaaatatgttgagcatcatcgtgatgaatgctgaagccaaaccctaaacacgaatagctactcctcttgccaaatatgatgactgttaccttgttgctaaactgatcatggcgcggttaagctatctgaaaataacttagaaatatgccacaatgaatgatttcgtactgtagcaccggtggctgttatttgtttatctcctgtttatggtgcttaaatttctctcaagttcatttgatgccaagttgccaactaatctatcaatttattgaacatatccgtttgcatactatcacttcacatgaaacatgtgtatatcaacgacatgcactataatatcattagtttttaaaggacacactttcaccatcgcctggtgaaccatgaaagcatatcacatattaaggtcagatagcatgatatcgagggtccttagctactaccatagaccatgaccatagtgctttgtttttgttttccattttcttggcatcttgctaaacacaacaattgtaaacacgcatacagagaaatataagggttcctttgagtaggaagatttacattgtcaatacttcatttgcctaaaactaacaatgaggttagggaagacaagaaaatattttttttttcaattttgaatattttagctgatcagatttgttatcatgatgaataatgcccatgaaaataaggtccgctatcccagcaaggcttctgctgtttgaatgtttttcatgtatacataaccaatatggagctgacgattcttcaatgtcaagttccaaccttgttcttgcatgttgtacgagttgtagagttcttctaaaaattatcacattcacttttttttggggaaataattttaaaccctgatttctctcctattgcccataggagcaattccatttaactgttttaactgatctctgggttacgaggtttgattgactttgtagaagcttcaatcttttatgcagcaaattgggaaaataatcagttgtgctctgtactctataaggaattagttgcctgcctcctgccatgtgtaatatgtttggctagtaattttactttacgagcaaataagtggaggggaaaacactgccttggtgaaagtttcatagaaatctgtttaggcccagaatctggcattaatttgttccttcctacaatggagcatcctgcaatttatgctttatatttgaacaaccttgtatctttttaagggtacgtacttcacttaatgttttagtgtcttggcctgtgtagactgtagacactaaacaccatcccaccactgcaactctgttacatatttcttctttacaaaatgcaacctgtgtttttcacatatgccatctattgttactactgtaagcaaaaatgattgtcaaactgtgttggcattctaacttttagcagaccatggaatgctagatgaatttgaggtgaactgaaagttctgaggtctaattaagcagacagtgagtataaatatgccactgaaatatgaaactggattgctagtctgatataatgcgcatgaggaagatgcatatccacatatagtatctattttcttcttacatcaaagctagtaacatagagaatcacaccgtaaggactatttcttgtttcctggtgatttcttatgctttgagcagccatcctaggctcctagccagtctcagtactgtaagactgttagttactgctcaaagtggaatgtaggtatttggaatttgggatctacaaaacgatgatgttgtcttttcatgctttaccatttgtcttgcactttagacctggatcgacaacttattcatcctttatgtcaatgtagatttattcgcttgctttgttcaggacgcatctttatgagacctctttcatgaattatttgtacatactcatagccttcatatgagtacagatgctaacttttgcgtagatccaaagctatatatgtctttcatgaacttttgaacagttctgccaatccttttactggattcctttcgtcttttgttatctctgccctgcattttattatttttctccttgcctttttgcgcgacactagcacatttcttctgtttctcaaatttccctgtagtttagatctgctgtgtctgtgtgacctccatgcagatggtccataatttgcaagcacggtatttttaactcagaacttcaatttccgctgaattttcttataaagccccatttgtagtaatctcccttgccatgaaattcctacagaatttctgttgattcagatggagtagtcttctgtgtggttcaattaccatagcttgattattgtcatgtcctagaactttttggtgtggtccattatgtttaatgtgcagatgcggaatagggaatagctggcaaagctgttaatgacttaatgctaaccaaccactgtccaccgtccattatctatgatgacaattcttttctgtatactactcgtacttgtctctccttttcttctagcaagatttcaccttaagcagctggagtatactactatagagagataaatgtttggaactccctactacttttaagtcttcactggagacaaaatgcattatataaaaatttagggctggcttttgcactccaaatggtatgtatgatatggtcactcactcactcctattaggaattggtttcatattccattgaaattcactccatccataaaagacttgtggtgggttcctgtatgctgggggcatttaaggcctagtttgtttggtttgaatatagatgaatgggtgatagattttctaattttgtgatgatgttcgataaaaaatcaatctagatgagatgtgacgtttcctagtacaatgaatatggataggaacatgtccaaattcaatatactacttcctccgtttcacaatgtaagtcatttctagcattttctatattcatatatatgttaatgaatctagatagatattcattaacatcaatatgaatatggaaaatgctagaatgacttacattgtgaaacgaagggagtagaaaacatcacatcttattctaaattgattttttatgggacggaggggatacaagcgaatggattaccattattacaaagttggagttgtttcaaaataatattttaagaaaattatatatagaattctttatatatatatatatatatatatatatatatatatatatatatatatatatggtgttcttttctcctgaaaatgaagatgaagattaagttttttacgcaaaactaggtggtattaacgtatgattgattgagttttaattattacaaattttaaaaatagattaatatgatattttagagcaactttcatatagaaagttttctcacaaaacatactgtttaacagtttgaaaagcgtgccacgaaaatcttaattttcatccaactcttgttgaagaaaagaacatgactatatatatcggttaggagcttgggaagcatatgccatggtaatttgttacaagagaactcaactggcctaggtaaaaccgtgccacaaacagtgtcggtagagcatgaaatgccctcgcggtgagccggtgagtagtcgcaacgtctgcatcgctgcatgtcatcttatctttctctgcctccggccattcttttggcctaaaatttctttgtttggcagctgtaatgggcgaagcaatgcttttaatccgataaagctgtaatgcgagacaaatcttcctttagcatcatagttctttgtctccaagaacattccatttccaccgtccaagtgtcatgtaacgtcatcacatcaccctcatactgtcatacagaaaaacttatataatcacattatttttactgacatgtggggccggctccaaaaggtcccgcacaatggcagctggactatagtgaagtcctttccgcttaattatgccttggcctcttgtgtgagcagctaaccatgcaagcgaagcgtccctgtactagaagccatacggcggcgctccgtacgtagatccatctgctctttggtcacactgggatgtactaatgctgtcaatcatttcgtgctaatttccaaaaaaaaactattcatatactggtaaggcatacgggtatcagtagtacatctcttgaacatgagcttcattgttgtcttgactctgaatatttgacggcgggataactac

SEQ ID NO: 49531 - DNA, 23986 bp, Oryza sativa
  unsure (1)..(23986): unsure at all n locations
ttttgcggggttgtcggtgaggtcaagggggcgtcggggtgatctcgccgcgcctcttcgacgccgtcctccgcccactgcggcgtcgcctccgtgcgcacgctccccgtcgctgccggcgccggggccgctcccctcctccctcgtgctcctcgccaaggtctccatcgcctacttctcgtgagccacgggtgccgctgtccttgcccgctgctcctgccgcctccttgccggtgagcgtagatggatcctccgctgccaccgtagaagcagaagaagctggcggtcccggtgcctcgactgccgcaacgccgacgacaacctgctctggaacctctacctcctctccatcctgatacctggtaccctggtatcaactgatacctgttaccctgggtatcgagctgatactaggtatcaagccttggtacctgggtatcaggccttgctacctgggtatcgactgatacctggtaccctgggtatcgagctgatacctaggcatggtataccatatgcatggtatcaggtaccagatgcctagtacctaggtaccatccatgggtaccatgtgcatggtatcagataccagatacctatagttatcaagtacaacctggtacctgatacctattgtacctagtaccacaggtaccaggtcaaaggtgtgggaatggggagcacgtcgtgtcgccgtcgccgcctggctgaccggtggccacacgttcgttgcctcctcttctattctcccttccttagttcctctcctcaacgtttctcttctccttctgttgttgttgctgtcggtgggggcaaagaggaggatttagcgggggagttgtctgctgctcccgctgctctggggcgccgacgccgacgaggaggtgtgtgcttctccagctgcaaaggcaacacaacaccggcaagggaagcgtgcgataccatgaggagccggctaggtatcatgcctcttcacgttgacaacagggacgcaggacgctatatttttattttgtcgtgtgttttaattatcccgtgacatcacttttccacggtatcccgtgggctagctgccctcaaaatgaaaggcacaatgagacaaagacaaataaaaaaaaggttcacgattataccataattaaacagagaccacaaatatagatcagagggaccgcataaaacaaagaggagacctactgaatttattctagcgcatgatagtgtttttaagcaaggaattcagttgatattttttgtttagtaagataaagaaataaatattccgaccactagatctacattctacggtgtattatgaccattttagtagcaataacactgccaggtggttagtggttaacctgggctttctgccgatttttttttcaagtagtcctgattttcacattttgtttgtactgtttgaccactcgtcttattcaaaaaacttgtgcaaatatataaaaaggaaaagttgtgcctaaagtgttttggataataaagtaagtaaaaaaaataattccaaatttttttttgaataagacgaattttcaaacagcgtaaataaaatgttaaaatctcttatattagaggacggagggagtatagacgtgttaatttggagtgttcaggggcgtacaatgtggagcccagtgagcagcgattgctgcgacggtgagctggagtggtcacgttgccgccggcggccagccggccggccaccgtgtgtcctgtttggttctcgccgttgcacggctatcacaccggcggcgcatgacaagtgagaaccgcgtgtagttttgtttaatcaccggctaaagagagccgcctaatccgattctgtgacgctggtggtgacctactaggctaccaccaccgacagcctctgcctggaatgaccagggtcggggattcccagagaccactgaccagtacgttcacctcatgatccaagtgaataatttcgaattcttcgtttcctactccctccgtccattttaatgcaattataagttttttattcaactttaattattcatcttattttaaaaaaattataattagtatttttttattagatgataaaacataaacaatactttactttacatatgacttatacttttaaattttttaaaataatttttaaataagttgaacgattaaagttggacacgaaaactatatctatatttaaaatgggatggagggaatatcttttccattatcactgctttttattaacggtcattatcactgctttaattgttgccttgcaagggaatgttttgctttcttatttatcgttagcacgttttctaatctcataaacaatactccctccgtttcatattataagacttgttagcattgactacatttatataaatgttaatgaatctactatgggtacgctggtacaaggatctacgtaatacgacatcaagtaggcagaaaacaaatattataccggttcaggccccttgataggtaatagccctaatccaattgatatgagattatatgatggaaaccacagattacaagggggatagtggaactcgacgataccgacgagatcgtagtcgagttgattcgactagatcacccggcgacttggctcctgtaggctccggcttcgtaggctgtggtggttgccttgattatgagattcgatgccttaggtcctcccggggggtcccttttatatcgcaggtcaactggtctccaagtaggactcggagacatcggacccagcacgatacaatgacgacccagttctgtccgagtaggactccttccatttgtgaactccatgatgaatttccttaacgtatgccaaaaatgtccgtatacgcatatgtataccatatcgatatgtgacgtatatcgaaaggtagagggtataccttacccgtaaccctgacagtagcccccgacttctgcttaaatgaactcgtgtaaccgatcgtgacttctgatgtcgaggttgttgttgttctcggtgtgaggaccgagggataaggagtgatcgacaacgccctgtgaagctcaatggtcatgagtgaatttaaattgaagtccaaaaaactactgcgcgtaatggacccagaaatttccggcggtaatctctctcctttccttggaattcgcaccatcggaagtgcgactatttaagggagttttgcggatccaatttgaagtccgccggttgtgaaaaaactctccagcctccaagcgtccctcgtcttctccgcttccgcaaaaaccctagctagctcgtctcggtcctttctccggcgaaccccggcggcaatggacctcgacaagtctacctccaccagtgcgtcgctgaagaagctataggaggatggcgctcttcccggtcgcgggaccatggagagagaagcaggaggtactgaaccccagcctgtcctgggtcgcatggttgcgatcgaggactatattctttatggttttcttcctccgccttctgaatttcttctcttggtcttgaatttctacagccttttcttgctccatttgaaccccaattccatcgccttcctcagtatcttttcgcatctttgtgaggcctacattggggtagagccgtttcttgacctcttccgtttttactatgagttgcgctggatggaaccaaaaaaggtgtccggatgtgtcggtttccgacttcgggatggcctgaagtcgcgatacatccccttccagtgcccttcatctcgcagcaaatggcgggggaggtggttctatcttcagatagaagattcggatccggtcttcattgtttctaaggagcaaccagccaagatttcatcttggactgccaaacccgccttgaccccatccctcaaatctttcgtcgatatcattgatgacctccgagaacgggggttgtcggggtatgaagtcactaccgacttcattggtaggcggatccagctgctctaggcttgagcccacccagcctttgactattctaggccggaggacgcgacccgggtttctcctcggggtattttttttgtagttgaattgactcccttatgtgcgtgttcctcctgacttatcgaattctggtctcgatctataggcttgaacagcgcaaccgtgaagcgtcgcgtcggccaattgatgatcagcggcccgacaacgacgagcaacgtccccgtccccctttgcgagaagggggcagtcgaacgcgaagctgccatcaatgtaagtgtactcagcggcccttttgcattttacttccgggatcacattgtgacttcatgaagcgtaggctctccctctgactgatatcatcgggccgctcgtggatcatcaggcggcggcgtcgctgaaggaggacgtcgccaaggaggcgtccgatgttgctgccgctgctgccacaacgagtggtggcaacgtcactgatggccttgtcaggacgtccagaaaggtgtcaggttcgagtggctctcgtctggacgcacgccgtgctagatcatccggttcgatgttgtccttgcggtacacgtgtcgaacctcgatcccatcgaaccttttttccagtttcctgacttctgcgagatacgtagataactcggggctagagcacttgtaatctttatgcacctggttcgtgactagttcggaatcccctttcacgactagtcgcttgactccgagtgcagctgcagctcttatcccggtgagtagtccttcgtattcggctgtgttattggtcgccctgaagttgaggtgaattgcatgcttgaattgatctcccgaaggtgacgtcaagatgaatcatgtccctgctccttggctgttgagtgcgccgtcgaacaccattgtccacgtttcgttgttgatttggttgtctgacctattatcaggcatagtccaatcggctacgaagtcggcgagtacctgggacttgatggttgttcgtggcacaaagtggacatcaaactggcttagctcgactacccattttgcaatgcggccgacaacgtctttgtttctcacgacttcaccgagagggaaggaggatacaactgtgaccttgtgggcttggaagtagtggcgtagctttcttgatgtcatgattaccgcgtagagcagttttcggatctgtgtatatcttgtctttgcgtcgtggagagcttcgctgacgtagtagactggtcgttgcaccttctctctctcgacaacaatgacagtgctaacggaatatggcgtggcggcgatatagagaaataattcttcattaggttggggggcaacaagtacaggtggatttgataggtagcgcttgagtgcaatgaatgcctcttcggcttcctgtgtccatacaaatttgtcttgcttcttcagcagagcgaagaaaggttgtcctcactctctcacctagcgatgaacttgcttagtgccgccatgcatccggttagcttctgtacttcctttagtcttgtaggcgacttcatgttttcgattgccttgatcttttcgggatttgcttctattcctctgccagagacgaggaaaccgagcagcttgcccaatggtactccgaacgtgcacttctctggattgagcatgaggcgatatcgtcggaggttgccgaaaacatctgtatacgcgtatgtataccatatcgatatgtgacgtatatcgaagggtagagggtataccttacccgtaaccctgacaatatgaaacgaaggaagtacatattttagaatatatatatatatatatatatatatatatatatatatatatatatgaaggttttttggaaaataaataaatatatttttcaagtgtataacatttattactcaattaatcatatcctaattacttccatccgaaaggctaaagcaatttgcagcctaagtcaaagctaaaatttaaaattttaaacttaattttaaattattataggtgctttttaattttaatttctgaacttaatttgaaatcactaattgtagaaatacaaaagtcgtatccaaaattatgtttcgttgccgctattaggcgaatccaataaacgtaaccctatatattctgaaaatatctttaaatatactacctctgtttcaaattgcaagttattttaacttttttaagtcaattaaatttatagaaaatttacctctgttttaaattacaagttattttaacttttttaagtcaatcctctttagatttgattaaatttatagaaaattatagcaatgttttcaaccaaaaaaaaaactatcagaagctagacgtaatgaaataaatttagtgctatacgtattgttatatattttacaatcttgataaaaaataaatgacctagcacttcccaactcacttatttctattgtgcgcgcatgctttttaaattgctaaacgatactttttttttgcaaaataaatccttataagaaagttgctttaaaaatatattgatatttttttaaaaaataactaatatataattaattatgtgctaattaaccgttccattttccgtggtgcacagcccttataatataaaagagggagtacataataaaaatttaaaaaagactcgttatttggagaaaaaaaatggttgagatgccgtggaaagcggcaggtaggctgaccgcgtgcggtgaaccgactcgagtcgagagagggtgcctcgaaatgcacgttgatataaacagcccgcagcgaaaccaccccaaaaaaccaaaaacccaccacccccacgcggtgccactgccaccgcccctcgccgctgacgaccgccgccgccgccgccgcacggacattccgcacacgcccgcggggggcgggcggcgccgcgtcgctgatccaacgcgagcacgttcgtcgtccatccatcctcccgctcggatttggagtcggcaaccgctcgggctcgcgtcgcggcaactgaagcggcgaaattgcaacaggcacaggcaggtgaggtgaggagcattctgatatattattatttttttttgcccccaccacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtgaatgtgggcaatgactaggaggacttggggttatttggtatggaatccagtactggatagctcactgtcactggtggccagtatgcatattcatcatggattgtggttagctttttccaaatctgcggcttgtcagatctgcctgtattatagttattgtacagctttatgtctggggctctttcgcgccgttgggacctcaaattctccaatgcaatccaagtcgcatgatggtccaagaccagcgtgccccactgccatgtgcttaacaaccaccttcttcctgagatcgactggacaaggaagcataattgtactgaattctcgtgttattacgtcggtttaaggtgaaaaatcttgcttgagatgcttctttaaggtggagattctgcttagctgtacagctgttgagacaagctggagatcagttattcatttgatgtcctatcacttgttcaatgttatgaagttatgaacatgggcttcttagcgttttactctgggtgcagtgtaagttatttatcttctctgaacttgtactgcacttgtagtacattttcttgatctcttcagttaaagcaatttatgtacaagctgttttgtgcgtgactttttcctgtcataatcattatgttgcagggtcggaccacccttgaaagctcttttgctatcttgctcattgacctgatcaagttgctagacctttgctcttgttactaactttcttggtgttatatacaggtatcaagtttctagtgcactaaacaacctttgagatgggtactgtagagaatatggaagggagagaagagcgttcgactgatgtggaacgggatggtaaacaaggaaaagaagttgaatcggactatgaaccagctagagactctgtttcatctcagggtgaggctaacagcaatgaagataccagagccaaaagagtctcaagggttccaaagaagctagtgaagaaagattcaaaggaaaacagcccacgctcaggcagaattaattccaatcgccaagtgcagactaagctgcaatatatatcgtcaaacaatttgcagagcaaatctccaaagccaaacaaaacatctgatggtgctaaaaccattgagataacaaagccagatacagtgacagttccttcttgtccttcatctgaggtgtctgaggagatggatgataaacccattgagaatatagtgacggatgataaatccattgaggatgtagctgatgataaggccactgagggcacggcctcttatgataaggccactgaaggaaaagctgctgatgatacgaccgttgaggacaacaccactgatgaaaggagcattgagagtggcactgatgataggaccattgcgggtatagcagctgatgttaaatctagtgaagaggcaaaggagattgatatattggatgaagccccaaattgtgatcagagtactgctactgacgaggaaatagctgatactgaagaaagcatagcttatgatggtaaatcagctgcatatgaaaagagtgaggaattagaatctaaatgtgaaaggttggagcaggaacttcgagaagttgctgcccttgagattctctttattcagtagtgccagagcacggttgttcatcgcataaattgcacacaccagctcggcgtctgtccaggctatatgttcatgcatcaaagttttggtcctctgataagaaagcttctgtcacaaagaacttcgtttctgggcttgtccttgttgcaaagtcttgtggaaatgatgtttcaaggtaaagtatctgtaattggatatagtatgtaactctgtgtagcttatatttccgcataccatcatttttaaaataaatctttatgtaggttgacattctggctatcaaacaccgttgtcctaagagagatcattgcacaaacatttggcattacacgccaaccaagtcttgctatgaaggctttcagcacaaatgttaatgcaaagatgctcggtaagaactcttcaccaacgcggcggaaaaacaactacagtggcaagcatgctagacctgctatctggccattacctgatgattggcgggaaactggtacactcgtggctgcactggagaagattgaatcatggatcttttctcggattgttgagtcagtgtggtggcaggtaaaacctttcttatgctttctcggcactttttaggaaattgagtacattttattctctgtaaaactaggatagcagacagctttttcgattcattttgttgtcaattttctgaaggatgtttccttttcaggcattgacaccccacatgcaaacactggtgaaagatatatcaagtccaaaggctgggagtttgttgggacctgctttgggtgatcagcaacaagggaacttctccattcatctttggaaaactgctttccaagatgccttcagcagaatatgtcctcttcgtgctggtggacatgagtgtggatgcttaccagtgttggcaaaactggtatgtttaatcattgatatttaatttgagaagaataatcatttttgtgaagtttatgcatgagttgttttattattgtcaggtgatggagcactgtgtagctcgtttagacgttgctatgtttaatgcagtcctgcgtgaatctgcaaatgaagtaccatctgatcctatatctgacccgattgtcgactcaagagttctaccgattccagctggtgacttcagctttggatcaggtgcacagctgaagaactcggtatgtgcccaaattgcaaaacaactacgttcttagtttaaaaccacttacgttggaacgtttcctgtaactgcatgaagaacaaaccagaacatgtgttttaaatcatctcttccttgcaaacaaaaccaaatgttaatggaccaaatgcttcttcagatcggaaattggtcccgatggttgcaagataagtttggcatggttgctgctgcccctgagaagcatggtcaagcaggagatgagagtgatgacagaagtggtgctgctgatttttattctttcaagctgctcaacgagttaagtgatcttctgatgctcccaaaggacatgcttcttgaaaagtccatcaggaaggaggtcagtattcatgcttagtcactccaactcttaagttggaacatatattcaggttcagtgctgcagttaaaattttgtcattctgtttaggtctgcccttctattggcattccactggtaacaaggatactctgcaacttcactcctgacgagttctgtcctgaacctgttcctggaatggttttagaggagctgaatgccgaggtacgacgtctatttgctaaatgatattattgcattgtagcattacaaagtccaaatacaatcttgctcaccatatgtaatgactaaccaagatacttctatagtttcactctacaccttctcaatcagtgttggttgctaaattttcacacagagcttgctggagcgcttcacggagaaagatgtgatcaccacattcccctgcgtcgcggctcctgttgtctactgccccccttcaccggaggatgtcgcggagaaagtagcagacgcaggcgggaacgcggagccggacctgagggcctccatggtgcagaggagagggtacaccagcgacgacgacctggacgacctgggcaaccccctggcgtccctgtacgacaggagctctccaccctcaccctgcaacggggcctctcgttcgactacacggcaaggtggctctatgtcgaacgcgagatacgagctcctgagagaagtatatggtcggagaggcctggtttgagtaaccagtgaaagtgtggaacggaagacgaaaagagagcctcttggtcttgggttgcagatttgctgtgaggtgaacaaggggttggaaattggtcgggaaggaactgctttgcaacagacgctgaatgaacgaacagcacttggatatcctcatggcaaaatgctagagtgtttagaacccatccccccattcttctcatgtatatttgcattttgattctgttgaagtgattggttcactcttggcaaaaggggataaatttatttgttggtggtagtgaggagaaattttagtgagtggtcagagtgagcgtgacttctgcgtcagccatcgttcgatgggccgcctaactgatcacaaataggaataagttcaactggcgtccctcaactttacagtttacatcgatttttttttgacatcccttatcctctgccttgtttcactgatgtggcatcatagtcagcaaaaataaaataaaataaaatatagagcccacataccgcatctctttctttcctttttctcttctcttctctcgagcgggcgtggcgtcagatggggggagaggccgtcagcggcggccggcaaagcgagcgcgacggcgggcagagctggcgcagcgggcgggctctgttgccgatgttgtgctcgtcttgcatggagatcccctcgcgacttcgtggcggcgggtgagcgcggcgggcgacccatggatcgagctagtactacgtgctatggcccctacctctgaattatgctgctgctagagcttaggtgggtatcgaagaactggacactgcagatagctttttattgataatattaacttgtggcaaatgacgatcaagcgtatagcaatgagtgagagcgaagagttggtaagctaatgctactgctcttgatttggagcacacactatacggttgcgttgtattaaaccgcaacccaccccccaccccaccccccgggggcaacccacacccctacccctacccccacaccacaccacaccacactagcacatccctgtccccctcaattcccgtaatggtgttactaacggtactatcaatttctactgagtaattgttttactggtagtagtgtttgaatcgtcgtatacatacatgtgttggtcccacaccgtaactaaccactaatcaatttcccccccttttttttttggatctacagaggcaggaagccggctcggcagctgtggcatcaggaagcggaggcggcggcgacggcgatggcgtgctacagggaggaggcggcgtgctggatctaatgggttaggcggcaagaacgggcatgtccatgtctggcgaggaggcgaggacggtttcgctctcgtttccgcggttgtcgtcggctccctccctcaagcgagaaaagcaagaagcgcgctgcctccgccaaggctgccgacgaggcctccaccaaccgcacccgcgctacctcccgacgccaacccctccgctggatccccattgctgtatcgttctcctcggtgaggtggggacttctctagggtttggggattaggggatttatagggttcctctgccctccctgcgtataggaacgaatcagaatttggtttttctttatttttttctttacttcatgcgatgggattttgcatggtggttctgctccagatctggaagcttcaatggcatgggtatcatgtgagaagctccttgctggtggatgccccttgttcttctgttccagatgtacaagctacagggcgacacgagctcctgctccctgcactccataggttagcctgcatcgacgaggaatacttgaggacgccaggggtgaagaagggtgtagcctttgggagccttgccgccagatccgccgtatccagcggccccgcgcgtccccgacatccctcttgccgtggtctagggtgctgcgatgtcgtcttgccgtggtctccattcggtttgttctccatactattttaattggacatagtttttttgagtaattggacatagtttttttgagtgctcagactgttgtgggatctattcaataagctgtaatgacttgttgtctttccaattgctgaaatcttggaggttttttttcggttaatttggctgaataacaatgttatgcgatgctgtttgtgctttgattcttcaggtactaattagagatattggagccattgtttaattactttacgagcagttcaggtactttactagcaattcaagtgacaaatttggttcactaatctagttctagcagtacaaacaatttcagcttttcctagttttagagttttgattctggcatgaattgtatggggaatatgattaattcctgcacactttaggatgaaggtctggtctcatttcacttgagcagttcttgcacttcttttctttcaattgcgggaatgttcagatcattttttgcttaaagtacctgattcgttcttagtttgtgtgtttgttggcctaaatctttcttccaattgcacagctctggaactcttgctgaacagaatagcatgaatgattctagtgtagggaagttcttatttttattttttgttggatcatggaattcagcactaattatagactaacagtgttcttgagttttcaggcatatctctgataggctagtgttatatggttattatggggctcatgagttttgaattttggtcacgattttcaggactgcaaaatatgcagtgagatgtgtaaactctgagatatgtcatatttttacagcatgtgtacagtattcgtcgtagttttctgaaattagtactgcatgtcctgtgagatgtgtaaactctgagatatgtgatatttttacagcatgtgtacagtattcgtcgtatttttctgaaattagtactgcatgtcctgattctgaattttcggatagatgaaaactcaaaaagctcgatcgaatagcagttttctaaatttttgttgttcaaaggagcacatcaattgaattctttttttctgaacttctgactagatatgttcgctgttgaacatacccttttttctctgtatatttttgacagaacagacatcttcagactaagactaaggtctaaattttactgaaatgattaacttctaatttttgcaggcatcagcatctacagtgtgcactcttgcaggtggatgcacatcttgatggtatggtggttggtatttgctctgctgaagatgtacatgttctaatttttttggttgctcatctatatctgaattttctttttaattgtgaattcatttgtgttcaggaaactagaaaagaacatgagaagattatgccagtggtgatggtgccactggaatggcatcctcgacatgtccttcgtcaacgttcgtcgccggcagccaacacaaagggtcagcccaggacgaccacaccacaattgatgacaggcttcggtggcaggcgatgcgatgccctctggattgtgctttttttttgggtaccgggtgtatatgtgtttgtaacgatgatggcacgatcaattgtaaaaacaaagtccattatacccgtattcgtgcagtaaaatatttactaccttatatatcaggcccaatcaactactaagtaacttttttactccctccatgattggataatcccaatacatatcaataattttttttattccatgaatatgttgcttcttatctattagtaaatcatttactcatgggcgagtctctattagtaacgcatgtactcattgccaatatgagatgtggctagcaaacgatattcttatctgttagtaactcattgtgggccaagtctctgttagtaatgcatttactcatgggccaataagggaagtgccaaacaaatgttactcttatctgttagtaactcatttactaatgggctttgtctctgatagtaactcatttactcgagaatagtaactcgattacttatcaaaaacatactaatagtaaatgaattactaaagtcacacatattattgttggtggctgggctagcaaaaggtgcgggattgatacatcattcaatttttacggtatagtaaatatgttacttatcgtatattgcgccccaaacaatcatttagtaattaatttactatacgttatttntaaaaggtgcagggtgagggatgtggggtgggtgcagctgggggggtaggagggagggtgggggttgggggttgtgaggggagtagtttagttataacgcaccctaggtgccgtttagcacatccctatatatatatagacatcggccgctgggacaagcatccaccagagcttgtccgccgggtgaggtagcccaggttgttgatggtggcatcactccgccactccatgccatgacaaaaatcgtcagggctccagcggcagctcagggctcaggtagcggcgcgaggagcgcaaacaacggtgtgaatcctgctggagcgctgccgcaacgagctctgccgcctcatgcttccgcggccatgccgctctcctccgaacagaagtgggagagagagaggaggaaggttagagaagaggggaaatagagagagaggatgatatgggtctcactgcatatttttatttttatccgaacacacgctgatatgtgggtcccatgttttttctgactttatcaatgtcacgtagacgccgccacgtcaaccaaactgtcttggactttctttgcaccggttttaagaattaagggactcgtcatattgcggttcagggacgaatttcggatttggcgacaaattgagggacgtacaatgaacttattccttgtggcggagtcccttcctccgatccggccggcccgacctgtgatccgacgcagctgaagcacgcgggcgcgctgcccgccaaaccggtccacgggccacaacgtcacgcgcgagtactctccgtgcagcccgcgcgtcgtccatcccgcgatacgatcctctcgcgtggcgcgcgcgatatccccccgaatcaccgccaaacctgcactggttctctcgcgtggcacgcgcgcgttgatccaaacccgttgttgtacgtggtttgcggccggcagcttgcggccgccctgcgcaagcgcacacacattatgcatgcgacgcgcgcgatcggtgacgagtcgacgacgactcgcgggagttgacgataagagatcgccgcccgcaggtaggcatgcgcgtcaccatcgggggcggtcgtaactttgtccatcctcgcgtaggcaaacaacatggcaagcaagcaggacgtgtttgtgaattggctggcacaaataaaagcaagccactttacgtactcctccagctgttacgtaaaggacggacgccgcggtatctccgtgtactgtgttgtaaggccctctttgattttgtaaaaagaaaaacaaaaaaaaacatagtgattttttttttaaaaaaaagtttgagtcctactttattttcttatctggtccttataaaatggctcgagagaaataaatgtgaggaaagttaacacatgatatggctaactttatgggaaattttctttgaacctttttctctcctctagtttctttcttttgtttcctcacgaccaggagcggatctacagtgttatgacctgtctcagacggcaccgacgtctttcgacaagctatgcttaaattgcttgtctatatattataacactatattctaaatataattagtatgctataacaccaatgaacaaaattatggatccaccactgctcaccatctattgcaacgatatttatttatttatttctgtattttgcaattctttatttaacaattacatttatattataatcctaaccttttcatgtctgtttttatcaattctactacatttttaaaggggcccacactatatccgtgcatgtttatttcactcgtgtctttggtccctttttttcctcaacttccgctacttgcgcgccaccacacaatagatacgcaatcccaccacagcgatgcaaacgttcttacagttgtcattgtccaagcttctttaatttccacacatgctttaatttgttgcgcactgcacttacgagttacgacatctcgtatgatctatcttgcactgaggtaattaaactcatttccagttgatttaatttacatatttgaagctttcagttcccctatgtatgaaactgattataagccgtaatacttattagcgacttaaaaactaatttatcgcggtttaaattttatatatgtattttttgcttaaaagtcaacgcaagtaaaacaaacaattaaaaacagcaaaatcaaccttaaaactaagatttaaaatttaaattaactactaccgaagagtggaagctgtactatttagttttgatgaactctctctatatactccctccgggttgataatacttgtcgttttaggcaaaggcacggtctcaaaaaaacaactttgaccattattttctattataatatgtaaaaaagtgttaataaatatattattttattaaagtactttttaagacgaatctatacatgtggtcaccatatttgaaagacaaatattttaaaaataattcataatcaaagattctaaagtttgatctcacccttgtcttaaaacgataagtattagcagcccggagggagtagcataaactactcgctagcgtaaaagaaagctacctgcagcatgcatgcacccatgtggcaactacgtgtgcagattgaagacaaaaacttgagttgcttaattagaagctaagctctcaaacacatcacacgtgtgacatcatgtagagtaagtagctagtgcaatgcactttcacgaatcaaacgagttgacacggcttgttcgtccagtctactcaaattattgccacatgtgccaatgtcaaaccatgcaccagtactagtaatatatccaagtggctacatattggagttagctagctacctgatgatcgacaggagatcgatgaaacaactcaggcatgccatgataagataatgatgcatataaacacgtcgtattcatttgggtagatatgtgagagctaccccagtagtcattagtggcacacatttggctagaagatcgagagcttataaacccctcccctcccattggggactgtacgatagggtctaacattctagaatgagagagagagagagagaggttggatgttgagaggaccgaaattctgattataacagtttcaaaaggtgtaataattaattttatacctgtaattaatttgatgtaacatcaacaagaagttagggtgcttacattaacttagaacatgtacaataaagtaatgtacgtgggttgtacaatttgtacaatttgctacatcagatttgtgctagaggagagaagatgagagataagaaaaacgggatacatatttatagtcagatatagcacgaactttaataaactatgtgagagagatggaaggattatgtattaatgatacaatatatatctacatctaactattgtatgagcgagctaacaggttggctattggtgatattttaatttttggagctagttgttagctatattattaaacttgctcttacattgatcaattgtaaaatgtttttcataggtggaaaataaccgatgtgagacacaatattattcaagagatatgtacaggtttttttatttttggaaaaaaaaaatactatagctagctaggtgcacgggattgggattaaatccatgacccgttgaatgaaacatgcgtggactaaccaacgtacgtagcaaagcgaacattttacattaaacagcatagacgacaaccaaatattccatccgtttcaaaatgtttgacaccgttaactttttagcacatgtttgaccgttcgtcttattaaaaacttttatgaaatatgtaaaattatatgcctacataaaaatatatttaacaatgaatcaaatgataggaaaagaattaataactacttaaattttttgaataatacgaacggtcaaacatgtactaaaaattcaacagcgtcaaacatttcgaaacagagatagtatttgagtattgagctaatatgttggttaattaaggggcgctattgggcggggggaacctgaatcaaatcactcttttacgtccagatactagatcaaccatggatagtgctaagctatgacctcaagagattgatgcgtcaatgaaatagtacaaattaaagtaaattttacggtctttctatagtgtcattttaatcttttaaattactgagtgtactcataggtacaacttaatatgctatccgagttaactttcttcgcgaacgtgcaactatccgagttaactaaaaggtatcgagttcaaatattgatcaatgaaactgaacaagaaaaattgtcttacatctccgtttcacttgttaaagtaatcaaatcttaatcccgcatagacaagtgaaaaccacgtctaacctttttttgagagaaaatatattttttttgagagaaaaaaccacgtctgactaacaaaaggttcctctccgacataactacatgatgtgatcgatgtgatcaatgatagagccatccacccgtaagtccatagtatgttaatgagtcacaatgtcatggcgatattacgtcagaggattatgatacatggcatgactggcaatctgttattagagtcactagtacagagggtatgttcggcaggccaactataactgctgtgtagggcggctgctgctgcggttatggtagaaattgtatgttgctactgtagctgttgattgccatctagtcacaccaaacacccagagtaattttactcatagttttgggtgctcaaaattagatagtagctaaaaaaatcaaagttttcctcgttaatagaaaagtaatattggtaggtggatatgtgtaagggttgatgagggttattagaggaataactcatcgatttgcggactgatagaggataaaaattaatttattttgacatatttagaaaataccacacgttattttgaaaaacacagaggttaccggaggagagttttctcaattttcattggccagggatgcgtcaaggcggcgtacgtacaaagcgtaagtcgttacactgaaaatttacgctagtgctgtagctgctagttgaggccaagttaatcttgcatatgcaagggtacgtagctagccgtgctggagaacgtgcgcgcgcgtacgatcgaattaacagcagcaaggggcctcgctctccggtgtcttttcttgccggacaaagtaggtcgccacacctctcgcgacgtgcgtgcattccatgcatacgcatgtcgtgagctagctagctccatctatatattgtccttgacgtgcatcgcggcatctagtacgtaccgttgccttgccttgcctggacgaacggaagcaacagcaacgcatatgagatctctccggccatgcatgaatgcggcccatccttgtgccaattgtcggccaatggtgtacctagaaacccaaacggcgtgtgggagaagcatcaccggatttaccattgttgtcagtctcctttaagcatctgctctctgatctcactgttaaaaaataataattctaatttttaagatgagtctgaacatatatgtcaggctctaaacacttcaagcagtagtagtacgagtttgtaagctagtactctctatgtctcattttaaatgtaaccatgattttccgtgtccaacttttaccgtccgtcttatttaaaaaaaattgaaaaaaatttgaaacataagtcacgtataaagtactattcatactttatcatcttataacaataaagatactaattataaaaaaaatcaaataaaacggacgatcaaagttaggcacgaaaactcatggttgcgcttaaaatgggacgaatggaatagttgtgttgtgcctgcgcatatgcacgttgattattactccctccatcccaaaatatagcaaacctttgagggagtaatgattataaaggattgatgactgatcttgaagataatatatatgcacacacatatatatggcgtgtttagctaggccctgtttggaagattagcccagggctaattttaagagctaatgtttagtcatgaattggtaggctaaacattagcatagggtggcatgtttggatccatgggctaattcaaggctaaaagatggagagagagagagagtagaaagagaggagagagaaggagagagagagctatttttttatggttcccacacaaaattagcctcattagcaccccttggaggggctaatgttttgaggagggctaattcatattagctcaaaattagcccacctgtttggattattgagggctaatttaaggctaaaaggtgagggctaaacattagcccatggaaccaaacagggccctgcatggtacaaccgctgtgtagcgcagcacagcgtatcggttattacagccacacaaatcactgttgaggttgttggttgcgttgtggaacatgcccatagccatttaattacgggtagtggttttgtataaagctatatacagctatattatcatgctaagaatggtttctttatgtggttttcgtaaatggcaaactattggcttacataatagttgtgaaaatgcagtaggtacagtggcaaagctaggtgtgatgcacttgatagggcagcaacaagagatgtatgattttaaccataagatctcatatttaatccgtaacacactcgtattttttttcttaaaatatgttggagggacgtctcttccttcaaatcttgaaaaatgccatagttagttataggctgttctcggctttcactggtttattcaaatgtcatagtccagattttaaaatacatgtggacagcaatggaggtagcatacacagtagtatttcgtttttttttttcagaatagtaagcactacgagcctgcaaatgactgaagctgtgtgtatactgtatagtgcatagctatgtgtaacctagctaaagcctgaatgtttcagctctttcatagtctgaaggtttatagaaaagcagagagtactgcacagatttgaaatttaatctcagccccgtcgtaaatagaactttgcatgcattggaaaatattgacgtagttcttcagatcaacagccagccttcagccacagctcaaagcaagtacagataaactgaacagtcaagctgtacgaaccatggattatatatgaattagtgcacgtacatggtcaaacattgagacggggtttaatgattaatctaataaatcaacactgcttaattcatgggacatcttttccgaatatcgaatcctgacagatcgggaaaatggcatatttcctctgctggtatagtaactcctctgtcagatgtcaatatgtcatagatcagcagcaacattgtgccattttgtgccatttattgtcgactcaattattcagtaattagattctgtattttgttggcacaatgttattactgaaagatgtaattcaaaaataggaattacatcccacgaaaattttggaatcgtccttgtgtcatcatgcagagagaatcaataactacaattatctgaattttttttatcgaaacacatacaactatctgatcgaaaatgcttccgctcgggcgtctgagaccaacaaatcgaacactgtaccgtagtcaattagactgcagggattaacccttgtgaagtacagtattttcagtcaccctagcctctagtgagcagaaaaggattcggattttacagtcccctaccgaaatagttacccttatttcacaaacctacccttaccatgtcacaattttacagtacaatctcttctactcaattttagtttacccctttcaccacaggatcacataattaatgattttttttgaggtgaaagtgaaaaaaagagagaaatactgtagttcgagtggaacaccggagaccggacgtcagaactccggcaagaactccgtcaactcctcctcctccggctccggcgaaggctcgtgaagcttgttgaaatactctaccacgctgaacccctcgcacgcggcaatgtcgtcggccggcggcgggatgtacggcggccgggagagctcgccgagcaagtcccacgcgactccggcgaagaacgggtgggcacggacctcgtcggcgccgccggcgaagccgagcctcttcgtgggctccttgtcgagcagcctcgcgatgaggtcggtgagctccggccaccgccgccgcgagtcggcggagaactccggctcccggaggagcacgttgcggaacgtctccttccggctccgcccccggaacggcgtcctcccgtacgccatctcgtagacgagcacgccgagcgcccaccagtcgacggcgaactcgtgcccctcgccccgcaccacctccggcgccacgtactcctccgtgcccacgaacgagaatgac

SEQ ID NO: 49532 - DNA, 10027 bp, Oryza sativa
  unsure (1)..(10027): unsure at all n locations
gccgccgccgtcgcttctcttgaggaaccaggccaggttgtgggtgtactgcccgggcgacgacgtcgatgtcgtcgcggccaccgacgactcacttctcgcgaagattcgcctcagctggctccggccatgtccctgcagctgcggcggcggcgacgacgtggccgagcacgacgacgacgaggtggaggtggacgcggagggggagacgggcgggagcagccgggagaggtcgaagtcggtcagcgtgacgtggccgtcggcgcggaggaggacgttctcgggcttgaggtcgcggtacgcaatcccggcggcgtggagctcggcgagcgcggagacgagctcggcgacgtagaacctgatggccgcgggggagaagacgcggtcgggctgcgcgtggcggagctcgttgaggtccccgccatggcagtacggcacggcccacgccacgaggtcgcccgtctcggcgcgcccgagcagcgacgggaggtgcgggtgcgcgagcccggacagcaccgacacctcccacctcgcccgccgcgccgcgtccccctgcctcgccgccgacgcgacgacggacctcttgtcgaagaccttgagcgcgtagtagcacgccccgccgccggcggcgtcgtccgccgccgcggcgacgaggaacacggtgcccatggcgccgcggccgagcacgcggacggcgcgcacggcgtcgaggtcaatgtccgccatgcgcggctgctgctgctgctgcatgggcgcgcgcgcgcgcgctctgtgtgtgtgcttgggagtgtgtcgcgttgtgagcgacgaggacgtggaggcgagatataataagctggtagtagggggccgggctaaacccgcgagacggttgcctaattaatttgttgtttttgtcttgtttaacctgcagagattaatgaaacaaagtggcaacgccacttcaagatttatactattgttatctccggcacagctttggcgttttctcaattctcatcggttctgtcaaagagacgatcttcggagcatatactggcctagggtttcaaaaccggctcagtcatcgaataccgcacggccttttttttctgtctatatatcatatgacataaaatctcacctcctatcatttgaattttgaaccattggatgtgctttaagattcgcgcagccccttaaaccctaactcctattcctccttccccggttccagatcatgctgccaccctcctcctcccgtcccacacgcgatccgccgccaccaccgccaccgccacccccaccgcgctgccgcccgcctcgccggctggccggaaaaagtcaacggccctgcaagccccctccccctccccttcccccctcactttgtcctcntggcaacnatnacnatgtgcccccgccccgccggatccgtttcctctggcccgcacctcctaatcccacgcttgctttgacccgccgctgacgccggctgaccgccctcctccatccccgcggctttggcgatgccgccgccacctcgccgctcgccggagtccaccgcccaccgccagttctccgccacccacggccatccctataagccccaaggaaacccccctcttccccctcccccaacccccctcctaccctcaccccaaccccaaaccctaacccgccggagttggaggagagaagccgatgcacgaatcttggcatggatccaatggtccaaaatctgtaagatttcatcctcaaatttcattcgaatgccatatagcaatcccctttttttcgataaacgcgattactgtatagtgtccgacaaaatttgaacaaaggtaggagtatttgaaagttattcccagtgaaatatactatttttatatttccatcttttatatttccaaaggtgccatataagcaacgagtcatgtaattgatgattgaaaaacacatggttttatttttgttgtttcataggtaatacatgcaagaaactatatattataaacaatttggacatggttttatcctctgacctcttggcacgtcggaacaatttggacatggttttatttagatgaaactcatcgatctcatctctcactttattatatttcttaccacatcattaaaaaaatactaacataacaccctatttaaatagaatgaaactactatattaggatgggccttatcttaacctcggtcgtctccttcgatctaatggctagaaaattgtctccaagattcagccaaaaagagagcagggagatatggagaagaccgactccccggcaatgacagtgttgccgctagagccgcgaggtcggaggagggtagtggataagtcggcgatagaggaattagatcagagtggtaggggagctaatgggggcaccttgccgtctcccatattgggtaggaggagaggcggggagggaaggggaaggtcgattggcgggtcttgttggcatgctgagggcagggatcgatgtggtgacacgagtagggtcaaccaataagtcaccaacgagataaaggttggctggagctgaagggcaccctgaaagaccttccagggagaccagtgaccctataacgatataagtctaccctatgaagaccaaataacctgaatatgttgaagaaggggaaaaaaccctcgtaaatgtttctatcaaggggttatgcatgtaagagtttgtgtaagcaaatcctaaggttagttagcaaggctaaaaacctacaaataaatcctaaggatatgatgcaagggcatgttgtgaaaaattaataccgtacactttactgtttttgtctatatttttaagataagtgtttatcttttaacagccatatagttatttaatggtcccttcaacaaactatactgaacttttgaattctcttgaactataccagtttactgactcaatacttaattcctacgcgctcaataagactgatgataactacaataactgaagtactgaaaatttaccgtcgcattttcaaccatacctctggcttgggttttagcatttctaagatattgtatccgaggaaaaaatgtgtaattgtttctctctaactctagtcaagaaaatacattgtttgaagatatcttaaaataaatctgtcatgatttacatgaaaatcatatggtggatttaaataaaaagcagtttaatatagtactatcatgtagagctgtttatttgtggaagatttgaaaactagctttatcacttcagcatggagtaagtgggtggtggatgccgttggtccactcactaatacgtgtgcatgataagctaaattatgtcaattttgtgctgcttatgcctcctccaataaaggtgagtcagctagctaataaatctccatatcagcttttgtatgatgtggaagagagagaagataaggagagagaatgcactatctcttcttcaagagctaagcttctaaagaaaatatgagaggaattgtgaaacccaaagcattttaaataatatgctataaaataatttattggagagttaatttttttctcttgtataaggtgaacaagcatatccattaaaggaggcgttacaagagagatcatttggcgtggagctcaaggtgagaaaggtgagctttacacgtgtgcacagtatcagcaaccgaagattttttttttttttacagtgactctacaaacaggcacttcacatagtagtattcaaaacaaaatttaaactgctggtcatcaatcatatgatgcaacggaacgggcatattccaaatcggacatcgtacgggattatcgagagactttgtgttgcgattgtacatgacaaaagattatgataccgataggacgaaccgtaccattatattgtgcttgggatgctgctcatgagtcgtagcttgtgttaattttgcatatttgtacgatgtacctaacgaattttgaatgcaaatttacgagctaaattaactggccagagcagaacccgtccttcagcgacttctgcacgtcgccaatattgacttcgagtcaaaatttgatagtacgaattcggtttgattaatgagacaaaatagagtgcgattgatgcttccctcctaacatgataatattttgtttaatgctgaaatcaagaaagtgaaggtcaaaacatatcttttcgtgaatcagccttgtctgttggtgcttgtttagttcgcgaaaagaaaatttttaagcgtcatatcggatgtttaaccggaatttcggatacgaataaaaaaactaatttcataactcgcctgaaaaccgcgagacgaatcttttgagcctaattaatctgtcattagaacatataggttactgtagcacttatggctaatcatatgtactaattaggattaaaagattcgtctcgtgatttctcccataactgtgtaattagtttttttagtctatatttaatgctccatgtacatgttcaaagatcgaatgtgatgttttaggaaaattttttggtgaactaaaccaggccttgtttagttcatatggttagctttaccttttgaaagtgctactatctttttttggtgaagttcgctcccatggtgagctgcatgcatgtgacagaaaaatcagaattgaagttgacattgtgcttactgcttacgtgccaccaaattacagtgcttaaattcagaattgaagttgacattgtgcttactgcttacgtgccaccaaattacagtgcttaaattcggttataatttagaataatcagggatcatattggcttgcttcaaacatgtccaacagagaattgagcttgagtacttggactgtagtttttttttttttactttcatacagatatttatagatttcttcagttagttctttcaaatgtgcaatacgaggagcagtataccatcagtatgacagtcatcaactggtgagcttgtatggcagaaatgggtcctatataaattgaattactaattaattttagctgcagtagtgccagggtaccacctggtccaccagtctaccaggaacactgttcgtccgtaaacatgtgtgtgataaagaagatactcagagccgtatttatttcagtatggcacaggagccatccaaaatggcctaaaatccagcgtcaagttgcaaacaaaaagtatatatattcaactaagtttgctgacaaaaaccaacataaccatcagggaacataagtttatatatgttaaagggtgggtggttcgtactacaaagacggtgtacttctatgaagaaaatcttcatggagtcatgtttaagttgagtgtgttagctacttttgttctcttttgagaggaggtttgattgctaagtggcagcaatactaattgctccaattctgtcgtttctgaagatatataattcttcgtggagcccagagcctgaatttgagggttgccttacataagcacattagaataaccaagaaacctgtcccatggtcaacaatttgtatatcgacacttcaaccaacaaccataaactccaacagtgctaagttcaaaacgagataatgggtaaatggagaacagagttcctgaaacactacctgattacctgctataaaatggaatagtcactcctagttcctagtgttgcctaactctagaaaatcttcatccgccgtcgatcgagacagggacggatgaagcaatttcacaggaattaaactatctcctatgaaattcctccaaaatttctacgtttcaaaggaaccatgagtgtgtggacggaggacacccggcagtttctgttgtagatcatcccctgagtcgggatgtgagaaacatcacgtggcataggcaaaccatcctatccaacaccatctgtgcggcacatgtatgatgaaattatcaacagtgaatcagtgtgatggtttggatgatgctctgaacttgagccgtggagagggaccagttctggatgatcacttttcttgatcaggcgccggtccggtcaaggcctcgatcgctcgtttcgtttggtggttgtctaccactcattaccaaagctctgggacgagaccgaaaacttctttgttttctccttaaacaatgattacctgaaagcaagattagctataacaaacgtaacgtggctccctggctaatcaaagcatatggcgtcttgtgccgttgttgcttcatgccactgtgcacgcaaaggccattccttcctgccaagggatacccagctgggaatgtctctgacagaagagaaccaaaatggagacgtgaattcagacgtagtatctgaacatggagaagaattgtggattttggtgtctctgcagatgcagagaccgacagatacacatatatacgtatagggatatgctcagtgttcagtgttgttgccacctgccaatccgtcaggttaacgatccttttggaaattccacccgtgcattcttgtgtgactgtgtgcgcgaatcatgctctgctccattattggagctgagcttggcgtttggcatcttcctgtttatctggttaacttcgtcgtcacctactggctactcactccccctagtctttaacaagtcgtaaagctgaatagttgctaacatgttagcccacactgatgcagggggttaagagtattcaaatcggagcttgtcacccatttaacaataggtgtctaacttggtcggccattacacgggagtattctagatcaaagtgaggtaatcagcactaagtaatttcatcaacacaagaacagatgcatcaacacaagaacacatagggacataggataggaggcccttttttgcagctcctgggtgcgtgatgaaccgatgattagtgaagctcaattagtagctccttgacctttgccgccaacgaacgcagattcaggcatcgtttcagccataagagccactaaactgaacaataccacttttgttcatatgggaagttactaaagatcacccctgtgtgcgatcacatcagagaagtgaagtcacgtcacgttggattgtggcgcagattgctttatgcaaaagcgtctcactctcacacaaaaagggggtcaaggccgacgcttagctgttcaactcttggcgagggcgaggcttcagatcagatcagatcaaagatcaagatcagaactaccgcgatgaactgctctgcaacaaccgacaaccgcggttaatgtccacaagttgtgtgagcactgttcggcgacgaagcagaaacgaacaacgatccgtgcagagagacgagcgacgacaccaccggcgccgcgtgaattcgcggtagccgagccggggaagccgtgaggcgcgacgaatccgcgggggatgtgatcagccgaccgccaccgatgggccgtgcgaaacggcaaaaaaatgggcgaaacggccgaggccgcgcgggacgggccagcgctcggtggagttcgtggaattcacgggatttcacggggaatttggcccgcgtgcgtgtgggtttacgaggccagccagccagcccaccgtggaaagctactggctggctgggttgatgccttgatgggttacaagtttacaacggttgttgggtttggattctataatcaggaggacgtgtcactccgtgtccagttctactacttttttctctttggaagcgcaaggtgcaaagcatgtgtactctatcgttcatgtcgtgacgctatacaggtcaaacatggagaattggagataagagattatggtgttctgacagtacttttgtagtccatctgctccctgtttgttgatggtgattgttggtaaaggtgatctgggtatacagaaaatgattcagaaaaagaaacacacactaaaagttgctgctatgtttcttttttcccttcagttactaccaacaacagctaaaaacacttgctcaaaaaaaactgaaattgaatttggcatctagatgatatttaaaattaaaatgttcattttgaactatgtggataatctcaaggaaatactgatctaacggtggaacaattaacatttttttttgcaaggaacaatgaacatgattgcctgattgggagggagtaagaaaagataacattgaactttcctcaccaaagacctcgatgagaataccatgtgctcatccattttgcccgttctccgtactgccacatgaagcacgctaaactccatttcaacaacaaaaaagaattaagtaatgtaaacctcaagggatcagtttcggcacaaacaatagaaaagcccaactggcaaagccaaattaacgagaagagagaactatatcacgagaactcttgactattgattgcgcatcacatcgagcagcctaaggaatcctaatcatcatcatctacaagaacacaattcgcctaccatcacgtatactctattgctaacagttcgtgttagaccaaataaaaaaatataatcagaagtaatcaaagacgagtgaagaacaggtcagagtgagaccacaacacttgcgagaaagaagacgactggccatcacgagcagaggatgtggacgtggccatgtgaagagtcaggccgtgtggcctccacgacagtataacccgtgttcatgcacaaatcgcgccgtatcttttactactcgcacataatttctccgcacaaaatgacttatctttttgttgagaaaaatgaaaagtttattctacttgggtagtagtactatgttggctgatctttttttttctccctttttagcggttcatgagagacgcgcacgaattgatgattagttgcttggttggatgaataatttgcagtttacaaagtgtggagaaaggttccagtttgagatgaacacggaatgtgtcggaactggaattggatggattgtttatagggcagcaaccagctaccaagtgattgctaatcaagctactcaattccattcctttcatttcaatgattgagcaataaccatatgccgaataattttgtaaaaatggagcagaaagtgcgagacaaatacacacccaatccatttgttcttcgattctttttccctcaaccacctcacatcaccattattgttacactattccttttccaccacttatcctcccgtttgcaattaaaaagaataaaaagggaaaaacaattgcgagaagagaacagcataataataacatccacaccttcaattcccaatttttttctccatttcttgctaaaacagtagattttttttttaattttgtttgcctctcagaacctaacgatcttggccgcgcgcaccaccgggttgtccctggcgatggcgtccctcgccgccgacttgtagtcgtagctgcagccgtggcggtcggagtaccggtgctcgccgcagaacaggtggccgcaccggcaccggaacccggtgaggccgacacgcttccggcacctggagcaccggttcaccgccgacgtcttggcgaccggcgccggcgccgtcgcgagcgcggaggccatctcctccacaggcggtgggagaggagcctgaggctcaaccagcggcgccgccggcctcggcggctgcttgtcgagcaccggtgacgacaaagaagacggcgacgaggtggacgccgtggccgccaagaagcagttctggcagaggttctgcgtggccgggttgcccgggaatccgcagctgttggcgcacagcgtgatctccggcgccctgagctccgtcggctcctgatccttcttgtcgcgctgcgccatcgtcaataaccaaaaaagaatccccctcttggtctcaggctctctcagcaggctgaggattccgctcgcggtttgggtttgctgtgtgatgaggattgcaggagagatcgaggagaggatttgatcgggaatggcggcgaggcgggggggctttttatggacgcggaggcgcagcgtgtgtgggggtgggggcagcgacctgccccgcctgccgcgcgggcgcgtgttatttccggtattggcctcgttggcgtcgcgcgggaagggggggggggggggggggg

SEQ ID NO: 49533 - DNA, 20787 bp, Oryza sativa
ggggggggttggcgcggcggcaacgcggccctcggtttcacgggtggattccgcagccaaaaaagcggtaaacggcgtgcacggccgttgggtcggtcgcctcgcctctcccacgggcgtagtactacggtagaatcgtcacggcggaacgtgacatgccgccactcatggctcgctgccggccacagttcggcgctgggagtggaggagctggatccagatgggtagccgtggctcactggctcctgtgaccgtgtactggatgagtagtacagtggagctatcgttccgcttatttcatgaataaacgaaatgacatatttacaaacgaaaaataatttataaataaaatttttatatatgtattcttaacgatctaaaaataaaagatgaaagataaattttaataaaaagacttaaaatcagttttaaatttaatattaaaaatttaaattttaagtataagtataaacgaaaaggtgaggccctaagcgtgtggagacgtgtgggtggaacggtctttttccccgtaagatatgttgtgtttttaggacacgggacccgggcaagtagccaagtagcccaccccgcggggaggagatatgctcgcccgaaagaggaggggagggggtggaaaacgggaaagcgaagaaccggggcaaagcggtaaaccaaaccatcggcaagccgcatcgccgtctcgggtcggctaagcaagctctcgttctagctgggaattggaagttggaacccgtcgtcgtcctcggcctctcgacccgtcgcgtggcgtggcgcgggtgcccccgttcaccgcacgttctcgttctgccgatctgcctgacgccgcgatgagaaaaattaaggaaaagatcccccctttctgctgttgctgccgtggagctctcctcgcgtcgctttccgcccgctgagctgtctggattagcatggccattcctttccttccggccggccttccccccccccccccccttttttcttttctccccctccctccatacgtagaccgtgcccatgtcactgtcacacatacgtacgtacacactcaaaagccaaattgcaatccgagaattgagaatactaaatcacggcctctctctctgtatatgatatatgcatcggctgtacgcatgtcgacatggagaaggacgattcgtggaccggttttggtccagctacgtacgcaatacattgccccgtacatacgcgccgcgcagccacgcgctgatggcgttttcatgtgaaatcacggcgtagtttgttgcccgattttacagggaaacttcacggcctcgctgagcttaactcgtcctgaattaacaaagtacaaggcggccaaccacgaggagacacgcgaaccggagcgcacgaagagaatccccggataagcggattccctttgccccagagaggacggaaaagacgccggaacagcacgcgcgacgccacgcgagagacggagcgaaccgaaactttccccacatgagtacattgacaattcggcaaccgatcgattgatcgatcacctcacccgatcgaatcgaattggggtaaaggagagcgaggaaaatatgccggaatgcgcgaaatatctctctgcccttggataggtagcagcaaaagcaggaatggatggatggatgatccgtcgggtactttggatagagcattggagctaacttgcagaggttggaagatgcatggtcgtgatcatatgatcaattgatcattcaggggaagcttaattgcgcacgctgccgacaacgggtcgaccggcagccggccggccggccgcccaatcgatcgaccggcaaccaactcgaccaatgatttgtcctgccgatatatatacacgtaattgttcggctaatcatgagctacgaacgaaccgggctgttgacgaacacatgttatatatacctacatcataattcgatgttaattgagcttaattcggtccctcaaaaataacctaagatgcttaatgcttaatccttcatggtttccattgaattagctgttccctggaaaattgaagtcggcgtggaataatatccatgatataaaggcatcgaaaggctggaccattgctcaaaaggatgaggtcgagtaccgctcaagtgactgacaggacaatgagctagtaccagaaaactagctgcaggtataacttttgaaagccgccttggctggctgtaccaatcctttaccggaagcacgacaaccaggaaaaccacatccaaccgaagatatcaacaggactgtatattactgccgcaacacgtcaccgtccgtcttgcgggcaacagagagcgtcagcgtcggtgtgtccgttccagtttgcggaccgacttgatatttcgattggctttggattgctatcccttgaccctagaatcacctttgccaagtgctcctttttcgctcataaagttccagttcaggatgatgctactagtggctttgcacttcaggagtttactacataattgtttgtggagtttagacgtggcgattgtgggtggatggccggcagctggtgtgatatcctccgtcgaacggcggcggctgtgatcgaacccggcggcgacgctgcgcttcacacgtgtgtgacgctcgccaccgcgtgtctcccggccactgagcacgagcgccagcccagcacgggacagttcagggtcgcacacgcgtcgagccgtcaaccttcgtttactcgctcccggggccgatgtccgcttccggacgacgccggtttgaccgcaccttccggcttccaggagagtcgtcgtgatgcccgcgtgcgcgttttgcagattgggccgcgtaggggacacgctgaaaactgggctgccttttttggtccaacgtgaaaggaaaaagtacatcgaaggtccctcaacttgtcaccgagataaaaaaacgtcctcgaaccataaaaccagatatcgaaggtcccttaacttaccaaaaccggtcacaagtagtcccagggcagtatttcacacggttttatcctacgtggcactggttttgtccaccgtggtgctttaaccttggtcttcgtcgctgagtcaccagcgccacgcgaagctggcgcctggcgggacggagtggggcggcggtgagcagacgcgcgggcggagtgacggcacccgaagccgacggggtggcggagccaagcggaggacgccagcctcgttgtcgtcatcttccgacatagggaggaggcgtgggagctggagccggaggaggggctccgctagaagccgctactgtagaaccaggagcacatgatcttgagctccagctccgacgccgcctcagccgcgtcagttttgccgcgcccccacgctgtcgtcgacgccacctcgtcgtccatcatatcgaacattgatgcggccgcgataatcgccttggcgctccccgacagcgactcttccggggcggccctcctcttgccccctcatgtagccacaccgccccctgcggcggcctcgactcttgcgccgccgcttcatgactcactgcatgacgccagcagggagcctgacggtgacgaggagcaggatcgctgctcccttcctcctcctctctccctcttgtctggggagggcggccagtagcggtcgacttcgtcctcgaactcgccggcggcggcgagctgttctccctgccggcggagaaggatggagaaggcagtggagcggcaccgcccgggctgctgcttcccctgccgccgccgcccgcccgcgcgccgctccgctgcacgccgcctacacgctgctcctcccccgccgcttgcgctcgccggccgtcccccgtgcagctgcttccccgcccccgcgcgcgcccgcaaccacctccgccttcgccactaaagccgccatcgtcgtcgtctacttgtcttcatccaccccaaaatgtcgtcgcacctagacgggcaccgccgagtagccaccccttttccctcaggcgccgaccgccgcgccgcggcgatgcgccggtgttgatgaaaaacacgaggcctgggtcgttaatagccggccatcacccaatcggagccgatgccgccgctggcgccccctccaattggcgccccgtccttctcctcccggcgccactcccttccctccctcctccgcctggcgccacctcgattcctcccctctgcgccgtctcccggccgcgctgccaagccgccgcgcctcgcagcctctctcctcctgcgtgcaaccgcgccgccaccaggctccctctccttgccgccaagctctcccccttccacgctgccggcccctcttccccaccgccgccgcccatcacctgcgtcgctggcgcccttcctctgctgcgcgcgtgtgacgcgtgaggaggaaaaaaaaaggcagagagagagaacggcgaagtgaagaaacagagagaaagagacaaaataaaacaagaaagaacagaaaaaggaagtggaaccccccttgactcctccccgtgaaggaaaaagtacaccaaggaagagatgtgacgtggcagtctgacacgtggggtacatgctgactcagctgccacgtaggataaaaacgggctcaaaaccaccgaatgagttattgtaaccggttttggtaagttaaggaaccttgatatctggttttgcggttcgaggacgttttttatctcggtagcaagttgagggaccttcggtgtacttttccgaacgtgaaatgggtggtatcatgatgggctgttcaatctgtcgatatttatgggctgaattaggcttacaggcttagggcaagccgaatttcgtgggctattatggcagcttttctcgtgcacaaatatggatctttatttggcccaccgcgaccccacggcataacgaaacaggcagagcccctggaaagatttcagcaatacctgttcagacgacgacgtctgctctgttgttcgatttccgtccgcatattcgtcgtgtgatcgtgtccacgcctggagttttctggcacaggccgcgctcttctcacctcagcctcaggactcaggtgatcgtgtcaacgtccggagctctcaggcgatcgtgtctcacttcacaggttgacaggtcggcgcattcgatgccgttccaaacgcagaaaatttagagaaacatctcgggacagagcggcgctcccacgcgtggaatcccgcagatgtaaaacttcgttacaatttacagtgttcgcaacatcaagaaacgacattttttcattcgaaaatgctgcaaatctgcaactggcaatctctagacaaatcctttccctttcgatgccgaagcagaattgaagtttgagaatgttcttcgtctagaccgagcagtcagtgatctgcaagcgcgaggcgttcacagatcgtctcgacgacctccctcccctgggacgcgttctgcctgaacctctccgcgcaccgccgctccaccatctcggccgcccaggccgccacggcagcgagcggcgcgcaccgaatgctcgtctcctgccggaacagcgtccactcgtcgggccgctccgggtgcgggcggtagctgcaggtctcctcgacgtgcaccagcgcccggaggttggcgttgcgggagatcacccgcatggcccgtgcgggcccgtccacggtggtgtgctcgacgcagagcaccacgtcggcggcggcgacgaggccgcggaggaggagcgggagcggcggcgcccgccccgcgatggcgcgcacggcgtcgatgcgccccgatccagcgtcgacgcggcgggacagcgtgtgcacctcgaggatgtgcgacagcggcgccgcccgcgcgtccgcgtccgtgaacttgcgccacgccgccgcggtcacccggtgccacgggtggcggtacacgtgctcctgcgtgtacgagaccaccatgccggccggccggccgccgcttgcctgtgcgcgcgcgcgtcgcgtcgcgccgagatcgagcgaggctagcgagagcgatttcgacagcaactgcagcgaaataatgggaatatgagtgtgtgtggactccggactccggaggaagagaggaatattcgagttccacggggaattaaacccattattttgggctcaatttgcttggactgcaaagctaccagacctgcagcccagcgcatctacagatgggccaaattttgacatacttcttagtgggcctaagaattcatgaattggggccggcctaaggccagcagcccagtgagtcatcacctcgcgacctaatgtctcgatccaacggcgaagatcaaaaccctaacctgcgccatcgtcgactatattaaaagcccactcctccccgcgccgccgcccttctctcgagcaagcacccaaaccctcccctctaccccgccgccgccgccgaggaaggggcaagaggaagccggcgaagatgaagaccatcctggcgtccgagacgatggagatcccggagggggtgacggtgcaggtcgccgcgaaggtggtgacggtggagggcccccgcgggaagctgacccgcaacttcaagcacctcaacctcgacttccagctgctggagggcggccgcaagctgcaggtggacgcgtggttcggcacccgccgcaccatggccgccatccgcaccgccatctcccacgtccagaacctcatcaccggcgtcaccaagggctaccgctacaagatgcgcttcgtctacgctcacttccccatcaacgcctccatcaccaactccaacaccgccatcgagatcaggaacttcttgggcgagaagaaggtaagaaacccacctttggatcacttccatttgcccgctgttcgtggatcatcctagatctcccccacagatctctcaaatctgatgcgtctttctgtatgctttgtgtttcaggtgaggaaggttgacatgctcgagggggtgaccatcttgcggtcggagaaggtgaaggacgagctcgtcctcgacggcaacgacatcgagctcgtctctcgctcagcagccctcatcaaccaggtgaatgatacgatcccgtttcttctccctatagattggagatttcctggtcttctaatactgatatgatgcaatataacctaattagtcctgatctttgcatgtgttatgtactcatgttgccatggttgtaggaattagttctctttgctccaatgatatatctaggtttgtaattgtttaacaagtcatgcctgcctgcttgtttctgttgtttgctgcttaaggttatatgttgaaactgctaaggcggcatgatgttctatgtccttagtttgatcattggcagttgtgaatgtcattatttacagtgctctacttaggttttaataaccatttcaccatctgtctgttatgtcagtactgaagttacgttaacacatttgtgacgaacaaatccatttcttgaacaaccaagatcccttttgtagttgggctaattggcattgctaagttcttggtttggaaaccatgagtggtgtcggtgctcagggtacagtttgttatccactgtctgatccctatttgaatttggcgtctgcacaacaccatgattatacatcaaacctttttgccaatgtgatttatcttctatttttcggttcgtcgagcactcttttttccatgctttcagtgaaacaagatattttatcaattatcgtgtgttttgctcttgttgatttgtttgtgcccttgttgtgttgttgatcaaaattccctttgcttgtaaacagaaatgccacgtgaagaacaaggatatcaggaagttcttggatggtatctacgtgagcgacaagggtaccatcacagaggatgcgtaaactcctatcttcacctagtatcatgaagtgctgtttcttgtctcccgtgtctgatcatcctctgagttgcaattttctgagagactgaattttgtaatggtgggttatttaggatgtaatggagcatggtatcttatcctacatattgtttctgtttgcgattatgaagtctatttatcatcccctaaagacagtttactggaagcattcgtggttagataaacagcataatgctacttaaaagtgtgagctggtatgttttcccctgcgtatgatggattgcaaactggaggagtgtttttcccctgcccttccactgttactggaagcagcggttagtttcgagacattggcttatctggacatagaggattccattgttagcatcatggatgcatgtgtgatttagagctgcaattcatttgattaccacactccgcactactgatctgacactgacgtacagaatcaacattgcgaatgctttttggggacttcctctcacattctcgctgtagagagtgcgtctagtagagggtgaaaccgtcgctgtacttaagagagagtgcgtctagtagagggtgaaaccgtcgtcgtaggagacgtggcgtccgcggcggcagggcggcgcgccctcgtcgcgctcctggcagcagctccacctccccttccagttgtctctcccggtgtttgggcgactccccctgtcgttccacctgtacacgatcaccccgctcttgtcgctccattcgccgtcgatcccctggtgcggcggcgacagcgagaacaaccccttctcccctgcaaacccgtcaaaagatagattcaagtcttatttaacagtaactagctgggtggtccgtgcaattgcgcggctagcacccaaacaaaatcatatatttttttaagtatgattttacttaaaatttattaaatagctatctcattgtcttaagattttgaaagatcaaactttatcatctccgtgtttctaattatataatttttaaaagtcacactagttgctacttcttatgtcatctccttctttatttgcttgtccgatctaccacaatttctattcattctccttggaacctttaaaaattggatcttatatttttttagagtttattgtcattttgggtttcgtttttataatttctagatgtcccgtcaaacgttgccattatactcctctacggcccgtccactgtcttctctttattgccattgagattttaaaaatcgaacataattatcgtttgggttcatttttactttctagaagtcccgccaaaccatcagcggctttgctattttactcctctaccactcggccgctgcctccctttttttttgtcattgagattttaaaatcaaacatgattatcattggtttttttttactttttaagaagttccgaacctttaaaaattggaccttatagtttttagagtttattatctggttgggtttcattttttataatttttagaagtcccatcaaacgatgtcactatgctcctctacggcccgtccgccgcctactatttattgtcattgtgattctaaaattcgaacataactatcgttggaattcattttttattttctagaagtcttgtcaaccgtcggtggctctacaactatactcctatacaccccgcccgctgcttctcctttttattgtcattgagattttaaaaatcgaatattattatcaatggggtttattttttttactttctagaagtcccggcaatcgccttgctcgtttgcttcacggcctacatgtcgtccctccttttaatcatcattaggattatatttggtgttttattaacagtttttatatgtcgtatcaatcgtcaccactctactcttttataggtctgttacttaatttatcttgtcatgtgttttagatggttttttctttcaatagtctttattttatcccaaattttagttatttataaactgtattcataattgaaatcttatttttctttttctaatttgagaatttattttttccaaattttaattaataccatattgtgttattttaatattcttattttttattttcaattttagttgtttcaaaattgtattccgaactctctgttagtttttctaattttggatattattttattttttattctgaattttaattaatgtcgtattgggttcttatatcatccttctttcaatattgcttatttttaattccgaatttcagctaattttaaattgtatttctacttgaactctttttttttctaatttcagattttatttttattttaattccgaattttaattaatctcgttttgagttcttatatgaactcttcttttaatattccttatttttaattccgtattttagctatttttaaattgcattcctacttggattatccttttcttttctaatttttgtttttattttgaattttgactaatctcgtattgggttcttatatggaaacttctttcaatattgcttatttttaattccgaatttcagctatttctaaattgtatttctacttggactcttcttttcttttctaattttagattttattttatttttattttgattttttattaatctcatattgggttcttatttggaaacttctttcaatattgcttatttttaattccgaatttcagatatttttaaattgtatttctacttggactctacttttcgttttcttcttttttctccgattaatgtggaaatttctaacccccacggcaaacgtggtgcctcctttcaaaactgttttaataatataatagatacttatatttacagctaattattatttcagtgctatataatgtatatttatataaggtcatttcgttaatttcaaaatacgtcgatctaatcatttgaagatgcttataagtgttaaaatgttgtgggcgtctatccaaaatgtcgacacacttcacactacactagcccaagatagccacgaaccggagaaagaagaagatatttatcgcgaggttggctacctgtgacgtggccgtggaaggcgcagtcggtgggggagttgtcctcgtcgagatacaggctcccgcaccgcaggcatcgcttcctatccttctcctcgctccgactgccctgctccaccgcagccgctgctgccgcggccgcgccgtcgcctggagacgcgccgatccgcgccgtcgcaggccgacacggcggtgccgcggcgttccggtggcgagacggcccgcgcggcggcagtaccggcaccgtgcgggttggtgcgagagctgggctcgccgccatggcgtgatgaggcgacgggattggcatcttgtgctaatggagctcgcactccacacgcacacacagacattcccgctgagaattgctgcctcttttcaggttgtggcttgggggtaatgggccaaatacaaacggcccaaactacactggacgacgtagtagtgatgcaggggaagagatctggcccaaattgaaactagcgatgtgagtagtgccgtacccgtactgccatgtctctctccacgccaaggacggcaggacgccaggaccaggagagtacaagcaacttccttgtgatttttgaaccaaccctaataatctccacgttttttctagtagtacagtacataggtagtacttacagtcagtcgttgacgtgctaataacggtggctgtcacgcagtgtcatcatggtcctcatcacgcagtggaggtggtccaaacatgtatcataagcatcattcagaaaactctgaagaaactgcgattagttacagctcgccgacgacgacgggcgagcttccgtcggtccgaccggccgcggtcgcagagcagagcagggagggaagctgctgacttcgccgcgctgcgtcgcgttcggttcttgccagccttcccaagtgggttcctgtcagctttttcctcgcggcctctgagcctctctctcggtcatcatccttcagctcctgcggctttgctgactggagttgctccaactgtttgtttacagttttgactcttggtctccacatttacatcggcggctagaacacgcacatttcactctctcaaagaacttttcaccctatcacattaaatgtttatacacatacatggagtattaaatatagataaaaaactactccctctggtcctatattaattgacgttttggacaaggttgaggttaaacttttataactttaaccatcaataactttaaaaatatttagtttagaaaaacatatatagatttgtctttcaaaacactataataaaagtaaacatgtatttatttattgtatatattataatagaaaaataaggtcaaaggtatattttgtagagcgtgtaattgtccaaagcgtcaattaaaatgaaactggagtgagtaattacacagattacgtgtaaatgcgagacgaatcttttaagcctaattgctccatgatttaacaatgtggtgctacagtaaacatttgctaatgacggtttaagtaggtttaataaattcgtctcgcagtttataggcagaatctgtaatttgtttggtattagtctacgtttaatacttcaaatgtgtgtccgtatatccgatgtgacacaccaaaacatttcgtctcgcgaactaaggccctatttacttccaggggtgaaaagttttggcgtgccatagtgattaaagaaccaaactctgaactcgtagcacctgacatctttgtggcctcaaaatagaagaacagaactgtggcgaatgcactataccaaaacatttgggtcagggatctgaacacactaggctgcgtttgataggatgggttgggaatccatcccctccgcacgaaaaacggagcagtccattagtgcgtgattaattaagtattagctaattttttttaaaaaaatggattaatttgatttttttaaagcaactttcgtaatttttttttgtaaaaacacaccgtttaacagtttgaaaaccgtgcgcgcgaaagaaagtgagagaggttgggaaccttgaggttcgaaagcagcctaaagataaccacggaggaccatctgtgacaattcatcaatctttggacgaaaattcagaatatagaccctcatcgtttgggtgctattatgcgagcagaacactagaatctttcgacacatcgccatccccaacctccgtgattgcaaaatcaaataggaggctggggcttgggtcaaagtaggagcgtccaagttctaagagtttctatttggggggagattacgtactttgacctttttaagtcgggcgaggactttcacacgtcgatgtacatactttaattttgtttactccctcactatggggtgtttggaagagaggggctaaactttagcccctctctcaaaaatataagtctctaggagatggacttatatttttgagagagttagatttatttgttcaaagaaaagacgcctaaaaatcattcagggctcttggtatcctttaccacattcactttccatattccctttctttagttcagacgctatcatacctcagggaaaaaaattttctatcaacgattcccacccaactctaaaatgactctcccctctctcccttaacatatcgaaggcctcttatacgtcaactagaccttaatagctcagacttccgagccttgctggatgatgcagaagggccaacataagaggatcaaatagagcgacagtccagattcagggttacttgtccacaccaactaatcaggtatcggaaaatagggcatatttgtttcagccgggagaccccctgggggtctagttttaaggcgattaggcctattgagatgcacatactaccttctttcatcttatcaccccgcctagcgactttgcaagcattacaggctaggcaccgccgaaggtagtccagtccgcttgttagattgaattgaatcttatataacctacgtagctaaagagaaaatcataatagtctaagtggacctctcaaaggtataaataagtatacattagtcttactggttcgatctttttctttttttgttatgatgcccacatttcatacttctcaattcttatttattcaagggttcgtatgtactgagtttagggtttagcccctctcttccaaacaccccctatatatacaagatgtagcttttgccttcttaaaaaaatttagatcaggaagaaggtgaaagagaggagaaaactaatgaagtgacatgtcggactcgccctcaccttttattttctcaaaagatcctcttttttaatgattggagtcatataggccaaattaggccggttcgagcaagggatataacttaaacagtttgaaaagttaaagaggcacaatatatgatttgcatatttaagattgatgttagtgttccatggaattttagggtgccgttttacacatgcagttgattttgcttattttgttcctacaaaaatattttctacctgtgaattttgcatagcgtagctggttagatttcatttcgtgaaacatataaactatggttgaaatcttagatttagcatgggtacccgcatttatggctaatttttccaggtgtaggtgatgtatatgtcaacagcaaggtgctcgtgatgatttcatcaatcgcaaggtacatatcgattgtggagtgcttgtagtgtcttcgtaagccttaaggtatatgtcgacagcgaaacgttggtggtgacttcatcaatcccaagatatattggttgctcatagagaaaagatgtgtatgtattcacaaggtcaactgtgtgcgcgtgtttataagcatttgtgtatgtaatgtgtttcaaaaatatatattcccttattcccaaaacaagcacaactatgagtttctgtgtcccaactttaattgttcgtcttatttattttttttaaaaaaaactaaaaaatataagtcacgcataaagtaatattcgtgttttataatctaataactataaaaatactaaacatgaaaaaatttcaaacaagatggacgattaaggttggacaccgaaatttatggttgcgcttattttgcaatagatcgagtataaaatagccagctctacgttttttctttaaaaaaaaagaaagatgttttttgtgttgaaggaaaattactgggcgcgggagggccggcctggtcagccagccaggccagcggtagcggtaggttgtactttggggcaccggcatatccaacttttcaggacaaagactgaagctgctgctggtgttgattagactttgcatagcagggcaataatttccatatctcccaaagttcctccccacgaattattcaggcagctaccgatacacattttggcagggcgcgaaaaagacaccaatgtacttcagtacttgcagccaacgcagtactccgtctgtggccagtggccagcgcgcgtgtgtgtgcatgcgcaacgcaagagagcgtcgcattgattgtgtgtttctgcgtggcagatggtactacaaggggtacgtggagtccgggtcacgttgctggcctgcccggtccggccggtctcccccacctgcaaaattctcacacacgcgtgcccgttgaggtgacccgtcctccagcagctaccgcgcgccgcgccgatcgactgctccccctctcgtctcgtcctgctttcgcacgccggatcaaacgcaagctagcttcccatggtattcggtgttgttttgcccgaaaagcaatctatttacacctgcaaactgcatatatgaaacgcatgagtttgtggtaacgagggccgggtaagattgacaaaaaaaaaaaaaaaggggaggatatgcatgcagtgcccgtgaagtgcacgttacaccaaccctccatctatcgatccgtcgtctagatgaagctaaggccctgttttgggttgaaagttttgagaagtactacctccgtttcaaaataagtgtagccgtggatatccgtacccaacgtttgaccgtctgtcttatttgaaaaaaatatgaaaaaattaaaaatatttagttacacataaagtattatttatgttttatcatctaatagcaataaaaatacgaatcataaaaatttttcaaataagacgaatggtcaaacgttgaacgtgaataatgtaaaactacacttattttaagacggagggagtaagtcaaaatcaattggcaaggggccgacgattatgagaattaagaaagttggttttttagcaccgggcctagcaaaagagaaatcgccatatactagccattatttagatatgggtggagcccaagaatatcggagagggtctaacaccctactattcagtttataattacctaattagttagatggtcctattataaaaaaagaaattatttgagggagctttgactccatccattccccccttgtctccgccatcgcttggtgagtcatcagctagtgggagtatgtcaaaactagatttcccaacttcttgctgctagctgggttcattctgaatcctatagctattgattcacatagtctagatgagtatatggaccacttccctcggttccaaaatgtaaaaatttttaggtttaaacaaatgagcaattttattgtacttgagagataccatggggtaccaaagatttagtgtaaaatttggtatatcatagtacttaggtatcacgaggtatcaaatttacaattgaaaaggcagtacctcatggtatcttctcaagtaccgtaaaattgttcttacacaaatactaaggttaggtcaaaagattccatgtaaataacttcagttgtcaattttgaattgcttagtttttatttcaagcatttcattgtcttaggaatcatcaatagaatgatatgaatcttgggaataagtgcatgaatccttataatattatgatgtaaaatttgaatcatagaaatacttactctctccatcccaaaataaatcaacttttatacgagaatatacatagactatatccagattaatgtataaaattttatattttatagggcagagggtttatattttaaattggatggagcatttagaagaggtggtgattctataagaagctgtaaccattggaagctagaattaagggcatggtcgtttcaacaactcaggtgagatttttcatggcatgaaaaagaaaatcattaacgagtaattaattgactattaattatataaacttagaaattgattgatctttttaagaaacttttacatataaagttttattttacgaaatgtaccttaaaatagtttgataagtatatccacaaagaattaacgagggagttgcttgcccgagttgcagaaacgaacggaaccccaggcagcacaactcgtaagataggcaatcgcatacagtgtgtcgtcccggcctgctctggcagaagagcaacttcctccatgcctgactagcggcaataataatattccaggtccccccattgattccctctcatgtatctttccctttcaatccaagagatgcatgagaaaagctcatcatttgacatgaacatctcatggtatttgtgtgtgcagcagcagcagcaggtagcaagcatgtacatctgatgttccatccatccatcaaccttgcctagacatacttttgtcggccattccgtggtgagccttcaagtgcgcccaaaaagttgatctccatctacacacatatcctctcctcgtgaaaagaagatccccaagctatttgttctctctcacttacacacagtgacacacacatactactcatctctgtgctttgtttccctctctctctctctcttgtttcttttacagtacatgcaatgcacaggtaggtcacagctccatccaattgtaggataggagtatataaatgtttgggcaaggaaacatctttgtttttggaagtatctccagctacaataccccattgctcccttttttcccttttctagggcaaacaaacaactggacatgtctctcacagcctttctgcaggggaggttcggatgcttgcacaggaaagaacacatagcaacagtagaagcttgaccgatacagggttgggaggttattgttttccagatgtagacgaagagatggtgataaaattggccccatcccaaacgcatagcgttagctctagcaaaacctggcgttgtttgaaccgacaggttcagttgaaattaaaaaagagagctatatggcaaaattatccactcctagcttgaatttgctgccacgagttaattaatactagtactagctggtatctaaaatctcaaaaatcttgggggaggatccatttattaattcttttttttcctagaaacccctttaggactcatttgcaatgtaaacattttctagggttttgataggatgctagctcaatttcctctagctagtacaaatccattagtattccttcattttcaaaagaaggccatgagtttttaattaatgggcgaagataacaaaattccaaatcttacaacacaatgctaaaattgaaaaaaaaaacaattccatagagaggacctagcaagaaaaactaaccccactcattaccatgcgcaacttttttccctccactcacccgaatcctcattttcccttctctcccttcgtttgccctgtctccccttgtgatacttcacaattgttgcctgcaagtaattaacatcctccctcatgacgcaccatatctcctaggcaaaatttgccacaggacatgcaaaaaaaacgtgtaattggctaagagacaccgtgaaaacatgacacggctgatggacagtaaaaaaacatgtaattggctgtaggacaccggtcacattttttttattatttccaggtcaaaagaggtgagatatttttctaaatgcctgactgccccttctctttccttctttaaacaccggtgggtcccatgtgtcatggacagtgtatgtttaatctaatttttaataggtttttaaccatcaggccccacgcgtcatggactaatttgttcctaattagtagggtgattactatttactaaccataaggggggcccacatctctgtccgatcgtccttcttcctcacgcacgcggcggagcagaggaacagcagcctgagctgggacggctcggtacgcggcggaaaaagcggcggcgctccgccggggtatcactgccggcgacggcgaggaccaacgccgggatctcctcattcagcgaggaccaacgccatggcgacgagcagcgccgggatctcctcgttcagtgaggaccaacatcgacggtgacgaccaacggccagcctcacctccatcctcatggtgcagtagctgtccacggacatccagggtctggacggcctcatcgccagctctgaccccatcggcttccaggtcggctccttcgccaagagctacctcatgcaggagctgggcgtgcctgagtcccgcctccgggagctcgccatcaccgactactcctccagcctgcagagcggcgtcgtggcggccatcgtcgacgagctgccatacgtggagctcttcctctccatcaactgccagttcaggacagtggggcaggagttcacaaagagcggatggggattcgtgagttcttttccttgttggcttcttttcttcttctttttatcctacactacaaccaagtactacatatgcaggctttccagcgcgactcccctctggccgtggacctttcgacggctgccgaggaggaggaggctagagagcgaggtaggtgcggaggcaatccgatccgatgaattggcggcggcggtgctccatggcagggacaatctcgccatttgaaaaatattatcacctcttttgatctggaaaatataaaatattgtctccggtgtcctatagccaattacacaatttttagagtgtcaatcagccgtgtcacgtttttacggtgcctcttagccaattacacgttttttacatgtcctgtagaaaattttgcctatctcctatttgaccgatgtcatccgccactcctcgactgctcttatgacgtttgctttggtaccttttcatctactctagtttgatatctatgacggtttgtgcgctttcgacctgtgttaccgctcattagtttccatctcaagcacatcatcaagggccactttccatgcatgtccaggtgatggtacattcttggtggttgcttttgtccagacataaaatgccaatgagaacactgttttggcaaacacatggaacccacataaacacacatgccacatgtatacacattagctagtgacatgagccatgtccccttaaggccttaactaacaccctcaaggtctcaacagacaatgtccatgaacaaatccactaatctcataaaatttctcaattgtactatatcacatatttataaacgtgagcacccaggacctgcccgtatataccaaatacgtgttttgcttatggtagtatatggaaacaacatgcaaatgaaaaacagtatgtacaagcttgagccaaactctgtacaaacatttcgtctgaatgtgtatagtatatatgatggacaaacaagaataaaaacgccattattttcaatttgcgttagtcaatttgcgtcagtcaattttccatgtgtatagtaagcaaattgactgacgcacacatcgcgtccttgtaacgcagcatctcatattctagatgaacgaaagtacataccactgtacgaggtgatcgaaacaaatcgatcgagaatatcagacccgctggcaaatacgtacacacattgcattcacaggcaatatatgcagcttacagaccactccacgctacagcacccaat

SEQ ID NO: 49534 - DNA, 1684 bp, Oryza sativa
gcacctcagaccagtccagacctgatctactagccaacaagctagctatcgcaatgatagctaatggcacaccagcacatttcttcaaaatcttgtcacatgcctcagttgatgaactgtcaagagatttgccttcactaccagttcttgtatacaataattctttagagttatcatgagaaagtggtttcatattgtacacatcgctgataattgttgcacctcagatttacgagtagttacaagtattttacttccgtaatcattatcttgtaaaccactttcgagtatttgccatgatggcttatcccatatgtcatctataacgataaaaaacctagaatagtagaagaactgtataagcaccccaatcactgaaaattacgagtcatcaataagatgtggttttctttttatatgtgaaggagcaataatttttagtgccgaagaaaatctagataagagagataaacatgcattaaaagtgagatattgcaattaattattcattagcctatgcattggcatgtgcttttggataatgtgtgggcacgacggtcttgtagctaggaaccagtggtgcactagaatagtgacagggataacgctgacaagtgggtagtgtgctcctccgtcatgagttcaaatgtgacatgctcatgtgacggcggtggccaacacatcttttggcgttttctggaattttccgaaaatggtttttggaatttccaaaatgataaattttgtgaaaaagctctctggtgatttcaaattttttcgaaatattttcagaatttccgaaatgttatttttccttttttttttgctaagtttgtgctgtaatttatactttttggaatttccgaaagtattgtagcaacttccgaaaataattccgaaatttttttggaaattcggaaaatggttgctcaaatgaaagtattgtatcaacttccgaaaataattccgaaatttttttggaaattcggaaaatggttgctcaaatgaaattgctttcttgtgtttttcagacttgtccgaaaatggttttcaaaatttttcaaaaaattgaatcttgatttgcctccaacgatcagatttgaggttgtggttataaataaccccctccaccccaagtcaagattgctcgctccattgctttcttgtgccccttgcttgtgttgatttgagattcactttgagccttgccctctcacttcttactttccactagggatggcagtcgggcacgacgggcacgggtagtgactacccatcccgtgtccgcgaggtaattcatgtccgcgggcatgcccgttactacatgatgggcaaggagcacttccaatgcccgtcccccgtaggcgccatgtgcccgcaggcatgcccgtttacccgtcacatctgggaaccagaggtgggaggcgcgtctggaggaagcggcggcgaccggaggtgggaggcgcgactggaggaaggtgtggcgggctggcggccgatggctggaggacatcgacgactggttggagaggagctcggcgcagacggggtagaaggcgacggcggtcgcagcttccttggttgccccccctcccccgtggccgctatgaaagtcgtcggctggagggtggggccgccagcgactagcggaggtgggaggtggtggcgaattgcgcgcccctct

SEQ ID NO: 49535 - DNA, 23435 bp, Oryza sativa
gcctagttccgcttcgggacccaggtccactgaagtacatcttaagaatgtaacgtgtgcctcagactcggtgagaggagcgtagagacctacaagatctacatcttaaaggaaataaactaaggtatgcctcagactcggccttatcctgggtctcgggctcaccttagtccgcacaagtcacacattgctctgagaagaggagtgtggagacgtataaaatctacatcttaagaatgtagcctaaggtatgcctcggaccctgtcttgtcctgggtcccgggctcaccttagtccttgtaagtcctacgtagacgagcgtagagacctacaagatatacatcttaagaagaataagctaaggtttgcctcagacatggccttgacctgggtcctgggcttaccttaatcttcataggtcacactttctacaaggggtggagggtggagacatatgattaagagataaactgaggtatgcctatgtccggcctcgtcctaggacccgggcacaccttactccttgtgagttttacattcctctacaacgaagagtgtcgaaacattatatatatatgtatgtatacatatatgtatgtatgtatacatatatatatatatatatatatatatatatatatatatatatatatatatatgtatgtatgtatgtatgtatatatatgtatgtatgtatgtatgtatgtaaatatcattgtgagctcctcaacggagagtagattcagtaacatatcagtttgcaagaatcccggtggtatctctctctctcactcctccagttttgctatttggtgcagctagtagtttagttgttgtttgtgaaaacccattaactacttttgccgatatccccttttgcttgccttgttagcttgctcacctttgtctgcatgtaggttacgtcccttgattaaggaggaatgtctctgtcgaaacattagatattatctaagatatcttcaagaagcttgtgtaagaatagctaaactatctccataaatgtgcaagggcgcgacctcaggaccagctggggtgttgggcgtgctccacgggctgttgtgaagtagtcctctccgccataaattaaacaggtttatgggggagccccagctagtctggagctgaaaggatgtggacaaggcaccatcactgagtcattagaaccagtggcatcttggacacgtgtcgcacatgccccatgccgcctgatttagccaaacgggtagaaacgaaaccgtggtgctgtttcaggcaggtcgggtctcaccaggcccaccactcgccacatggtgaacatgctggcacgacccagctgtctcggacagaagcccgggtgcttgggggcaatgcaagcttcaaatgtcagtgggttactcgaagactgtgtgagggaaccaacaggcattgacaagacagctgatagacaagacaaggaagtagatttgtagcattgtgagcccatccttgatctataaaaggaaggggacaagctacggatgaagagttggattttttggatcagaacttcttgtctgtagcccaaaaaggcatcccttgttctaagctgatataagaaaaacaacaaaaccaacacgggagtagggtgttacacctccgggtggcttgaacctgtataaactctggtgacttttgcttggcggggagatcaggccccacaaatcttttctctgtttggctttttctatcgtcttgcactgctaaccccctggctgaatcttcaaactcggggaggggtctccactcctcgctgtccgaggagtcgctccatggacacccctctaggtgacatcaaggtcattttaggtttaatatcttgatcacgatttttagcttgctcatgatgtaagtggagcctaaagaacgggtaaacccggactattactgtgatcgattaaaaagaggtacatcatttttttttcaaatagcatgcgcaaaggcaaattaaatagctttaagactatgattgtgtgtagcgcaaatattcattcataagcgggtaaggtagcataggttatggacatatactccctctgtattctaacagaagatgttgacttttgatatgacgtttaaccattagtcatattcaaacaaattatataaatgctatttattttgttgtgacttgttttattattaaagaaactttaaggtatgacttatacttgagcatatttacactaaaattttgaaggtcaaacgttatttcaaaagtcaatggtgtgatttattaagaaaaagaggtagtatataaaaacaaatttggtgggtcgtcatattcatacctctttcccttgatgaattgcttgagttcaccgatgagctcctgtacagtcaacatctccatatttggacaattcaggtacttctccaggccaaatcgatgaagaatgttccacaagattgccttcatattaggattttgaccgattggaacaaaagcattcaaaggaaaacccactttaatcttctcatatactgctgtggcaagggtggttttgcccagaccacccattccaacgacgtatactatctttgtcttcctattggacgtattaagattgttatcacgctcatgttgggacaacatcttaataagctcatcccttggctcatcaatgccaacaagattgtttgccattttctcaatatttaggatgtgaggatcaataggcgtcggacgtgcagggataactatgttatcaactgggtatctgtaatagatgagagtcaagagacaacatcaagagatgacgaatgtaagactacaagaaatagaattcttgagataaatcagctgtaactcgtactatagtcaaagttctcatcattctatgtatgtacctcatgacagatcaatataatgcaatataatacaacatattattaagatttcttccatattactcccttcgtcctaaaataactcaatttttgggtttctgtgttcatcgtttgaccatccgtcttatttgaaaaaattataaaaaaaataaaaagataaatcacgcacgcataaagtattatttatgttttatcatctaacaacaataaaaatgctaatcatagaaaaatttcatataagacggacaatcaaatgttggacacggaaacctagaaattgaattttctttgggacggagagagtaaatattttccatacctgccatgccttgcatcaatctccaggagcttcttttccatttcttggattgcgtccgcgatggtgacgcgatgcttggtcttcttgaacagtttcttcacctgcttgccgaggcgcctgagcacatgtgggtcggctggcttggggccatcgtcgtcgacatgaaccaagaaggcgtcgatgatatcctccatgtcgtaggacgcctccctgaggtcgctcgcccagagcttcaccagctcgttctgctggtcttgtggcacctcgctgaccatgcggaggacggcttgcgctcgccggagctccgccgagagagactcgatcttcccccttatgttcttctgcagattgtacttctccttcagcagctcgcccagcttggggatcaggctactcatcgccccagtgacgaactccatgcttgctagctagctgtggttgacttgacttgagttgagtggatggtattgctgggttggtagctgggtaggagcagaaacaatgcactcctgtatatatatgtgcaactactagcctactagctgacaggttaattaatggacttgtcacaattgggttagagcaagtttaatactccctccttcccaaattaatcatcatactccatatgttccacaaccactttttcaagaaacaattattattattttctaatttggatcatcctaataaatataatacatgtatgcatccaataaatttagagatcttgagagtgaaggatttaaaaaagtaataatttaatggagaagatgtcctagttaattgtatgcatacatgtatgccttatattatggaacataaaaaaaatagttgtgccttatattatggaacggagggagtataattttatgcaccaagaccaatgacaatttaaatcacatcaatcaagacaccatacacacattctcccatactcgattaaaacctcctgccaattacaccctagcatacacatattctcccatactgtattaattgtattccgatgaaatccgtgtccatgcagttatataatgaccaatttgaaaaattttaaattctattagagcaagtttactagtatagcccactactagctccaattcatctatagccgatctaatagccaattcatacaatagttgcttattatactattaatatatggtctcacatgtcatacatccattgcgtcttggagtccgtgttatagctggctacagatctatagcctgctgctcttctctctcatcttttatctcattaaaatatgtttatagctggctaataatttgctgttgtacctattcttacatgattaatttgggaagaagggagtagtatattcaactgttggctccaaatcttctaaagtcaattcatacaatagttatctataaaaatgtactatataattaatgtctgatctcacctgtcatacacacatgtattttggagtctgtgctgcagctggctataaatttataatccgttgctcttatctctcctcttttatcttcttaaaatatgtttatagctggtttataatcttatagctactcttatcggagctcacgccatccattctcgaaaaaacattaaaacgtgtaaatgtttgaattgacaaaatgtgaaataatatttactccatctcactccaaatgcaacgagttctagacctatgcaactagaatgaataaattaagttgcttaaatatcttcatttgtaattgtaaacccatcattataattgatgagccatttatctgagtatagtaccattttgcatacaaaatcctgcctcaggattgaagtgttatatccgatttgtttgtttccattggagcatgaacataacaagagggcgaaaacgcgtgtaattaagtttcaaaacgcgtggtaggcaatactgtgtttatcactcaagttactcaacttgtaagacgccgttggctccacctcgaacgcgtcacatgagaccctctgggtgtgttcgctacagccggatgggaagatgttcgctacagtcggatgggaaggtgcatagtacgtacgaaaaacgaaacggtccaataggacgtaattaattaagcatttgctatttttttaaaaaaataattaatttaattttttaattttttaagcaactttagtatataaatttttttttaaaaaaaatacaccgtttaacaatttgaaaagtgtgcttgtgaaaaacgagagagagggcttaggaaaaggggcatccgaagacagccacacgttgattaagggggtgtttggtaagtccctcgctcctaaccaccccctaattgaagccacgttgggaagctatttttcttctcagcagccagcacgctcaccttccggaaccggttggtgcggcgaactgtgaaaccgaccgtggtccaggtgcattaaagtggacaatggtaagctcttaaaaatcagcatgtgcatcgtcaagtctgttgaaattccacaatacatcttttacaatttaaacgagccgtatcctaaaattgctttgtaggagatctctggattttgaggactagagcggtcattttaaagtgtaccagagcttcttgcaggatttgttctatctccgtttgacgacaatattcgtgacttgtgcaaatttcaagctacctgtgcacgacaaatgtatcagtgttgtaacaatatagcgttcgattccaactgttaccttatgtggttgttaggattgttgtatttgttaaccatggtttagctatgtttgaatagaaaaaattttagttgttattcggctaagatagggttagtgaagatattgttagagtttgtatcgaatatatgtacaaagtcggttacaatttagaacttggacttacagtttagtggctgcactagaggacgtacggatgcgtggaggctgaggaggtcacgataggtggctgtgtgcacgtttgcgtgtcgaagctaaagaccacaaatgactctgttttgggctggagttacgcagcagatcgactcgggccagcggatagactcggatcacgaatcctacttggctacgcatggaagaagctgttgaatagtcccacattggttatgaaagagtaagagacctaacatataagtgggagagcccctcacctcaatggctagcttttggggtgggaaaaaccctttatgattctacaattggtaccagagcctaactagttcaatatctctgacccgaggaacatagtgtgtgaaggcctgatggaccgtaggtgcttacggggcacgtttacctgagggaccgtgtggggaaacggtgaaggggcggtgaaggattgagggacaccaatatgtgaagggggagattgttgaatagtcccatattagttgtggaagggcaagagacctaacatataagtgggggagccactcacctcaatggctatcttttagggtgggaaaggccatttacgatcctacacaagccaagccggtgatctactcgtacacggaaggggaacggagagtttttacgatttgggcagaggtgatttgctagtgtcgagctccggcggtgtaataggtattaggacttggagttgtaataggtattaggactagagtatgagtcagactctatcctaggatctctcttaaatagaggggtgtgcctgttataaccgcatagcgatatagcatagtgagagggagcggctgttggtggcgactggctgtgattcgttctaactctaatatgttgtatatgttggatcggagaagagcgcccgtaatcagtgtcccggagatgttggttacggctgaactctgtaacgccccgacatttgttagccataaatgcagctaactaacaccggggtgttatgcattacatgtgatatagtaccagtcccaggatacactagctgatacacacagaataaatgtgtaatcaaagtaactattttattacatcactgggtagtagtccttacataagttaccatcatggacaggcccatagatgaacaacacaacattacagaaaaaccataaaaggcgacgtcgcagaagcgaacagcgcggagaactaagcgactaagcaactacgcactaggcaaagaacctaggcaactaacttattccacgggcgaggcttggggctaggcacgaaacatctagaagtcttcatactcagcttgctcctggagatactcctcggcggttgggtcgacgtcttcgtcttcaaactctatagattattataaggggcaagggtgagtacttaacgtactcagcaagtcaggggaaagaatgacatgttgatttaaacaaggaagctagtgttttatttgcgaaagctgcctttttggcaaagtgatttatttcacaaaactcctagtgagtgagtcaaattttagttgtcgggaggaggctcacgcctcgacccattccacaagttgctttgcaacagcttgtcatgattaacgaacaacaattaatttgtctcctctattagcttcttctcacaacaacacatagtccacacagttatcttagcacaacaacgccatcatggtcctagcaacacatcggtgtcggacgacaccccaggtcacacagacccgttcctaaccacaaaggttagtcgtctgccacacaggcgaactctagaaacgttactcttctgaacaatcacttttccacaaacatttgcaaacaaaactacgctatgagaaacaccttacacttgcccatgactgtgggcacgactgttcgaacagttcattaatctctgcagaggttgcacgctttacccacacgacacgaaacttacaccgtttacccgtcggtaacggaagttcgtgataagacctttccaaagctaacccatgaaaatcgcatgccacctagttgggctaagatccatagccgaatatcgggcaaagacagccgtcatccactcaagaaataccgaggatgtctcctactgatatcacacgccacaatagaggcaaaaagacacccatgatgggcaaaaatgtgtaaaacttcgtctgctcatcctcggcattccacaaccattggcataccaactcccatgtgataacaatttacttagcaagaggcaacccataaatatccatgtggtctcactgtaatgtgtttggatggatttcccaaaggaatcggtccttaacgacaatacgtagccaaaccacaaaggcatgactccgcatcatcaccactttcacaacacattttatttcacaaactcctcggtacaacgtacttgatttttaaacatgtaatttggaataacccaagtttcccacacggcaacaacgtaagcatggctaagtgaaactacctcggtaatcgtataacaataccggcgcaaatatttgtggagctatcaaaggtatggaaacatcaacctatgaaatataagtgcgactactaggttggtccgtcggttgtataaacaatccgaggcctaaacatgttaatcgtgtatactaagtaatgcacttttcaaacaacatatctttacaaatataggggcaatttgatcaaagaggcttgccttgcacaggatgcgggtcttctccctcgaaagcggcgtccggagcttcctcgaactcgggctctaaacgcgaaaagcgaaactaattaacaaaaggcaataaaacaagctcaaaccagagaaacaatagtgccactgtgtagatctcatttttagaaaaatttaggaacttgaacgggtcaatcggagttacagttgattttctacagattttcaaagaataaaggattttctagaatatttggaaattgacttattaacggaaaggaatattccgttggaatattccgctaacttggacggcaagggtggggcccacctgtcagcgacttgatggagggagagaggcgcgggcccgggctgtcagtgttgagatggaggaaaaaggacgtggggccggcttgtcagtggctggagggggaagtcttcttcctcctctcgctgcttgctcggctcggcctgggacggcgacgctccgcgggaccgcggtggctcagcgtctggcggccgaggggagcggcggcggcacttgaaggcgaggcgcggtaactccaggcggcggcacagagagaagaacgagagggagtgagagaggagagagatggtgatggtgtggaggacaacgggagagttcgagctccttttataggcgggcgacgcggtgtcgagctggcggtctagacgcggagctttggggtagctggctagcgactagggcgggattccggggtggagaggatggcgacgcgacggagttgcgtcacgcaccggtggccactcgatggcgaaacgacggcgacgcgacacgaagtgacgcgtggagagcgggattggcggcgagacgtgggtgacgcgcagccgacggcggctacggccgggatttggggcggtagggctggagagggatgatgcgagcgacgctggcgacgcgacgcgagagagagggagggatgctgctcggcggtttcatggaaggaggcgagcgacaagatgaagcgagagagaggtgaggcttagcggctaagctccttcctctcgaagcaagcgaacggataagcaaaggcgatcggataaggggatgactcggcctagggttaggggtgacgaagggtgaggtggcggccgttatccgttggtgtcgatgcgacgggcgatgggatggtgacgggacaatggatgacgcgaggccgtgtctcccggagagaaaccggagcgtgggagtgggttttgcggcttggcgcgacccgggcttgacgcggcacagcctcggcttggtgcggggtggcgcgacgtggccctggcacgatgcggggcgcacgggagggtggcttggtgcaatgcggctcagacacgaggcgaaagtggtgcgacgctgggtgagacatttcgtcgtaacatcttgcgtgcgtgagctggctggcctgaggaggaacatgatgaatagtggctgggctgggttgggctggcctggtcggggaggtgaagagaggagggagtggaggggagttgggctggggagagagaagggaaggaggcccaaaatgaacagtgaactttcacctttttccagagatttgtagagttgaattttgaagatatttttggagggatttgaatttgaattttgacctagggtttcatggaatttgaaatgaattctaggagaggatttgagatctctattggcacaaaaacaaataagaaccaaattaactccaatttttaaatgacaaacttttaaataaatccaaacaaaattaagtgtgctacaaactccgttaccaaatatcgtgtctcggtgtcgacatcatgtttggatctcctatggcgtttcttccccgtttacactggtggagaaaccctttgtagtcccggttcgtaacccccctttagtcccggtttccaaaccgggagtaccaatccgggactaaagatcgctatctttagtcccgggtcaaatcaccgggagtaaagatcgatctttagtcccggttggtgttaccaaccaggactaaagatcgatctgaccttttttttttgcatggccctgttgctgcatggtttatatatatatatatataaaccatgcatatatatgtttcaatacatatatatgcatacatatatatatatatatatgtatatatatatatatattatattatattatatgtatatacatgcataatatatatgtatttatacatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgcagaggatgtgtactcacaggaaatttgaacttccgcctaagtctttctctccatttgccgcagaccaaatgacggaaccgataccaagccctacatggagtttaaagctatgattcgtagtagcaattaacataacaagattttcttaattaacaaaggaacttatgacggtacctgtctataagttcgaaaaccttgtcaaacatagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccaccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaaggctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgtgtgcaatcgtaccccgggtccttgttcttggcggcgtcaactttcgccttcttcgttgcccttgtgtgggcaggcggtggagctggggggcccttgactttgaaggtgctggaagaggagcttgcgggggagtaggtgtaggagcacgaggaggagtcggtgcaggatcctgaggaggagtcgatgctggagcctgaggtggagatggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctctagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtttgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccactgtgagcatagtaccagaacttctatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcatcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcatacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctaggagtcgcaccaattccgtagtcaataatatcatactaagtctaatttgcaataaaataatcttatattaaaactcaaataatattagaacactacacattcttatatgataagtctaattacaggtctaataatcttaattaattgcattacaaatataacaatcatttatattattacgtcacttgcctgctccaattccttctagggctagctcttccactcaggcttgacggacgactccgacaacatgtcttttctgcaagatacaaaaagatgtattacgataaatacgaagtaacatatatatatatatatatatatatatatatatatatatatatatatattgcatttcacgttcacgttcgttcgctcgttctcattcatgttcgttcgcttgttctcattcacgttcgttccctcgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctcgttcacgttctcgcggcaacgtacgttgacgtgttcgttctcgctctcgttcgttcgatcgttctcgttctcgttcgttaacggcggtgtggcggcatcggggcggcggttggcgcggcggcgtggcggcggcggcggcggcggcggcgtggcgacggcggcggcggcgtggcgttgcggggccgtggcggtggcggcgtggcgtggcggcggcggcattgcgcgcgtggcggcgaaggcggcggcggcgtggcgttggcatgcggcggcggcgttgcgcggcggtgaaggcggcggcgtggcgcgtcgtcgtcgtggcgcggcgtctcgtggcgggcggcgcaacggagagagatcgagatcggagagattgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaatgtctaagtgttggtgaagaagacgagggcgcaccgggaatatatatacccccggatctttactcccggttgttgagaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtgataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaagttcgtccgagtatccaaccttgttaaggtcaacagttgtcatcccaatgtcatcaatcattacgccttcaccagtcaacctaacccattggcaccggaacagaggaaccttgagaggaccatagtcaagttcccatatgtcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagggaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgctagcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactaacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctcctttgtgcttattattcgcttgatattcgtggagtatccagacggtacctttatgctctccaagcattcaaacatactttccttctctgccttgctaagagtgtagctggctggactcaagtaatagcttcctttctcctttggttccgggtgaaggttgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgttggtcctcgtcccacacggggacaccttccttcttccacaactgtttaagatcttcgaccagtggtcttaggtacacgtcaatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgatgctcttcagcgtgccatcgcaacattctagcattccccttgttcctgaacaaacgccttagccgtggtattatagggaaataccatatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccctattttttgccttccattgcaacaactccagagtggtatccaactttttatgcccctgctcgcaacctgggtacaacgaagttctgtggtcctccaacatcttgtccaatttatggacctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctctatgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaaaaaattttgaagcttgctcgggcagctggaggaggaaaaagacatatatatataggggtgggactttagtcccggttggtagcaccaaccgggactaaagatcatctttagccccggtttttattgcatccgggactattgtggaaatcggccgaccgacgaaagatggtttctccaccagtgttagctatcgatgtctatttcggggctggttttataacagatgttgctcacttgcttgtatgaagcatctggtactgttgacatgtttcttggattgaggctattagttacatggtgtacgaatccatgcacctcctgaatcccagcatgttcttgtttttgtctcttttttgtgtttgctcggtcgaattcatgagctaatctatacacaatttatcgaaacttggcaatataccgagtgaaagggtaaccagtacacattagtggtcgttcttgcattcatacaagctgaaggttttcacgatccattttacattcagaaagctgaagtgaaagcaatgctttctctgaatctttcagagaggcactttgtttagttgggcccgaacttgaatgcacagtacttgatgaatcccatatgtagctcggatgcaataatgcattatattgccatctcaatgtttatttagtatttttataaagtaggtatataacatcgtaaaatactaagataattaattaatggtagtatgtatagaacccgataatttttaattcggaccctccacagtactgtacatgtagacatgtgagcctgaaggtatgtgggcccatatacagtaatgtagaggacctcactcgataatttttgttcgggttcgtgtggatgccgcggcatctatccccgtgggaaccggtagaggcggtacaaccgtaggtcgtcgtcggggcgagtggtcgccgtcgtgccgccggcgatgcggagctcctccatagcccagccttcgacgtcgcacccgacggaccaatcgttgacgaaggcccatctcctactccggccgatcttggcgccgtccgccgtggcgatgatcgattccggttgattgatcatcactttccagtagcctccggtgatgtttctcggccgtgggatcttgcgtcccgggctgaacacgtacacgctgccgtcttccgccgcattgctcttcaaattatctaaagaaaaaaaatcatacaagcgattcatcagagatcgatcgatcatggatgcgtacgtcgtcgtcagtgaagaagaagaagagttggggtttcaaaaaaaaaagaagaagaagaagaagaagaagagttagaattagaatgaattaaggtgcatgagtgagagtatacagtagaggtgggaggggtggtcgccggcggtgaagacgttggcgtcgtggatggtgaacggcagcggcggcagtggctgcccctgccgcttctggtcgagggccgccacgagcagctgccgtatcgcggcgtaggccatggatttgggatgatgatgatgatgatgatgcaggcagaggcggagatgaatctgggtcgggcgcccgatcaggaggaggcaaaatcggacgctgatgtcagcatgacgtaaacgttcgatttacgtgcaaaattactttaaactgatttatctcttaaattacttatccaaatcatgatccgattgcaccattaaattcattgcaattaaatcttcaaaacaagaccacacatggatatattccgatgaaatttattttttagcttattattgaattatttttaaatgttgcacgatgttccaccagatatatcggaattgtttcgctaagtagatcgaaaatgtttcactcgtttaaatcgggtgttgtttcatcttatataaaaacaatgtttcagcaaatagtgaatgaatgtttcagttcagtgcaatattatatctatacatagtgaaacattgtgagtacattaagtgaaacatttttggtggaacaaaaaataaaccaaattcccttaatagagagtttcccaaatatgtgggtttttttttgcaaaagagtatttttaattcactgagatctataaatagtgaaacattataaatacattagatgaaacatcttttgtgaaaaaaagggaggaagaaataggtgggtccaaatagacacgtggggggagagggcg

SEQ ID NO: 49536 - DNA, 7257 bp, Oryza sativa
tgcctccccccgcgccgggcgaccagccaacagcattatcgggcagaggcagacagattaatcgccgatatattggttctttgatttttggtacgagtgtttgtaatataatcatgtttgagatcgtgttcttgtacgcgttcgtgccggttcactcttgtacgtgttcgtgtcagagtgaaccgagaattctgttcggttaaactatcagcgtctcggttttggatcggcacccaaaatcagccttatacacttcgttgccaaaatcaaccttattaaattataccaaaatttgacatgttttgatgttttcgaattttagtggttttggttacatttggtttaaagccttatcaatttagttgagtttttatgggaggaaatttccgaaattaccaatctttagtagtctagtaacggtaggattatgctcaatttgttaccctaaccaaatttactaattccagatacttgataataaggttgaaagtgagaaataaagtggtcatgtcctagggattgtgaagtttcgtccgaaagagcatgcatagcccatattatttgtcctggaacgggaatatggcatccatgatgcccatacaagttgggctggaactcccgtgggctgtctaagtgacacgcggggagccactggctgtacttttgacttgtgccacctgcaacaactcggatgattcccttggtcgttctgagatccatccatctgtaatagtatgtgatatatgcggaagaaagaagagtgcagcgcacaccttgctgttacgttcatccatatcaacgtaagtaatatcacaaatattactttactcgctaatacaaatatttgacaagtgaaatgacatcaatagatttgtgtgaaaaatattttgatgtagttatactttctacttgttttttatgaatacttgatagaaaatgaatgataaaatatgcaggacagcagattgtgtcaatgactctaaatggcaactaaacagaatggttgcattttttttccaaaatgtttttctcgagagcagaagtgcaaattgaaaggggattttagctacactggtcacaaatagaacttatcagagctaaatgaaatatctctggtattgtgaaacctgaaaaattgagtgggagaaacttttgacttttgaaacatcacacgtttactaatacacggacaatatgcatgatgaaatggcacaacaacctaaacgaattcgattcactgacattgtactacaacaaagggaaaggacataattaacattagctaactttgcaccggcatattcagacacttacacacttgtgcaattaaacaatagtggagctacaactaaagttgctattcggtggccggtgggacaactatatcaccttgtggagccgatggagctacatgctggtcttgtttctccttgcgagactctgccccttgggaggtgtcagttggagcaacaccatgtcctccttcctccttgagattgtgaggatttttcgagccttgcgaatcggatggaccgatgacaccatcttccctttcatcctcaggttcctctgttggcaagtgaaacagttgcctcctctggagcatctctgggaacgtctccatgccggcatgtgccagcaggagccacacatgggagaggtactcaacacctgatccaaggctcttggcatgcaagtatcctcggcatctaccagcggagaagcatagcatctctacccacacatctattatgacatcccacatcttcttgtaaccccgagccaataacaaatctcgggcaagccggaaagcatcatgaatgaaacaattccttttatgctccaccttctcaattacttttagcgtaagtttttcttcatcatccacaggtagatttttctccttgtgtagaatggagtcaagttcgcggtacgcagttgtgaagagattacttctgctgccagccatcagcatctcaggattagcgaacaacagatgcattatgtagttggagattgctcttgacatcactctgaaagaagggccattgggtggaccaaaagattcatgatacttgtgaaagcagaagtccgtagccacatgccatataaggacaatctcatcgaatggtttctctaagctccagcctagaagccaggtgcattttgctcactcaagtgcccactgtcccatgttgtcattgaaactcctgtagctctcggcgtttctatgtattttgtccatccatctttcacataattgtgaaccaaatttgtaatatcggtggacatatcgcatagattcatgcaccagtattggtctagcaaacccttgcattgtaagcatcctgcgatgcttatcaaccatgcgtgccttttgtttcgggtgaagaatcctacgaggctttgttgtgccatagtgttaggcaagacatcgagatatttccatactacagccatggaaatgatctctagtaaaagggtgccatacgccattagaaatgtcacaatgacatcattatggctataggcttgtttatggctgctgtggaggagaccaacggctgggatcaccagtagtatagctagcatccatgttgataaccaacaatagcggtttgcgtcaggttgttcgctatcaatcttatttctggtgtatagaatatcaaagatgctggagagcccactatttattgttttacaaacttgtgtgagatcaagggtaaagaagtattttaggttatcaaggcgatcggaatatgggtaggcaaaatccacaaacaacatggtgggcacatcgaactctggggatgaaatttcttctctagtaccttgctgtgatgctggaggagaatgatcgctgcgctgaagtaaagcctttgcttcattgacgaaagattccagcatttcttctctgttaacgactatatccaattcagcatcataattagagctgactaattcattaaagcttgcggccttgagagacatgggcttctcaaagcatttgacaataccaacgatgaaaagcaaaattgcagctgccaatagccttctgtcagccgacgacgaccacgactggcaaaagacgtagatggctactgtgacctgatcacgaattcacgattatgtgaaattaacgaataaatagatgtcaaaaatataaatatataattcgaaattccgaaatatgtcaaaaatttcccttgtaattttgaaatcacattttataattacagtctggcctgatattgaaatttaatattcaaaatttagatgctcctgcgctttattatacataattcgaatttcaacagtaaacgtaaggaagcataattctattcccaacttgaacacaacaaattgacatataaagaatttcagaataaacatatctgacaacttagggtttgctcgcttaatctctatgaagaaaggactgtaggggattgaaagggattatttccacacctcaatatatatgtgtaaaattattccccttcaattcctctcgatctttttgttggtgggattaaccgagaacaatcaatattaacccttagtccttgttcagtccacaataatttggcgaaacttaaaatacaaatacaattaatatatccgagcaagaattgcacgttctagctactccttccatgctaaaatataagtaatttttagcatatatagtaacaaatcaaacatttttaactttgactattaataacaaaatagtaaaaaaaaatcaatcatgtaaaactgatgttactaaatttatcattaaacaaactatcataatatacaactctttttacttaaaacatttttacttttatagatattattggtcaaaaaatagtacctcgtagaccatgtcagagtctaaaaatacttatatgttgggacggaggaaagtagctagggttgagcacctgagataatgcggttaggatgtggcgcctccacagctcattgtcttctatgttgtaggcggtgatgaacatctggccgccgagatgcatcagcaggataggagcccacacgacctctagatcatggctaccattgttgtcgtgctgcagtttcttcttgcgattgaagagagtggcaagtgcgtataccgccaacgcatcactagcaaggtacgagagccagatgaaaaacctgtactagggtgggaaacggggtgacttgcgcctgccgccaaaaattgcaagaaagtactgtacgccgaggctgcccaacacaagcacgcgcagctgccactcctcccaccattgcacggcgcttgacaaacccatctactacctgttgaatcgatcgtgtgttagcttttgtataactatagctttacttcgcctaatgacgatgccttttagggctttatgcagctagctagcacatcgtcagtcacagtaaatttatggagtttcttttcaagactttcaactgcttcggtgcttacttggtcctagagaaatattgacgcacttatcaataacctcgatctccattaacagtgggattgatcaccgaaactttaattttaagtgtagtacgagtactatttatacgagtcacccattttacttgttattaaatatgttacgtggatctcgaggtcaactacgaattgactaattttataaaattgcaagccttaatgctactatatgacttggggcatttccattagatggttattaatgaagtttgtaccagttcctaataaataggtagattccatttgtagattctattagcttgttactcatcttcattatattttttttgaccaagcgagcaagagctaccatttcacgtattaagagaaggttcgataggatttgatgtgaatgatcggtctggcatcatacatgcatgagactgtcatctagctgggctgcgactccacttatggttgggccgaaaagaggcaagccgagcaaaaggtaggatgcagcgaattgggttagggtgaaaaggaaataagaaatgaacttaagacccaaaaacaaggaagatttttattcaactttttcaattatagtgtataacgatccaaaagtttcaatttatagttgtatcagtgaaaaaatatctttacccgttgcaacacaaatatatttttttctggtatataagagatggcacatgatgctgagttatccgatgtatatgtgaataacatcgtttaagtgttatagtggtttaacaaagtcaatagctaattcttgaaaaaatggtaagaatatgttttctttggtctgaaattgtactatttcagcacatggtacgtattgaaaaagttacagaacttttacaaactattgcagtacaatatattggcagtatataaatgggtaatttagaattttatagaaaattggaataagttttctagtaatttcgtggtcgagagttaatccggtccagttgggacttcttcacgtgttaggccaccgacatcactgctggatcatgtttgtacgcctgcgagagacgatgacacgcattgcgatggcatgattcctggtcaattatgatcatcattaaaaatttgcatacttggttacatgtgaccaattaccagttaaataatgcaagttataacatagcagatgtgcgtggaaggccttacacgttctgaatcttgctagctaggttaacacattcatacaaccctaacaatgatactagtttttttatctaaattaattactccctcagtttcatattacgagtcatttgactttttttctagtcaaatttctttaagtttgactaaatttataaaaaatagtaatactttcaacacaaaacaaacatattatcaaaatatattcaatgtttgatttaatgaaactaatttgataatttagatattgctaaattttatataaagttggtcagattaacaaaatttgactcttaaaagggtcaaacaacttataatttgaaaccaagggagtactttcttttttaacaaaaatgaccctcacagaataacaaagaaatatgcatttacccttgtaaattttacactaccatctatttaagcgaaaaatcaaatcaatctacaccattaaatcatttatatcagtatattatacagtaaaagttctcaaaagttaacattctcatgaagcctactaccatctttcttctatacctacacagggtatataactgtctcttgctttatgaataggagtaaatgttgaagaaaggatgtgcctggctaggggtggcaatttcccccgtgagggcggggacgggtgctggtttcaatccgcggggagtcggggtcggggccccgataatgggcgggggcgggggaggacagtcacccgctggtgacctgcggagcccaaaggatgtatattcgactattaatcctagtatgtcataagcccaaaaggccaattagcctatcatatataaatccaaaccctaatttccccaccccaccctatccccaatttctcacccacctagcgacatctccatcggcgggcgacggcgcaagcgaccaactactggttaaataatgcaagttataacatagcagatgtgcgtggaaggccctacacattctgaatcttgctagttaggctaacacattcatacaaccctaacaataataccaatttttatctaaattaattactcccttagtttcatattacgagtcatttgacttttttcctactcaaatttctttaagtttgactaaatttataaaaaaaatagtaatactttcaacgcaaaacaaacatattatcaaaatatattcaatgtttgatttaatgaaactaatttgataaattagatattgctaaattttctataaaattggtcagacttaacaaaatttgactcttaaaagagtctgtcggagggtgcacgcctcaagcgagggactgtgaggcccccccgttttagttcggccagaggcagcgggtgagaatcgaggattcggtggaacggtgtgatgtagagggggtcgggccccttggaaacgatgagaccaaaggggtttatacaggttcggaccgctgaaaagcgtaataccctactcctgtgcttggttgatcgactatggaatacatgcacttgaattggtgagacccaagcatgagttagccaaagaacccatctctccctctcaccaagcctggacctccttttatatttcaaggggctgccacatgagcctagattaaatgcatgtcttggtgcttgacttggaagcca

SEQ ID NO: 49537 - DNA, 5142 bp, Oryza sativa
attcaccatttaatgggtgaagacttctgggttcccatctacaccgggaaacaagaaacctgctttgaccagagcggatgaaccgtctccggccgggttagcctctcatcatcatgatgtgacagggcatggcaggcggcatgccgcctgacgtatgaccagtgcgcaggcgcactacctcggtcccatcaatcattcgaccggtcacagaccgatcaggcgcacagcacgtcgcattaaatgcggcgtggcacgcccgctcagggggccttaaatgcggttaggtgggtgttgggaccgttcacctaactccgcacacatggcgtcatgcaaagggggtcggggcagcccgacccgccgcgctaccgtgggcccgacccccttgggggagtgccatgtggtactgggggcagcctccttcctctagtctcgataccctcaggcccatatcaccgatagagtcaaacgacttataatatgaaacaaaggcagtactttctttttcaacaaaaatgacccacgcagaataacaaagaaaaatgcatttacccttgaaattttacactaccatctatttaagcgaaaataaaatcaatctacattagatcgtttatatcaatatattatacagtaaaagttctcaaaagttaacattctcgtgagagcaattttacggtccttgaggaggtaccatgaggtaccaaaaatttagtgtaaaatttggtaccttatagtatctaggtaccaaatttataatagaaaaaatggtacctcctcacactactacaaaaatacccattagtgccgattcttaaggcctaataggtgtcggttccggacccgacaccttttaaaattataggtgccggttatacaccaagaaccgacacctatatttattataggtaccggttgtacactagaaccgacacctatattgattataggtgccggttgtactcctataataggtgtcggttttttataagaaccagcaccaataattctaaaagccaaaaaaaaaatattgtgaaatacatcatcctgaaacacagaaatcacaaaaatgacacaatattatattcgtagattcacatatgcattcacacaaatatggacattcacatatatgcattcgcagattcacatatgcatccacacaaatcacaaaatattacattcacatatgcacatccacatcctcgacatccacatcatccacaaaaatacactatggaacaaaaatgacacaataatattcacatcgtccacgaaaatcacagaatattacattcacatcttgcacatccacatcattcacatttccaagaagactcattttaaaatcccacaacaattcatatcagtaggtatgttattgctaaaaattgaaaagagaaggataaacacgtggcaaaagtgaaggataaacacgtgacaatagcaaagtaaatgcagagttagaaactgtagcattcagtacctagtgttgtactaactagataataccccgcgcgttgctgcggggaataataaataaatttcaaagatgcaccaagagcatagtagcacatgaggaggaaagaaaaaaaaattaatcctaagtgattgacttcgtaaagccttcatattatggaatggagggagtaaaaattatgtgatgagctatctccactttggtagccgtggttaaaaatgcaacagaattgcaggtgaaatacatagttgctgaccggatagatctagtattggaacaataaaattaaagtctattacctcgttgctgaagaatgaaaaatatacaccatcaatagaattatgcagaactatatgtttaatgtccatatgaacctttctaaagaaaatctatacgaactgagactggaaggaaaatatataggtggtgtactggaactgatatcctcattgacttggtagccttgtattctgcataaagtatttcgtagtacagctctccctcactgatccatttagctcggttttagtacctcagtagttaatcttgcaatagaatgctaataagttcttgaataagttgctgaaatatcatatttttattgcggtaagaaatgtacatttagccacaagtaaaaattattatttatatgttgtcatatgatacgccaccaggaatgtgcagttgaggcatgtagcaaatctggtcgatccatgacaaccatacaattacaaaattgataaccatcactaaaaagactctcattttatatttaaacatctacatacatagtccaattatcacggttagctggggaatcataactaaactgttaaacgatcatagagaatagtagaacaaattcctgcttagctatcggagttgggaaaaggattacctctaaaatatataattaagttctcatccttcgttaactcctttctgtgttcgtagctttcagaaaacttccgaaataccaatattactaagctgattcagagtcacaaaaagagtctatatccagatcagttgcatcagcaccttatatataccgagatatagcttcaccagctaaagatcataattgaataccaattaaaaaaaacttcatcggcttagcatgcccatacattcttagatctgattgggtgacaaatcaaccaatggatgtatatgatattgttttccatacccttcaaccgcttaagagacaaatcaagagtaaaaatcaactaagtcagtaatcatgggcctaaaacctgggaaacaaaagaggatgggaaactacagcaacaaaaaaaatgtgttagacagtcaaactgggtaaataatgctactatatcctaaatatgaaccatagtacaaaattgaattaaatattgataggagcaatcgaaatggtgtgcatgtaaaagtgaggttctattttgatgaacaaaatccgattgagcaaacaaaaggaaaggggaaattggtgtgtgatcacctgtgttagatcattggagtgattggagagataatagtgtgagatgcatatgaatcaagccagcaaaaatccaggaacaggagcagactgccagctccaattgcttggtagatcgatggatacgcaagagggataaatttgatatagtggcagaactaaaagagggataggaggagaagaaaaggcaagccattaattgatggatgtacttgatggcagtcgtcggcagtttcagttcctcgcggcaccacgactaggggtgaaatcgggtcgggttcggtcggatctcactcttcccatatcctaacccacattttataatcggaatcggcttggatacggatagtatcgaatacggatacaagcacggataatatcaggcacaaatatgagacgaatacgtacctagacggatacgaccactatcggttatgaatatcttttcggatatcacgtcaaagcaacgatcatctatactatatagacaatagctatatattcaaccatccccgtatatccataatgtgactatattattagggtttaagatatacgagcaatacgtcaaggaacaatcgatttttaactggaaaaattgaaagtttggttgaaattaaaactatgcgatggaaaagttagaagtttgtgtatgtagtaaagttttatacgatagaaaaattggaagtttaaagaaaaagtttggaactaaactcggcctgacttgtgatgagctgctgacttcctgttcctgaagagatgaggatcggctggcagaaaaggcatgtagcggcggtggccacggctcaacggatgcagcaggtggcggtgcgacgggtgctgcaccgcagcaccggtggcgctcgtagtctcggcgtcattgcttagtgggattagtgaacactgaacagtaattagtatttttagttgttgggttgttaagcatggtttactggttgatggtggtcattgtactagtaggccttttggccactagtgctttattgggctaggcatgttatccgggtattatccggatatttaaccgggtaatacccgtatttttaccggataatctgtatccgtcggataccgtcctcccgaacccgatctcatatccgatagaaaatacccgtattcgaacccgctacccgtagaaacttccgggtacccgaaatttttacccgaaattgtcccgaaataatacggctgggcgggcgggcgggaaatacccgccccgttttcacccctactcagcagcacaacgtgccgtccacccacaccgcatcctctccctctcctgctgcccgcaccgtcctcctccgccccccgtcgcatcgcatcccagcgagcgtgcttacgcctgcgccccgtggcctcccgcgccgggcgatcccgcttgcagtgccgcaggtgccctcctgccccctggtcgccatcgcatgcctcctctgcttccagtggaactttctctcccgcgtcgcttcttctcccgtgcctgcttgcctcttcgagtctgctgaggggacagggatgcgatgcagtgcagatggttgatcgttcgattcaaatccaacggccatgagaaaatgaggtgacgtgacagcatcaggaagcagagaattcctagtagtggggatgatttgtataggtatataggattacataggctaaatgtagagtagaactaaatttttgttgttaattaataggttaaggttaaggtgtcctcaggcctcatggacacaccagaggaccaataacatggtgaccaataacacttcaggacacaaacatgatacaggacacttcagctcagattctattaacaagaaagtcaccaacaattcttccattatgaggacaacaattccagcaactaaccaacccaagacacacatacccaagatttcctctaaccactgtgtaactgtccctagatctctgcaaccttgattagagtgtgtctccatgataattatagtgtgattttatagttttctcaggtcgaactgcatgcacttgattaataggtgcttatggcttgtttttttgaaaagtctacatgaaaaatatcataactaatgtacagtacttagctgaaacatttacactatttagccaatttttttgtgattgaacttatttagtagtacaaaattagtcacaggtagaagagact

SEQ ID NO: 49538 - DNA, 8363 bp, Oryza sativa
tgatggcgacgaccacaattgtgaggagcgggcgggcggataaggctgggggcgtagtgaaatacggagtatatactagccacataggtgtcggtttgtgtggtagaaccgatacctacagagataaaaggtgccggctttttattagaaaaccggcacctattcccctcgccggcctatatgatgcaaacacataggtgtcggttcgtttaaataaccgccacctttcgtataggtgccggtttttgtccacggccgccacctatgcaatttttggaccgttggcgggagtatttttagtgccggtttttgataaaaaccggtaccaatgaccttcccaacaaaaaccgacacctattaattgttataagtgccggttttttgctacattgacaggaaatgacttataggtgtcggtttttggctaaccggcacctttgtgaccgacacttatgggtgtttttttagtagtgtcaaggaccataaatttactcttctcgtgaagcctagctaccatctttctctgtacctacacagggtatataactgtctcttgctttctgctttctgaataggagcaaatgttgaagagaggatgtgcctgccactgcactgcctataatcaacgcccggagctggcttaggtaagtagtatatttgaggccatacaattacaccgacagacaacgatcatttgactgaaagacagcctgaacattcatgtcatgtatgctaagtgaaaacctttgggttttttttttcaaaaaaagaaaaatctgtcagtagagaaacaggcgcagtagtctgggcggaagggcttgtgggcttcgtcgagaccacggaatggaggaggggacaagcgcaatggtacagcatgaacaggaactaaccatgaacaccaggtgattgatttattagtaatactagcttgtatagtgtgtacattaacactagtgtatactccctccgtcctaaaataaataaaataatttgtctcttaaatacccttcacctatccattcaccaatacaacttttgtattaatcaggggcaatttggtcctttaacttcctccttaactttacattgggaagctagggtaagagggagtaaggcacaggggttgtcaaggaacaaggtctcattgattgggtgcagtgtatgtgttctagctagctagttaactgcatagggtgatttgtttgttgtaattgtattcgagaattgtattgttgtaaaactgaaatctggctgagcatgtcctagtgaattcaatgttgttcaggaacttaatgaaactaaatatatattgtaattttatagaattaatcgatcgtagttgacctcgagatctacgtaacatgttttacaagtaaaactgattcttatactctacacttaaaagctccaggatcgatcaatcacacagttaataatggagatcgagattattgattagtgcgtgaatatttctctaggaccatgcaagtaaggaagcatcgaagcagtagttgacgcgaagttttgaaaattactcctccataagtcccattagatatatatgtgtgtgcctgactgactatgtaaaggcaacatcacgtagatgaaaaggggacagagctagagagacgggagctagcccactgtaattcgatcgtagacgatggatttgtcaagcggcgtgaaatggtgggaggagtggcagctgcgcattcttgtattgggcagcctcggcgtacagtactttcttgtaatttttggcggcatgcgcaagttctcccgtattccgcactgctataggtttttcatctggctctcgtacctcgctagcgacgccttggccatatatgcgcttgccactctcttcaaccgcagaaacaaactgcagcctgacaacaacgacaatagcagccgcgacctagaggtggtgtgggcacctattcttctgatgcatcttggaggccaagtgttcatcaccgcctacaatatcgaagacaatgagttgtggaggcgccacatcctaaccgcactatctcaggtatgtgtgctcaatgctacttatatatatatatatatatatatatatatatatatatatatatatatatatatatatattcccctatgtatatatacacacacacgcgcatcatctaattctttcttgattggattatgtataatgctgaaatcttgaattattatgtgctagccatacctctgtcttaaaatacgcatgtaagtattttcatatgtatatgtatgtaagtatttccatcgtacgtaataactattttcatgcgtatacgtatgtaaatatttccggtaaatggattctgttggacacagaaagcatatgctttttaaatagatctaatctgacggtgtaaaataatggttctatcaatttaaatgaaaatcgatggtgggattgtagtatgccacatggcggcctaggaacgctcgtagaaacgccacgtggcggtttcggagcgtttgtagaaagtttaatagacttttagtatataataactaggaaggtatcccgcgcattcgcgcgggcatgtgtcctatgctaagtttgagatatttgtaagagcgaaatgttacatctaccacaatttctccataaattgttttcatcggcattaattgcttttataattttctaacctattagttttatattgtatcatatttaaataatatctataagtaattttttataatcttctatatcatttgaaattaaggtagacttattttttaaaaacatgtcaacgaattgaaagtaaaaataagtaaaataaggcatttttgaaattgcatatctattatcatagttcattaaaggattaattaggtggaacatgaagatctactaaatgtttaggtttatatagtctaatatgattgatgtagtttgagaggcaatcatatatgaacatttcatgtacatttcatgtagggtgggtgagaggttccatgcagcctaacatgaatacgataacgacgaaatataattgcgcagtaatattttgaaaatatcatgtaccatgaatacattcttttttatgtaagatagatctaacgattataactaatagtttaccagtttaaaaggcataggagtattgcagaaatgtagcttaaaaattatggctgttttaatatccaatgttattgcgaagtaagcgcagctcaactggattgttttaatatccaatgttattgcgaagtaagcgcaactcaactggttaggtttctcgtggtagagcttgcccatctgggttcaagttctagatttgacatgggtgttggtatttacgtctaattattcttttagtggtaggtgacgtacccatcgacagcgaagcgccgtggtaacttcttcaatctcaaaatgtaccggctctgtattttaagatgctaaaggggtagggtgcgtgcacgctgtgtttctaaaagatttccaatattattgattgtttctgttttagttttatagctaagagagagggaagggacactaaaatctatttgattttttcttaaaaatgtatggattagtgaacagtagctagtccgtataatatatatgatccaaagtaataattttttaataatatagttaacttggttctttaattaaattttatagtaaataatctaatttatctcctacttagggtacactcgatctcattgattgagcttaagtagggcacacaaaacgatataggccattaacgtatgattaattaagtattaaatattacaaacatgaaaatagtttttttaaaaaaatgtatagaatatatttgcacaacacgcacaatttagtagtttggagaacatgctcaagataaatgagggagccaatctgataaacactttacaactcaaccttaaatttgttacttatgtacttaaaaaatatgtataaatcaaaagtgtagatcgagtcattaacggctaaaattcaaaccgtgtttagcgagaaaaacatgcaacttatttttagacaatacattttttatttgtgtttttgacaatatgtcctgaatattttaattactcattatttcatcttgaactatcaatatataggcccattgatgcaaataaatgctatctatactcaacaataatagtgtgaaatgatacgtgtatttgatattttatattatattatagatctagttttggctgtgcatgtttgttaagtgatatatattttttatactaccaccttcactaaatatatgacattggtcatcaatatataaaaaacaataaaaaaatacaaaggaagtataatagaaaatccagattaaagagcgttgttttctttcggtagtttcactaaatatttaacgttggctgtcataaaaaaatacaaaggaagtgaaaatccaagtttaaaaaaagcgatgtttttttttaaaatttttttccagtagtacgtacgtatacagtattttttttttgctgtatatcatttcttcttttctcggttgtggttgttaattcgtacgtaccaatgccttctcagccttttctagtcaatttttttatggaaagtattactcggtaaatttgaagggatagattactatttataacatatctaatccaattgtgtaaactaatggatccaccaactttttaagaatttggagggatagatttttttttcttttttctcagaaattttaagtttttttctattttattatagcgccttgtggtagcttgagagctttttagagcaccatgtggcggcatgagagcgtttgtaggaaatttaatggacttttagtatataatagaatagataatagatagatagattgatggtaagaaagcggagcaatggatagcgtgaggcgccgccgtggcatggggcgtggcttcttcacggcctcgtaggagtgtttggtacatatgcacagtttgaaaaaaaaacttagaggaggaaggaaagagaatataggtagttgtgttgtaaaatacagaatataggtaggtttccattaaatgattatgttatatatacaactaatctaaatccggtaattaaacatttaatatatatctatcatttattcgaaatatttagatgtgtcaatatatcattctaatactcttctcaactatccaactgatcaaacgtatactaatcatgctgaactgctggtagacaataggcgactcaattagcacggggtgctagacttaatctgtgttttggtggttgtattttgttcacaggagataattccgatccgacttgttggttcgtgacagtctcgccgccgtatattacccattaacaaatgaataacggactttttctttccttttttttcacatctgttgcgcataggaaggacattagccggttttaaggagagagagagagattttaacaaatctaatccatatgtttgcgcataaatcaatggctagatatttcttatattttctctaatttattagagtgccatatggcattatgagagcatttgtagaatgacatgtggcggcttgagaacgtttgtatgaagtttaatggatttttaagtatataatagatagattttttgtgtttaaatgtgccagtgcaattgtgcaagttacgtcatgctgatgtccgttctaatatttgttgtacaccatgtgtggaccgtcaagttcatactgtaatcgtgtcattttaacgtattatcgcttctttgcggtacactctacactacgctaccctatactagttatttagacctagttctttttctcaactctaaactcttcaactttctcattttctgttagcacgtttttcaaacgattaaatggtgtattttttaaaaaaattatatagaagttgtttaaaaatcaaataaataaatttttcaattttataataattaatatttaattaatcatattctaatgaggtttctcgtggtatttccagtatttttgcaagacttgaccaactacttcctttgtcttacaaatattattattaacgcaagatgctcatccatctaatgggaaaaattaagctttttaattattacttacctagatctcgaggttgagaacatgatatgagaaatctactcccaagttgtcggtcagttgtacactgcactgttttgtatattagagacaggtgccctaattatgctctccaagaattgaccaacaatttccttaactggtcttatttattacacagtaaagtttaattattttattgtcaactccggaccccttttttctaagactaaactccagactttttttttttactaattcaccgggggaagagcttccgcatccgaattttcattgcaacaaaggggaggaaaactgtccattacaataagtttagagtttgaaggtgggaagagtaaatttgtttccaaacagaaattacatgtcgatcttcaatcttcagattttctgccctgagggccacctcgctaacacacctttgaaggcaggaaacaatggaaggcgaacaacccctgaaaactacgtcatgacgatgatttcaaagcgcccagaaacaaagtagttagaagacctgaaaatgttttaccggcagattgtgcgggttttagttggtgtagcatttgcacttgctgaatgggtggatgaattgcaattgcccgccagaagcttattgcaaaagggcaagtaaaacacaagtgattcgccgtctcagccccatgattacagatgatgcatgccgccgattgaacaatttttttctttagcagattttgttttgtggacagtctattcctgacaagcagccatgcaaacagctttacctttagaggcgccctgcattcccatatccagaaaactccaaacttaaacaacacctaaatgtcagatcggtgcaaagttaactatacccctgttgaggtgcaaagtcagcacctactttttgaaacacagaataaagctcgggaaactgaataatataccgccaatccgtgtaacctgaacaactcctgctttgcctctctattcaagtaagtacgtcgatcaagttcatcaaccaatatgttacattaagttcatcacaatttaaccaacatgttacatgcatctggtgcctctgctgttgttgcgtactccgtttgtgttactacaggagtaaacatgttgcgcccaacccaacctataaagtggtatattgtccattttctcatctctacagcctgaacatttccacagacctttttttttcttttgtagccgcgtaacacatgctttctctgaatcttgggttttctttcagactagatatagctgagtaaacatgttacgccgagacgcgaattaacgttggaggcggcgtagaggtatgtgttcgcagccgcgcgcgttttgtcgagtcatcgccggagctggggccgaatcatccatggggaggcggcccgagtccgagatagacctcatcggagcacgtgaaagaagataaatccattcttactactataaagttatagtatgatccactaactacaattaagatactaaatctcaaacattaatgttccacattatcatcaatttttagccgttggatcattggattagattgcttcttaggtgttggatgaataaaacgcagtcaccacatgtggcccattgatcctaggccaatttaatagtgaaggaattacggtttcttctttgatcggtgaggtcttctcctatagtaacaatgctggtggtgtatggttttctccatcgatggcagtcgatgcccttgtgaaaaatctaatatgttgtattctgatattttttgatatattacatcgaccctctcatgaggtatatataggagtacataggagatagagacttgaaatacaatacatgtaagagtagatttatctctaggattctatctctagaactctattcttatctctaggattctatctctagaatatattttatctctataatttatttttgactcttatctctaactaatatattatacttctaacaaccctaacaggctagcacggcctacgtgtggtacggtgctggcctggccaaaaaacaacatgcagtactttattgccaacggacgttagccattcatctcgacgctgagtttcggacaccaccaccttcaaggacttcttttccccataatttatagtgctgatgtatgcttctttttaaactgaccgattaattaaacgtaataaattaaaaagagaagcatgtgcttccaatagctacatatttgatgagaacggcgtgtagattggatgaaatatagctaaagaccatacaagtcagatactcccttcgtttca

SEQ ID NO: 49539 - DNA, 2940 bp, Oryza sativa
atctatggtacttaccgatgacctccctaagggtgtgttcggcacccccttttcccaaccacccttctcgcttgtttttttccgtgcacgtttttcaaactactaaacggtgcgttttttgcaaaaagttactatacgaaagttgcttaaaaaaatcaaattaatccattttttaaaaaaatagctaatacttaattaatcacgtactaatgaaccgctccgttttccgtgcacactatttgtgttgggatctgggatgccagcctaaggaccggaagaaatgcagggctgggctagataggataacgtgcagcccgttttatgttgggctagtccgctactgtgacatacgtgcggtccaattaattggtccgaaacaaatgtgatccacatacggcccatactaattaggctgtaaagggagtgtggtagttgggccggaacacacctttgctcacgcgcacggcccaccgaagcgccatactagtgaaccaataatgccttgatctgagccgcacagcgcacaagatcggacggctcgcagggacccacgtcgggtggtgtcgcatttctggcctctcctctccggccggcggcgacacccggcggccgcagaacgccggcgagcggaggcaagcagccgcgatcaagacctgaaccgcacgcgcgcctccgtcgttcttggtgagaagttctcctacctgattttctccgagtagttcattcttccgcctctattcgtcgtctagggttttccatcgcccctgctccgccttagcttcttcgcggcctctgctaggaaccctgaatcaggaaatatagggttttcccgtagttgtttttgacggagattcttgcatttgagccaaatcgtcagttggttgcagatgctctccacggcaatggctattttttttgctgcaactgtggttggtaggctcctgggactggaacactgggggaaggggttgctccgaggaaaaagaaaaataataatgtgatttagtcatgtttgatttctatgacgattgccgcaacgaatatctagattcattctcctctcacggataaaaaggctaaaagccatggcaagattgtgtgggtgttggtgtttctgttcttgaattgccaccgaaattgttgttaatttttttcatgtttcaatctccttttccattttctgcttacgacaatgaattcttgactgcatatttactagtgcagtgtagttttctgtcttacttattatcttcctttgctcaggattgtttaattttgtagagacaccagtttgctccacacctgctcgattgaatgcccctgatacaacaacttcttccagatacagggatgtccatctctcactgtgaggataatgattctgacaggatcagcaacctacctgacaagctgctgcaccatgtcatgtcctatctaacagcgcaagaggcagtgcggacatgcgtgctgtcacggaggtggcagaacgtctggtcatctatgatgtttctgcatgctaacgcagccaagtccagcagcatcacaagtttcaagaaatttctcgataatgtgctcctgtaccgcaatcctgttccactgaagggactttgggtttctgccgcctgcgacaactctgatgattcccttgattattccgacatccatcgatgggttcgtcatgttcttaggagcaatgcacgcgaagttggcatattcgttcgttgtggttccaagcttctttctatagatggttatccctttgctttcaactcggtgcacttgtctaagtttgtgcttttcaagtttacagtaaatgactgttttgccaagaagttttcttctggttgcccggttttgaaggatcttgtgttgataagctgtggcatcgatgtcaccatgttttcctcaaccacattgaagagtttcgtcattcacaatgcagaagacattgaacatctgcccaaacaaattgagtatcttgtcatagaaatgccaaacttagttaccctgcatatagaggagattccaagaagaaatattcaccttgtggacttgtcgtcagtgaaagaggccacaatttacttttttgaacactcttttcgaaattccgctgttgactgcaatattctcagtgctctttcaaatgccacaagcttgaagctgatatgtgattctgtctatgatgaagtatgctacctcctttgaacattttctcctatcggtttttatgtgtttttctgatacacctttggacttgtcggcaggtgtcaaaggtattaatgcgtgatcttccaaggtgtaaggcatttgacaacctgaaaaggttgaagcttggtgagtggtttctgagaaatggatgctatccgctactcttcttgcttcggtactcacctcacatagaaaaacttcgcctgcaacttaccaaggcaagatataacacctccccccttccacattgctgtttttggtcacggcttgagtttaatggtttccttttttattcttgttatcagcttggagctgaggagtatgagaagtttccaactgctgcagcagcaatagatcctccatgcaaagaagcagcaagaacgtttcattgtgaaaaacttacagagattgaaatcgtctaccctcagggcgataaaagggtgcacatcattgtgaggatattgattgcgaacattagccctctccctgaaattaaaatcaagccctttccgaaatccggattatcatggtatgtttcttaaaattgcccattcatgcttattgaattagtggcttatgtttggaggcatttgacacacatcatttaaactattctattaggtgatctgtggattttggtgactgaggtgtctatctggctggattagatattctgataccaaggatgatgtttttggaagacttgttcagctatcctttatgttcatagtg

SEQ ID NO: 49540 - DNA, 8414 bp, Oryza sativa
gacgctaggatccactgtaaggatgcccttgctgcggaggtgcaggaagccgaggtggcattggcaaatgcagcacacggccatcccaaccgtccagtccttcgaactgatagggcatatgagaggatgatgcgctcacctgatgacgataaggtacgtgtatgcacagtacgtaatgtacttagatcatttcaatcgattttccttatgctggttttctgcctacatatataaaatctgatcttaattatttcttgtgcttatatatatttttcagccaacaagctggtccgatcaaaaagtttttgagatacatgtctatccgtcgtcgaatgaccatcatcgttaccttagctacctccggttgttgaagaagccacgcctggagaagcttatagtcaacatatatgtgtccaaggatggtatggttggggatgtggatgaagctgtggcagctgcgaggaacgtagtcgaccatcatatcaaccatccaacacttgagataaatagaatggaagaaagtatttctgaccaacatcaacaggcaagatatatctctcttcttgagctcgtccccaatattgtactacagagaaacccagttaatttgtaacaccaaccatcacattctgaatcatgtttgccttttaattgtttttatgcatactctacatgagagtgctatatatattttgtttcacttgcagttgctcatagtcatttcacaagatacatatgcatggtggtagactgctaaaactatagttcatcctaacatagcattattttttgactgtttctaggtccctgaaaataattgagtggcaagctgttcatttgaaggttaagattggcacagtgatggcacaatattaatgaatccgagccagactagacgggaagctgtcatagcattgactaatctgtaatccgatttcaaaatgcaggatattcggatcaatttcctcatatgtcgtctactcttttactgtaagtatgacactttatcttttatctcatttatgtatctttcgtaagtggcacagtaataaggtgacatcccattgttattcccacacatttgtaaccaaattctttaataattgagtgcagttctggtgcatgtttgattctctgcatttggtccaagcagaggttacagcacattatcaacggagaaaataactgaaaaaaggtgatgataaacagaatattatgggtgctgtagcataattgactctgcacctgatcaccctcctcatgggttggtaagcacaacagcttgccatcttattgctgtacaatcttttgtgaatgatgataggtgtaattggatgtgtgctggagaaaaaatgctcaatccaagtgacaaattgcgcacttgttttgatctttaattccctttcagagtgatctactctaaggacaatcttggatcacccttggatgaaaaacttaaggattggatgttggacattttacctttgataggcctaaaaacttcatgtatatattatatccaaactagaggttataagtgtgttttggctatgtgcatcatagctatgcaaatgccgggagtatgctcaacatagttgtatcgcctcattgtaattgactgcgttcaataaaatcttccattatctaaaaaatggaaagcttcaatccaccaacagagtcatggccacatgattccctcattggacaccgaaagattcaaagaaagcagacttcaggctgtaaaattgtttgtgaaaaccttcatgttgcatgaatgcaagagtgaccttgaatatgttgcttaatttttcagattatgtgtttcacattttctaatttagtatactgtgaagtttgcgggggaatgtatagatttagttgatgaattcagtagagcaaacacaaagtacaggtacaaaacaataacatgatgggattcagatctcagaaggtgcacagattcgtaactgtgaacctacagaggcacaatgcaacaacaggtcaccaaataatatctcaactgagtaacaactaaaaatcattttacttgaacaacttgcccaaatagagtcatcaaaaggagaaataacaacttgcccaagaataagaaaatctgatccaccttaagatgaccaccctagtcatcaaaatccacatcacttacaaaacagatttaggatcataaccatcaacatcttcaataacgtaactggtggcctaggttgtaaaagaaaacattgaaatatgagtcatggaattccaattcaacagacttgagtgtgcaaatgctgaaattaagatgctcaacattctcagccattttggggatggattttgatttgagggagaggattaataatggaaaataagatcttcacaatgatgtggactcttctatcgccttgtgggcaaatgattttgattttcctaagcttttcacagttaactgctgtccctgttccttcgcatgtgggatctaaatctgcagtagcatttgcagaattggtgtcgtgatcataggcataagctccatgctggtaaaatgaacaaggaaacagttaaactcaattcatgagaagaaaagaaacagcaatgtggagagggggagatataccgaaccttgacaagatgcagggaaagtttctctatgttaggtgagtgccgaagcaagtacagtagtggatagcagccatcactaaaaaacaactcaccaagtgccaaactcgttagattgctgaatatcccacaccttggaagatcacgtagtaataccttttggaccacctgcccacaagttttaaactccaaagatgttaaagataggaatatataaacaacaaataagagcaattgtaatttaaagcatttagcttacatcttcgtagatagatgaagacatcaagtgcaatcttgcagcgtttgaaagagcactgagaatagtgcagtcaacatcagaatgtccaaaagagaacctattaagggtaaactgaagctgattccactgatgatatgtctaggagccgaagatttctgtttgcaatctcctctacatgcaggcagataaggtttggcatatttatcacaagatgctgaaaaccttctgggtcatcttgagttctatctgcagctgtaatggtcagaatcttcaatgtagcagagcaaaacatggtggccttgatggcacaatgtctcaactccagatgcagtagctccgggcaaccagaaaagagtttctcgacaaaacggttatcaatagaaaatttgcaaaggtatacactcttcaagtgcaagaaagtgaaggggacaggatatccatctacagaaaggagcttgccatcacaataattgagtatgccgagagttttaacgttgcacctaagggcatggcagacccatggatggatgtcagaataatcaagggaatcatcagagctgtcataggaggtatggatacagaacatatccaacagggcacagctgcgctgcaggagcaaattgtcaacaaacttcttaaaatgtttcactgtaatgaagttgcacgagtcaacattgaggtatcccacagatgcccagacgttctgccacctccgagatagcacacaagtctgcacagcctccttcgctgttaggaatgtcatgacatggtgcaaaagttcgtcaggcagagcactgatcctgtcacagacactcgttcgcctgctagactgggacatatctctctctctctggaagagcttactttatcaggggcattcaatcgagtagttggtgtgcgagggtgccaactgccatatccacagaatggagaaatagatccacacaagcaaaattggatacagcacgttagtaatttgcaatcaaaaatttgttcttgtaagcaggaaacaaaataagattgaagtgcgaggaaaagaaacaaattttgtggggcatttctcttctacccgaaaaagaaaacctcaaaaacgcaatcatgttccgccctgttggtaggactggatatagaaactagatattgctaatcacagtacagagaacgctagtaaccacagctgcggcaatggctaaataaatcttttccattttggagagaagagaccctggcatcctattacaggaagtgtactacagcagtgaagcatccttttctccaatgcaaaaagcgacacatccacataagacttactagtacttggcactcgaacaaggaataaaatgtactcttaaacaacttgggtggcatttcctttttaccctctattaatggaaatggaggggcttccctcttcttctttaattttaaccccaagatatgaaaaccatcgcacacaattttgttccggcctgttggcaggactggaaataggaaccagatatcaccaattcacaccacaaacaacatctgcagctattgctaaaaaaaaaaaatgtgcattactttgaagctgaatggctaaaactaaagatctcattatttggctcaagtgctaatcgacactacggctacggtcaacagaaacatggcataggggggttcattttattcatccaaatcaaacacaacattgaaataacacccaagcccccaaatggaggcggggaaaaaccctagcgggcgaatggcggatggaagaacacagtaattgcctcaggaagtcagcaagacgaaacgcctcacccaagggaaccggcggcgggctgtggccttgctcgcgctggcctccgttcttcaccggcgtgcggcagccgtcggagggagaggcctcctgccaaagaggaaagagggggacgatgtgacaccaccagctatccaaccagcaacactgcacgctccggcgccgcttccgcctacctccgcgccgcgcaccggcgtgcgacggccggcgaggagcccaaacctgcacacgacggcgcggccacaggcagcgctgcagcgtttccacaaaagatggccctcgttatggcggtgaggggagaatctgccgggggcattttactactctctccgtctcataattaactattctgaatctgctgtcacctctatcgccaaaatctttttttttaattgaatccatgtcattacaaatttatctattcaaaaaaatgtcatcataattcatctattagcagttgtaccactaaaattttataaaattataatcatgccactgttgtcacctttttcattttcttttttatcttcttactacttgctcccgtcttctttcctctcctctcttctttgctcctccaacccggccactgatggagccgctactccaactcgacatcgttggccacgacggtgaggggttggagtcaccgacttggacgaggcaacgccgaggaggtggtcgagggtggcgtgtaggccagcaatgacggcctccttgttgcgggcgagctagacggcggtgatctcgtctgcgagaaagcgaggcgaaaggagctcgggcaaccagatcggcaaagagcgaagtggcatcgcagcagctgccatcgcaaccattgcttctactacgaagtcattctagaacttaagttattttaggatttctcacattcgtataatgcctagattcaccaccatctatataaatatgaaaaattctagaatgacttacattatgaaacggaggaagtacaataaacaacatcggagtggggctcatttttccgagagatgttcctttcattaattgattaattcccccgtatacccggattattgtaattagtattactcctattgttccatccagacattgtagaagcaatgcattgatgcatgtggaacagtctactcaacctgcttggacgctgttgtactccgactgcagtttttgccatctttttcaaaaaagaagaagaagaagaagaagaagaagaagaagaagaagaagaagaagtggagtcaaattctagagcactgtccacgaccaagtttaatttggggggaaaatgtctgaagatacatcattgcatacacttcagcattcaactacaacggataacaagcaccatgctgctggacaaaagtttcgactttccagttaaagagcatcagtagtaacaattttctggggagagttggtattgtgcagtatgacccgcaggacactgcaactctcatcaacaaaatgctactacctccgtctcaaaagagaagcgcagccgtggaaatccgtatccaacaacgtttgaccattcgttttatttaaaaaatttatgaaaaattttaaaaaaattagtcatacataaagtattattcatattttatcatctaataataataaaaatagtaatcatatttttttaaaataagacaaacggtcaaacgttgaaaataaatagtgtaaaacttcacttattttagaacggagggagtagttgtcataatgtcatatcaaatgcaaacatcctctactaggaaaaccattttttgtcgaatatgaggatcaaatcctccacaaatccttattatccttttgcttcaaaggagacctaagcctccaagtcatccctttcctctacatttcaaaaccctcatagatcctcattgcacatagcataatactgccgcacaaacaagaaaaatgcactccagtacagattaatccgacccggcaaaaaaatggatcaggtaaatttacagcaccctcccctaacattgcatgctgaagtaaaccccactgttaatccatttgagccaagatcattcatgcagataacactagcaaatgcgaaagtcattcacctgattctacccaaaaaaaaaaagaaaactaagagatgacctaggcagcgaggaagctacaggatacaggagcaacaggaaaaaaaaacccggaataaggaggattaggagcacagagagcacgcacccaaggtgaccggaggagcgcgctccgcttccgcttccgacgacctccgcacggcggcgcgcgactccggcgagatcgagatggcccggaacccaagcagaagcagccgtggcaccagtgaccgagttgtgatgggggacgcgagcatgagccacagacaagtgggtcccacatgatgaaggcgcccgcatgtcagtgagcaaaccaaccacatcaactatagtgggccgcacgtctccagcctaaatatttttatgggccgagaatttccgttctcattccatgggctgatttggaattttttttatttttaatttttttattaaaagttttacaaaaataatttttcattttgaaaattgacagaagtggtcgcctaccgtcctctgggagggcgatttttaaaaatcgctatcccagagggcggcgaaagtgacgtggcagacggccgttcgctctcgggcgacggccctcaacgaaatttgcaggcggcccccttgccgccctccgctagggcgattctgtggcgtccggggggccgcctgcaaatgggcggcggggggcctggaattttgcaggcggcccccttgccgccctgggggagggcgattttatactgtgctttatatttttgtattaatatcaatagttatcaaatctttttatattgaaaactatacaagattaaaatctccaagactggtaaaatacaattttattatttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggcaccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttaggtaaccctaatggattgttcctccagtctaagcttgagtattc

SEQ ID NO: 49541 - DNA, 971 bp, Oryza sativa
tgtttgattaataagatgcagctagcacaattgtactggttgatcatacaatttactgcaaaatgacatggcagtgggtatagccagctgctagctatactattgaccttgctctaagtgatttcatcatctaaacaccagcacacatcgcggttggctaggaaagggaggagccaacccaactcgagagtcaggcagtggggcaccaggctgattcacaccggcgcctcgaatcgaagcggcagtggtgcttgggggagcgatgacggctgtccactgccaggcttcggctgaagtgcagttgccaccatatcatgcgccgccacgaggaagaaaaattgacactagggaatcatgggggagctacagacttattccagccagccacgggaagacaatgctggtgacgggatagatcgacacggcggtgtacgagagcgcgaagaggagaacatgtcgccaaccacgcgcgaaggagtgaagtacgatgtattgggaggcagacctcgtccctagaagtggagagcaaacaatccagaatcgggatttccaactattgggagcttcgctagggactctgttggagtcattttttgaacaaaaatctgattggaaatcatatacagacactattggtgatgctctaaacaacgtgacacttaataatagcttgtcaagtagccttcttcctggaataatgctatctttttctcgatcgcttcgtacgtgcctaccacatagctgttctaagagatacttaggttgtgttcttcccctattttcccaacccacatctctcatttttcgcacgcacgtttttcaaactgttaaatggtgtgatttataaaaaactttctatatatgaaagttgttttaaaaaaaatcatattaatccatttttcaaaaaatatagttaatacttaattaaccatgcaataatacgtgctttgttttgcgtgccgggaaggaag

SEQ ID NO: 49542 - DNA, 1294 bp, Oryza sativa
tttttgagtatgaaatcagtatgatgaagttccaaactaagcttcagcttctacccagaaggttccaattgcattcactcaggcaaaacaaaaggccaatgaacctgctaattaaaaagttaagccacagtcaagaatctcatcctgtgcaatgctttgaaaataatgtctacagagggccataatagtgaaggatcatgacagttgaagaacaaagggaaaccaaaatctatttaaaaaattcagtggacttttgacatgatcaacactagtagatcacatggtaaatggtctttacagtttaatttggattcaattcaatgtttgcatatctttaaagcaaatccttgtgtatgtacaacattccgttactcaaatatactgcattcgtctgtaagtgaatcatttcggacattagtgtctccacaattaactttaaccattagtggttacatgcatatgttaacaaaagattgaaagtttcaaatactatgattgatgatattcttttataatgtatacttctatatcggtatcattttcatgcatacaatattatggacatgctaatgctcaaagttgggctccattggtagatgccatctggactgaattgaatggtttcacttacttaacaggtagctaaacctaacagcttcgcaattttaaccctgactatgggtaccatatcaagttattactcttggcaactttaaccgcgactatgaacacattttcttgttattgaaagcacaaagaactgagattagtgtgtcgttgcatataacgtgaaaccatgattaacgatgtgagtaccaatggtccaatgaagaaaattgtagctactctgggcagaaaatagaagataggaaaggtgagtggtaccaaataaagcaaggttctctcagtgtaaactggctttcttgaataacagacggaggaatgcaagtaccaacaatatcctgcaaaaaaaagcatattgtgaatatcagtaacaaaacattacgacttatatcaaatacttgtatataacactgtttcgtttatttgtaaagtaaataggaggagggaattggcaaaatctatgtaacatcgaatatatagtcaggttatttgtaccccatggtattgtgcagcataactggttaggtattagccacagggtaattagaagaacaccaaattcttttcagattccattagaactaatactagatagcccatctatcagttttgcagtctccatcgaaacaaacaaatgtcttcagtaggtgtgtgaagccactaaacactc

SEQ ID NO: 49543 - DNA, 1532 bp, Oryza sativa
agtctacttcccctccatcttccttttcttttccaaaagggtttaattaaatcctttttcctttagaccaaaaatctaataatcttagaaattcaatatcttcccaaccgtaagtccgtttgactctgttcaacttccaaaattcctcgaatctcgagatctatctaatggcacgctgagaggtcattaatagggccttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctataattgaacttaattatgttgcttgaaaaatattatgcattgataggatcacacttaatctgctgtcccgtctgcaaggcagattggcggacctacctattttgttgcattgatccttcctctgttaattgctatatcatgttcccttgtaaccacatagtcgtgcctcggtaatcgtgcactctgcacgagtatcgacggtcgccttcaaacttaaaatctgaaaaacatattgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggatcgtttccttggaatttcatccgaacataagacaagtacgaccacatgggtggaatgggacacccctggctgagtaactagcttatcaggggagccttgatgccgagagacatgtggattcaccggggtggtgtcggggaggacccccgggcttcctggcacagtatggtctgggacctaacctgttgttggtctgggacccctctcgtcggcatatggtaaacctgtgtcggctttcgaaaatgccttgtcatgaaagcttggaggtctcccgacgtggctgatccccacgggctgggtgatccaggttagtaatgtcgtgtgggtaaagtgtacccccctctgcagaggttaacaaactattcgaatagccgtacccacggtcatgggcggatgtgaggtgattcctagcgtagttttgttttactactgcttgtgaaattgctgttgtggaaaggggatcgatgtttggaaaatctgcagctgatgggatcagctaggctcgggtggccgtttgaaagttgtaggcccgggtggccgtttgaaagttgttggccgggtgccaatcttgaacaattcaaaagactgatacattgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttctcatggcttgctgagtactcccgtactcacccttgctctatataaataatcccccccagttgctggagaagatgaagcggatcccgctgacgag

SEQ ID NO: 49544 - DNA, 1702 bp, Oryza sativa
aaaaaatatataaaaggtttttttatagacaatatggctcaccaaaaaaaccttcaaaatgattattttcttgttttagttcaattcaattcttccatgaacaaaagaaagaggaatccaaattactcatgaagcatcaaggttaactaagctctggggagctttggtgctttaattttttttcccaagagaaaaactactgtcaaacatttgacatgctcaaaagtttcaaggatgggattaaacttgtgttagtggaaattactaaacacatgtaattggaaggtgaaaaacaagaaactgttcaattattgaagatttgtgaaacttgtccgattttttttaataaaacgaatgaccgaacatatgtcaaaaatgttaactgtcttatataaaaaaatatagtttatataaaaaaatgaagacagtataaaggagtataacacagataatgtttcggatgaaatcggttatattaaaacctactgggaattggcgagctgagagcgattcggagcggcgtgttcgtacgcagaggcatccacgtcgcccgcgagcgctgggaggcgggcggaatccgcgccctctcgtgcgtccgcgccgtgcagctcccagccgttcgattcgtcgcagcgacggctaagatcgatcatcgtcaagagtgtggtggcaatttttcaaaaaaaaaaccctccgttgcattgttaatgtgtttagaacccagaaatacggtgcgacgttgtggtcttttacgtataagccctccataaccaagaaaatcttacatgaagaagagagaaatctaaaaataggaccgcgctctgaaaaacgagcatcaaagggcttttttgaaaaacaatatatacctataccccttcccccaaaaccctagaatcattgctttccttcccctctccgccccattgacgccccgcgccgccgctcattctccagcaccaatcctcgcccctgtcggcatcgaaaacgagggaagtgcgcgtgctgatgtttaatcatgcgatgccaatgatgtaagcgcccgacactgccgcgccctgctgcccgtcctccattacctctctctctctctccttgccgttggttcctctgagctcaagctcgatggtgagaggctgtctccgtccgtcggcgacgagtcagtctatctggctttcaatcgggttaggtcttcgtcctctgcatcacctcgtcgtcgatttacctgtctccacaatccaagcccattctgccttcagatctggtgacggctgccttgcagtagccggatttggcgagctcggggggagggggaggagcccacgacgatggtggagctgaagcggatgacagccaccgtggtggtgtagactgattggcccaggaggcggacgcctcgagcttgcgagaagatggcgtcggcacggtgttctccaaggtgggggtccccctcgcgcctttctctcgcctgctttagacaatcacgagccgcctcgcatcgcctaccgccgccgctgcatcctccgtcctcccctcgctgcttcatctggtgccgcctcccataatccagaggagggctccatatggtggtgcagcgcttgatccggagcagctctgatgttggacacgatggcaagccaagggattttaccaccagcatctcctggccaccctcatcacccccctgctgcctcctctaccatct

SEQ ID NO: 49545 - DNA, 925 bp, Oryza sativa
ggttagagcccgttggatgcatgatcggacggctcacaccccatgcaatttctgcatgtgaaacctacctagaacgcctattcgggaaactcttctcatcacggtaaattcagcaagttcaggcaacaattgagcatttgggccagtgacagcacaccattcgcctgcgtgctagtattagccagtcaatgtacagcgatggccaaaaaaaagaaagaaacgggagagatttttttttctttttagcaactgctgtgtgctgcttaaaaatggggctgcgaaaaacctctcgcggttagcagcagcacgcacgattcaggaaggaaacggccgcgtttgctttgctgctccccataactccctgcagtttaagcccctccaaaacggcgctttcctgctcctttttcttcttgtttcttctccttctcctcgtcggcatcctggtcatcgtcctccttttgctttggagactcctccccctttccttgttgtctctcttgcgggatctctacgtcagagctctcgcacctctctcttaagcttttcttctctggccgatccttgaagcaagacgccggtccatggtcggataaggatttcagactgctgccctggtgccgcgatcctacaagcttgtgtgagttatctttcagtggcatctttcatgtgcatgttttttttttaatcttctttgtttcgatttcatcttttggtttcttgtttcctacagtatgttttttgtgtttgatggattgaatagttttttagtttatttcgttgaattatttggtgtttgaatatgttccgttcagatgaaaagtactgaattgtgcagtgttgatgaagttttgttttgctgattcgatgcttctcggttcacaccaaaatgttcctaaaatggttggaggctggaagaaacagatgg

SEQ ID NO: 49546 - DNA, 8959 bp, Oryza sativa
attaaaaatacttccttagctcaaataaatctcagaaaaatctaggaattatagaattaagcaaagtatttaatgaaattttatctggccccattttatattggaatttatttttaaaattagatcttcttttcaagacttttaaaaataaattctaaaaattccttttaaacaacaatttataaattttgaattttcaaggtgtgacacttgcccgatggtactccgaacgtgcacttctctggattgagcataaggcgatatcgtcggaggttgtcgaacgtttcccgcagatcgtcaatcaatgagtcgcttgtcttggtcttgacaacaatgtcatcgacgtaagcctcgacattgtttccgagctggtcactaagtgcaccttggaccgtgcgctggaaagtgtttcctgtggttattagtccgaatggcatcttaacgtagcagaataccccgaacggcgtgatgaatgctgtcttatcctcgtcctcttttgccatgcttatttggtggtaaccggagtaagcgtcgaggaagctcaacaactcgcaaccggctgttgagtccaccagttggtctattcgaggaagaggaaagtgatccttgggacacgccttgttgaggtggtgaaatcgacacacattctccacttcccgttggccttccgtaccatgactgggttggctagccactctggatggagtacctctctgatgaaaccggctttgagaagcttgtcgagctcttctcgtatggcttgttttcgatatggtgcaaatctccgcagtttttgctttattggcttggcatcgggtcgcaccatgagtttgtgctcaatcacctccctgggtacccccggcatgtcggacggctgccaagcgaacacgttagcattgtcgcggaggaaggtgatgagcgcgagttcctatttctcgcctagtgatgccccgatcttgacggtcttgtcggggttggcactggagagtggaacgatcttgattgcgccgtccggcttcggcgtcttgtttgttttgctcactttcttgggtggctcagctgtggcgggtaggctgggcgtgtgctcgaccatgtcgaggctccacttgtcgcattgtactgccagcttagcgttcccttgaatagtgattgttcccttcggtcctggcatcttgagcacttgatacgcgtagtgagatgcggccatgaacttcgcgagtgaagttctcccaatgatggcattgtatgctgtatcaaattcagcgacatcaaaggtgatctgttccgttcggaagtagtttgcttggccgaaagtcacaggcaacgtaattttgcccaatggtttggacgatgactgaggagtaattccatggaagggttgatcggtgggtgtcaactcgtttcgtgggatccccatcgcgtccaaggcgctggcgaagagaaggttgattgagctaccgccgtcgatcaggactcgtgcgaccttgatattatgaatagtgggttcgactacgatcagatattgccctgggatgacagcaatcttggggtggtcctcttctgagaattctatcttctgctcggaccacttcatcttgggcgcagccccctgccacgtcgaacagacttcacgttccactttcttgtattctcgctttgaggagtatgccgtggaacctccaaagatgtgtgagacatgaagatcggaatctgggtatgctgagtccgattcctgagtaggcgcctcagcatccttctcaaccacgtgtactcgcttgcctttttccgatgtcatgtgttttgcgagcgactttttgaagacgaggcaatcttctagagagtgtctgtccgacttgtgtatagggcaccatgctttcttcgtatcgctgccttgtgggtctgggcgcttgggagggtccgcgtattctgttgcgagaacttccgattgagctttccttttcctactcttgcgaattttcttcttgcttgactcaggtgcatccttggctggtttcttctctcctccagtcttcggtttgtcgttcttgcgtctcagtgcgtcatccgcatgagcgcatcgatcgacaatttcgaataatctccgagtagtcgtgacgcgcctcgttgccaactcttgagtagtatagcgatctctgacactggatttgaaagcgcgaattacagaagcgtcggtgatctcggggattgtgtttctgcactcgttaaagcgccgaacataatccctcaaggattcacccgggttctgtgtcaacgcatgtaggtcgtcttcgatcgcgtggcgcttgtaagttccttggaagttggctacgaactgctgccacaagtctgcccacgaagagatcgagtaggggggagatgcatcagccatgaacgtgcagagcctttcaatgtggttggcaagtaattcaccaacgcattgtcgtccgctccggcagcgtagagtaccgtggagtaaaccagaaggaactcttctgggttggtgctcccatcgtatttctctattgctccaggtcggaatctttcaggctatcggacatcccgaagtgaacgatcgaaagctctacacccagcgctggggcggtgggttgtcggcgatcatacgcccttcgtggatgtctatctgatgatgaagatgaggaagatgatgacgatgacgatgggtcgctcggttccggcgtgcggttacgaggacgtcggccgggttctcgagaaccttgttgtcgtcgccgttgttgtctcggcgccgatctccatcatcgtcgtcattatggcgacgtcctcgaccagtatcgcccagcacccgccgttcgtgatcgtcatgatcgcagcggttgtggcggttatcatggcctcggtcttcgcttgaacggcctcctcgatcttcgttatcgtgacgtcgtgaagagatgcgatgttgagaacggttctcgttgtcacttgtgcgtcgcgcctctcggcggccattcaggtgatcgcggagatcgccggtgccgcgaggtgaaggggtggctcgatgaggcaattcccggtgttcaggatcttcaccattagcatcgccagttggtggctgttctgggtgcactgcagcagcggcttctttgaacgcgttgctgaggttggtcactgattcccgtagtcgttctgtccatcgtgcgagatcgtcgttcagaatgggatcgtagggggtttccctcagtattgcgttgacggctctgatgtgctgggccagtgtagtcgcttgattttccgcttccgcattggtgcgcgctgatgtgccgacatcgtcgatagccaatacctcacgcggcgtactcgttgtcgatgatccatagtcttcgagcaggtgcaagactgatggttcgtggggatctatgtcgattaccccaacgaatcgatctgaaatcagcgtcgctccttgttccttgtgttcatccctgatggggatgcgtgactgctggaccttagaaggtggcgtcttcatggcgctgagaaagaccttgcagctcgagaggttgtgattctttgtcttgtgaattggacaatagacatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacgatttcgccgacctgagtccacaccagtgttgttgaagtagcaactccttggttgaggttggtgttgacactgttgtcgacaaaggtggatgtcatagtagtagaaccttgagcaccaagtccacctacctggcacgccactgtcgacggggaatacccgtagaccggatatagagggtattggggtacgctggtacgaggatctacgtagtacgacatcaagcaaacaggaaacagagattatactggttcaggccccttggtaggtaatagccctaatccagttgatatgggattatatgatgaaaaccacagattacaaagggaacagtggaactcgacgataccgacaagatcgtagtcgagttgatccgactagatctcccggcgacttggctccgataagctccggcttcgtaggctgtggtggagttggctctgagattcgatgccttaggtcctcctggggggtcccttttatatcgcaggtcacctgtctcccagttggactcggagagactggaccgaacacgacacaatgacgacccagttctgaccgagtaggactccttccatctgtgaactccatgatgaatttccttaacgtatgccgaaaacgtccgtatacgcgtgaacataccatatcgatacgtgacgtatatcgaagggtagagggtataccttacccgtaaccctgacacagcccactgcctaatttgctctttagccccacaaattttcaagagttggacattggcagtcacataattagttccagagaacacttctgtgatatcattgaacaacttgagcctattaactacctctacagcaaaagcacattcatctttactaggggcacaatcaaagagcttctcaacatgttttgcacgatcaaaagcatgtgcataaggtaaagcaatgctaagcatcttgtaggtggaactccacctagttttgcaatcaaggcctaacttgtgatccattttaactttaacatgcttagcaatttcatcaaatttctctactctcttaggcgtggctgtccaaaaagcaacactttcacggatttttgcaattgaatattttatcacctctataccatccttcacaattaagttaagaatatgggcagcacaacgcatatgtgttgatgtgaaaaacacgaggcctgggagatctgcttaactccagtgcaggtccaaaaatcttgcctttaggttcgtgagcgtgccagttgatttgatcatgcaatcaacaagaaataaagacaggaaaatagcggttaaatccataaacgatagccgatcgaccagccgccgatgacgtatcatttgtctttgagccgatgtcatatttgaatcgatcggcaatcatgaataagtaagaaagaactaaatctacttgatcggctgtagatattaaccatatataattcttatgttgatatatacttaaatcaagtgattgggatagatcggtcaccatgccgagacagtataaatcacttagatcgaaatatataataacaatgagattatagatgttcatagcatagccgattagatagatctagcatgtatcggcaacaagatcttaacataaagggcggatttaacatgtcaatcaagcatataagacatagagtagttaaatcaggtaagatcggctgaaaccccgacactaccctaatcggcaaccaaaagcaggctagaaattgagattttaataacgacttataaggtcaaactcaactgatgcagctataaatatgaaaagaaggacaatatctagacaatcaagctgttggctgtttcatagagtggtagataccctgtataatctaagtcaacatagatatttaacctgattggttgccttccaataatagatgttagccgattgaaggttagataacgatattgttgaagattatacataatatatgataattcgacgaattacataaacaagattagagtatcataaagatggaagcactaatcccgataacgcaacccgccataacaagttttacatctagttgaagatcgaaactgatgcagctcaacccgaaagcaagaacttgtcgaaaaaaaacaaaagtaaagggtggcgatgcgccgagattgtattgaacgtgtgttgttgtattacatggggctcggggtctatttatacccgagattacaaaatatgtccatgtcggacacgactctcatctctaacaaactctaagataccataagtctttgcggcagacttttgcccaaacttatctctaaggaaattacatgaaataccctaattaatagatacaattaccttttcaggactcaatccatgcatggcaatcctcatgaagcacattaactcaacccgacaacgtgtaccgaatcacattgtcggaatcggcttaatcggcaaccttgtccgactcgaactctaccgatcctgatcgtagccgattcggacttcagccgattcttgctccgcttctggaacgatctccatcttggattccgcttcgattttatttcatctccgatacctaaataaccaaatttggtcgttaacaatatgcaacaattttccctccaacatcaacttagacttgccaatcttcttcccaagttcagtgattaccttgtcattcgtggtacaattatcaagagtcaaggttgagatcttctcatcaagattccattccaccaatgcttcataaagttgttcacatataacttcagttgtgtgtggagcaggcacatatatgaacctatacaatcaaagttaaacctagattaaattcagattgatgcaaaaatgaaatctaatgtcatgctgaattaaatatgtagcagtaggaaatgaaattaattgttcatcaagtacctcatgataatgcttctaagtgtccaagaatcatcaatgaaatgggctgtgacagccatgtaccctcttttttggttatcagatgtccacaagtctgtagtaatagccactcttgacttagttccagccatgtaggctagggctttcttattttcttccatgtaatagtccataatgtccttcctaaaaatgcataaatgttaattttttcttcttaattgcagatatttttaatagacaactgaaactaatagatatcattattacctaatagtgtttcgagtcaccatcttaaataatggctgaagtgcagtcacaaacctttgaaatccaatatgatcaacaatagataaaggatactcatgtagtacaatcatggcagcaagctctctcctagctatttgtggatcaaatgtgtacttctccacagatatttttcctccctcctgggaattgaaccttaaagaagactgtgcaagtgtcttgttttgtcccgccatcttgatctttttcaatgtgcaaattttcaaatggtcatggagatgtcttgttccattactgcttttccctccaagccgcttgtggcaatgaaggcattgagccttgactttaccacagatttttactttcttgaaatccttccaaacgatagaagtaagcttcctcttggtgccaaagtccacatcctcctcctcagcctcatcttcatcatcatcaccttgtattggctgagaatcattaacactctcatcgtgaggtggaagtgattgcgagtcttgctggcttctattcgcactacccgcagttgacttcgatgtgaatctgagaagagagaaataaattcagttcaaaatttattcaatggcctagtaacatactgaaatccctttacaaagctgtgaaagcaaatttaaagttcagaccatgttgacgcatacctgcatagcactataaatcaccaaacaataatgcatgtacataagtataaatatagaaaatatataacagtaacgtgcaaagaaatatcccttcaatttgcaaagaaaatatatgacagtaacatcaacaaatccatcatttagtacctaagagctgaaacattcagtacctaagtgcaatgcaatctcataagtcataaactccaacttacatattccaaattgttaaataaaagagctgaaacatataagaggggtagcgtgcttgaaatcgaaccccatggattttaatagacgaaggccgccggcaaaagatgacgtgtttagagtagtcggtgcagaaggagctccaacagctgcaagatggcttttcggcttggatgtggtccttttcaaaggaggaggcctgcgaagggcatttgcattggacttgcgagaggagccagcacccaacccgacgaccgcaggggctgcacccaatgcgacgaccgcaggggcagcacccagcacggcggcggatacggcagtatgcccaacattgggtgtggctgcggcagcgactactgctttacttgtatcacgtggtagcaggtccaaatccatggcagcatcccttcgcgtggaccgccggtcgtgggttagtgagtcaacaatgcagctatggaagacgaataactcgatggagaagaactagaggtaggcgtctatcgagcacagagaagggatgagggattgtagtatgctcaccttgcatcgtcgctgtcatagcttacggggggaggctgaagccatggtcaacggatggcggcggcgatggcggctcccggcggcgcggcgacggcggctcccggcagcacggcgacgacgactcccggtgaagacggctgcaggctggcggcgtgtcgacagaggcagccggtggctctcggtgaagacggctgcaagcgccgcgccggccggtgacgacggcttcaatctcccgacgagagaaggcagcgagtggcagcgaacagtggcgtgcacggctcctaggctcccggcggactggcgaacggcgcggcgcggcgcgcgtgacttgggtggtggttgctgtggatctggatgggtggaggtcctggaggatttggctttgacctgttgacttagggttagattatatatatgcatgttaaatgggcttcaatattatgggccaatacatctaaaa

SEQ ID NO: 49547 - DNA, 6007 bp, Oryza sativa
  unsure (1)..(6007): unsure at all n locations
cccccgtcatccccgatggtgagaggtttttaaccattttattcctcatggtgagtagatattaaccatccccgtcacctaatagatgaattcatcacggggaaacggtaaacgggcccccattgccatctctaggcgtcaatgagggtttgagctaaatgccttgtttagtttcaatttttttaaaaaaaaacatcacatctaatctttgacatatgcatggagctttaaatatagataaaaaaactaattacacagtttgcatggaaatcgcgagacgaatcttttgagcctaattagtccataactagcctaatctttttaaatatagatttttttaaaaaaaagaagtacagttctcgttgaaatattagaaaaaaaaaatctcgcttctatatgaactttaaaaaagaacacaataccatcaagacttagaatgagaaaagcatgggtaaggaagtggtgggtccggcgggtgtaaggaagtggtaggtccggcgggttggctcgcttgcatccactcagtggagcagtctagaaaggaccggtcaatcaatatagacttgtcacactgggttcaggagaaatcagacttgatcagggtggagtacatagtagaaaggaccagtcaatgtatatagtactaatcagaagatgatgctgtaacagtaatgtttcacaataaacaaaacaattattggtgcagaacatgttgctgtcgtagaagcataacaatacgagataacactacaactttttttttccggaataagacactactacctttttttttcgaataagacactgctacctgtataattgggtctgtttggcattgcagatagtagaatttatgggttaaaatcattttcgaattttcatatatccagctagagttgaagctgtgttcaaacagagccatcatttttgaatttaaaagtttttacagggaaatggtatttgattttagagaggtcatattcgaaagtttgtgctatgatagtgcagaaagtctttttccctcaaattttgtggatccaaattctttgcattcatgccatggacccatgcaagtgtcatgcatattctgatataatagcagtaatactggagttgcaaaggaacagagtacccattgctagcgaatggattaatatagtgagcataaagcaaaggagaagtctggtaacacgtaaccataaagcagtgataatcaagacaccatcatatcagaaggctaaagtaacaacacctaaccataaacatactctaagataagataactaatgtctactcagttggcaaatggcaatggcatagattttgtggccggcttcgcttggaaggaggtcgtcagacgcccccaagtccgagcatgccgtcgtcatcgtcgtcgacgaagtggtcggggcgccatttgcggtggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacctcatcggaatcagcaagctccttgaggttcttgaacgtgccgattatttcctgcacgtcctggcttgcggcgctcccggccgatggcggcggagtctgctccaggaggtccagcgcctctgcagctgaccatgcgatggccttgtacggcgtcacctgacagcaaccacatatccaacaaaacagataaagattcagatatatatatatatcttcttcttttcatctcaaaaaacaaacttcagttgaggcacgcatgtatgtatatggaattgttttacgaaactaagttccagcccatatagcccaaacatcatcagccccaaacccctcccagcccaaagaatttgccccataaccaatttcctctcagcccaaactgcatgctcgtacttcaattaaattgcatcagcctggcctggcccagaacaactcattggcccggcacgctcccctaggaacccatctcacaactgtatccacgcccacagtatgcccagggaccaacgggctgatcagttcggcccattctcgaaccctttccgatcaggccatcctctcgtcaaacagattccatcccccaaatccccaacgtctgtcctcctagcccaacaacgatcatcaacacggctaacttatacttactaataacaacaagtactttaagcataactttttgttttttatatttgcacaaaaaatttttttgaataagacgagtggtcaaacatttacaagaaaatatgaacatcccttgtattagtggacagacatagtaaatatttttccttcgagaaaacaaatggcccaacaaccaccaaagatctaccgtttcttcctccgtagttgctactgcgtacgctttgtttattgatcagaagagaaccttttttgcgaacaagcctgcacgatttttttaaaaaaaagaaaactttcttttcagaatgaagaacctacgtacgcgagaaacagatagaccatgtatcaacacaaccaacaagaacggtaaagaagagctagcgtgtgaactcctcgggagaaaaaagccgaaaagaaaagcacaacgtaaactccatagaagatacaaacaaacacagatctagaccgagagaaagaacgttgtaagagggccttactacctgcaggccaacgtcacacatgcatcaagtacaacatatatgttctcccaagcaacaagctcgcgcgatctcatgtttttaccgcaagagcagattttctcacggcatcccagacccataatcctagatctaccgtttgttacagcacgcaagcatcaacaagaaaacgaccagtttttttttccctccacgtacagatcaatacgcgcgaccgaaaagaacatttttcttcttctttttttttttgaaacacatcgaatcaaatgcgaggaaggcagaagtcagtcgagacgcacaccgcaaacatcgatccggttccgtacgtactacacatgcatgcagatgcaggtagttggaaagaagagtgcgtgcgttttctcaccttggtggagtcgtcgtcccaggccagccatggacctgggttagcagccgcctgtgccaccgtcagcctgaggggacggccggcgccggcgaagcgcgcgaccggcggcggcaggagacggccacggccagcaccaccaccatggccggcgcctccaggcaggcacaggacggggcacccgaggatgaacaacgacgacatctcgatctctcgttctcgctgatgaggagatatggccgggggtggaggtgaagtgcactactgcagtgcagccttgcgatatttataatcaggagccaatgctagggttttttggcaactatgggttatgcattttgcgagagtgttagaaaaagcagtcaaactttagagagatcacctttggctttggagtttggaccaacgtaccgtgaaatgcatacggtgtatgtatgtaaattggagatcgatgtagacggtgtatatatgcatcaacaagaaaacgactttgttagtatactactactattccatattaccatttcattaactgcatgtatatgcatgtgtatttcgacatgcagtctgtctttgtcccccgcgcgcgtacagggaaaaagggaagaccagagctgcaggcgtagacgccgtcgtcgtggtggtagcagtagcagtacgcgctgcatgcatccacggcgccgcgagcgcgtggactgagttcatgaaccgcgggtagagtagacgcacagaccgtgctagcctgctaggtgtatggatctttcaagctccggtgtatgtatctttccggtagcacaggtgcacccatccacacgttctgccatgcatgaagccaaccaaccaagcacacaaattccgtgggtccccctctctccctcccctggacaattccgtggattgtttgcgtgcgaccgaacagcagcctagaagaagcagagatcgcaaacagatcgataattacatgcattctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatcatatgtataaaattgatgttactagatttatcattaaacaaattatcataatatgcaattctttatatttaaaacattttatttttattgatattgttggtcaaagtagaatctcggagactgtgtcagaatttaaaaatgcttatattttaagacggagggagtagtacatatctacatccgatcgatatttgttgtttggcaagatacaaattgccttgttaagttcgcgaaaagaaaatttttgggtgtcacatcggatgtttgatcggatatcggaagtggttttcagacacgaatgaaaaaactaatttcataactcgcctggaaaccgcgagacgaatctttcaagcctaattaatccttcattagcacatgtgggttactgtagcactaatcatggactaattaggctcaaaagattcgtctcgcgatttccccctaactgtgcaattattttttttatctatatttaatgttccatgtatgtgtcaaagattcgatgcgacgtttttaggaaaaaaaatttggcaaactaaacaaggcctaactataaaatccatttagttcagcaataaataaattaataaagctacattaatttctttttcacaggagtattacaccagtagcacgaaaagcatgtagccaccatgacccatctactcgtgctgcttaatttgcaatctgcttcaggctattgcattgggtcggaaagaaaaggggaccacggaatatgtatgtcgtcgaggtcgatcggctttagcttgcgtggcacgctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49548 - DNA, 2350 bp, Oryza sativa
  unsure (1)..(2350): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgctcaaagaacacaagctcagtaagcactgaagaaagtaccgttccttcaagccgcccagctcgtctgagcctggatgaaagggcctcccagaatggtgtgaagaaggtgcctgctgcgaacacggtgaggaagccccaacggaagtctctccccaaactgccatcagagcaaacagtcactgaacaggtagaaaacaacacgtcggctacagatcccgttcgggagctgatccgtgcccaagttaccccggatgatcaatttggtggatagaaaagctaccaatttgagccgcccaaagaaacgcgcaagttatgcctcaacttcctatatttcattctctgctatttctgctgtaaaactgctggatatgccactactatgtactaaaattagtcctcatcaccaggagtttcgaagaacgcaagtagcccctgtaatgtttatcttgtcaatttttgttcttgatacaagagaggaggaacctactgttgttatttgtagttggtaacaattgcatatgaccatatcctatttcctaggctagaagaacttattatttccatatgaattaccctgcctttttctctttagcaaataagcaataaactttgtgcattctatcttgttaagttggtgtggaactttggcttaaatgatttctgttctggaagggagatgagagccttgcagttgctgatctagctagaacatacttggctgtggcttatttatttcacaagcgttgctgatacagtgatacacatgtacaagaagtaaacaagatcatcatgtaggctttgcaggctcattttacaagatcgactacaccttagctgcgtggtgctcttctccagattcatttttacaggtggccggattcagctgcgagccacggcgagggtcgccgggccggcgagccggcgacgtcgacgacggccggtgcctcgccggagagaggccgccgtgattcctcctcgggtgttcgttgcttcgtcttctttacaggcggcgagagatcaagagcatctgttcactcaagacgccgctgtgatggaaggaggctgagctgcccccatgaacggcggcggcggctgctcgccgccgtggtcgtcatcgtcttcctcggcgtcccagaggaagccggcgtaggagccgaggacgtagctgcaggagaagcgagacatcatcaagaaggaattgcctgagaaggtggcggcggcgcgtgggctcaccagtcgtcgggggcggcgtggacggcgcgggtgaagtaggcgtcggcgcggtcggcgtcgcgggtggtctcccagacgaggcccgcgtagagcgcgagggcgtcgccgtcgccggggttggcgacgatggcgcgctcgcagtactcctgcgccctcgccgcgtcgccctccacctccttgaggaacctcgcgtagttgccgagcagcagcgggttcgccgggtcggcctggatcatacgccggtagtgcgcgtcggcgtcgcggcggccgccgtcgcccttccccccgctgccgccgccgccgccgttgcacaccttcctcccgccgcctcctcccccgacgccctcctcgacgaccgccgcgtcgccctccctccccctccccgtgtccgcgtccagcccggtgctcgtcagcagccgccgcagcggcacggccgccccgagcacatcctcctcctcctcctcctcttcttcaacctcctcctcgacggagatggacgccgacgaggccacggacagcgcccgcggccgcgcactcaccgccgccatcaggtccccctcggacgtcgcgcggcacagcggcgggccccgctgcctcgccgccgccggcgacacgggcaccaccaccaccaccgccccgacatgctccgccgccgacgcgcacgcggcgtggccgagcagcggcgacgacgcgctccgcagcagcatcgccttcgccccgatctctcgtctcctctcctcttggctttctttgccgcgcgagagaaatatcgcgagcgagtgcgagtgagccactgacagggtggggggcgggggatatttatagggcccgcgcggccgtgggtgattggacgtttgggcgcgcacgtgacggcggccacggtggagggcggggagtgggcgtgatgggggtggggcccacggggtggttgtcgggtgggcccgggaggggga

SEQ ID NO: 49549 - DNA, 1626 bp, Oryza sativa
ggacggggacggggacggggagaggagtcgcggagcgacggacggaccatatgggccggccgctacgcgacggccgacgcggtggggccgcgcgggccgagcccgacatcacttcttttgtaccatttccactgtcccgtgttaaacgtagcagtgggtttcagttatcaacgttggaccgtcggttttgaaacaaaattataaataataattttattgttattacatgataaaacatgaatattactttatacgtgtcttaatttttaaattttttttaaataaaacagatggtcaaatgttggacacggaaacttatggctacacggagggagtactacgtatatccgtcctaaaatatactattagtacgcataccttcgtttcattttaaatgtagttatgggtatccgtgtctaacgtttgacctaaaaatttatgaaaaaattaaaaaaatagtcacacataaaatattatttatgttttgtcatctaataacaataaaaatattgatcataattttttttaaataagatggacggttaaacgttggacataatacaaactacaatttttctaggacgaatgtagaattggttgggacatttttagtattaggaaagtcgtccagaatcgtagcatataggttattactatatgattaacaagtacacatgaaacgagaaaagtttttactatatgattaattacgtattaattattacaattcttgaaaatgagtttattttatgctttagaaaacttgaatatatatattttttaaaaaataatacaccgtttagtactctggaaaacatgttaaaaacgagaaagctgtcgggcaaaaatgctcaaacaaacataccctaaaagagacatatggatgccagagacaaatctatatcctcgttaaattcctgaaaaaaaagtcaagaataatatttataggttctgaaaaacttaaattttgattaacgaagtcatgaacatacacacacacgctactgttatatatgagtatttctgcaagactgaactaacatatcttgagattgacgaagttaccacgaacgtcttgttttcgatggatctatcgcatattactgaaagaataattagccataaatacaagcacccgtatgaatgtggatgaactagtttcaccacaagaaacctaaccagttgagttagggcaagggcaataaaaaagccgactgcttactctaatatttatacacgtcatttggaggtaacttaatagataataaatataatagttgtctcttcacatttactgcagcacacatatcaataattatttaattacttctctctcactccttcccagcttttctctttcctccaagccaatcagggaagattattcatgctaatttcttgttccgtcgatggtgctgtcgataggaaggctccaagccagcgctaggtgcattggcgcccgtgcatgatcgtcgacagattaatcgacgatgtttctctctcttggtactctctctccgccacgtaggtataaaatccaacgtaagcttactattaaccggtaatttcaagttattgtacttggccttacactcacttcgtgttgggtagtttggtttgattgca

SEQ ID NO: 49550 - DNA, 14170 bp, Oryza sativa
acgtaactagtggagttgtaagtacatgactccacacacactaattcaagttagaagaatataatgcatatatgattgcactttcaataaaacttagcgagactaaggactagcttttaatacgaatttgttgagataaaggtttaccgatggtgttcgtctcttcgaacgtattgccgtgttggtttttccctgtttgggtatgtgttggtggcatattttacatgtatgtgctaatgtgcatgtagtatgagcacacagtacggtgcgtgcgcgcatgacagccatcgtttcacttatactgattatatacataaaggcttatcagcaaccaacatatactttgttaatagaacttctatatacatatgtatagcaatttaaagcaaatgctggaaataaaatacgataaaagccctaaaatcaactctaaaatcaaaatttaaaactaattttttattcggttcataaccgtcttaggataaacgataggtgtatgtcatgtgtaatcgaaagagaatggtgcaaaggaaatcaatgaaaatgatgatagagttatgggtgttacccatcaccaaagattaagggcccctttgaatcgtaggaatgaaaaaatggaggaataggaaaaagtaacgtaggattctaacaggaatgtaaatgaaaaacagaggattgcagaacgcaggaaaaacacaggaatgaccgtttgattgaaccgcaggaaaaacacatgaatggaatgagagagatagactcaaaggaatgtttccaagtggttggagctcttgctaaatttcctccaaaatctctataggattgcccattccataggaattttaaaggatatgataggattcaattctttatttcaaagggcttcataggaaattttcctatatgtttcaaatcctctaaaaatcttatgtttttacttcaaatcaaaggggccctaaattctgctgtccatgaatacatgttttgaatatgatttcagtagggcatgtgtagtgctttgtgcatgatgaaaaaaaaaaggaaagaagagaaagatagtgatacaaagctttcaccatctggaaaaaagagtggtacagctgggcctggtcgcctccccacctcacaagtaattctgccgcggtaaagatctgtttcccccaccgcctgcgtgccgtagcgtgcgttgccgctacgaaagtccccgcgagaatgcaaagatatcgcgaggggagagagagaaagagacgagccagaagcccagaattacggcacgcatcggccgaaactacgggcgccgtcgtcaccggccggcacacaattaaagtcgtcaaaaatatccccgctaactccggtcggtcgaaccggccggccggctggccggcagcgtcgccggcgaccggccgtacgtgtgcagccgttgttgtgtcgcgtcagtctcacgtggtactacctgctcttccttccagtatcttactccgtactcccttaaaaactcaacctgggatattaggacaataaatctgaagactcgtgttgatattcgttgccaaagaatacatcacattctattttagattaagcttttgtgggacggatgaagtatgcgtaaagctgagcaagcaaaacaattgaacagattgctcgacgaggacattcgcgtgatccacggaatcgtgaagagaatgaccgcttatgtctatcacggctggcatgaaccgcgttctaacgtataacaacctactttatttgaaaaaacaaattcaattctgatgatgagtttgaggagttaaaaaagcttgaggctcgcaagcagctcaagcttgacttgtcccagctcgattcgagctcgactcgagctacaaatgagccgaaccagagcctaagcaaaaactcgcgagctttaccgaaccgagctcgaacctctactaagcaaatgtgtatagttcaaaatgtttattcgctttattgatttaataaactaatatatcatatatattagtatctatttacacagcaaattagcatgtgttagcgtaatatatttatcttagtcattttctactcttttattagtgcgatcaaatagaaataattatacttataaaaaatttatcattaatatatatattatattattaatggctgaggtcgagctcgaaccgagcttgcctaaaagctcaaaggtgtaataggcttggctaaagcttgtgtcgagctcggcttgttgacagccctagttgccaccagctgccagagccaaataactcttgttttgcacgtttcgatgtctccttcgtcttcttcggagccgtgctgctcggcgccaacaacgatttcgtcttcacgaattgttaccccgctaggtagggctccctccatggatggaatgaggtgcaccgcaactggccgaggttctaggactagctccgtggtgatggcggtgaccgctcctctctgtcgtcccctcgcctttttctatggctaccaaccgttgatctgccatcatcgccagcgcggcaagctctaggcgagtcagagtcagcgcctccccgtgcagtggctccctctccctgttgttgtcgcctatctccactaccttctcaacatggttccccccgctctccttgctggggctgggacttctccctttcctttgcaggagccgatggagccatcggaaggggaggagggagggatagaagaggggaggagagtgaggggagagaagaggaagaaggtgagatgaagaggaagtcgctgatatgtggatctcacctgttgactcaacgagtcaatcgtgatcaacctatcatgtctgcaaaacccactttctaaaatcatcggatcagtcaatttgtattggatttgaaagacgggagatgtgttatatggatgcaattcaatgaggaggagatcagagagataaaaatagaatggaataagttcatctagggttccttaacttgtcaacaaatccgattttcgtccctcaatcgaaaaactagacacaacgggtccctcaactatcaaaaccggtgcagatgaggtcccttggcggttttgagggtggttttggctgacgtggctaatttgactcgatcttcatcttacatggcactgacatgacgcttaagtggcaatttgatccgaaaaaataataaaaccagtgggaactacatgtcagttccacacacaaaataataaaaaaagagggcccacatatcattctcacccctcttcttcctcttctctccccttctccctctccatctctctcccctatcctctctctaggcgcgacggagaggcagtggcgcacggcggccggcgggagaggagggagcggcacggcggcggaggcatggctccggcggctgtgggcggaagaggaaggggatgtggagcttcttttctctctctcggtctctcccctctccacgccattgatctctccctctcctacttaccgcagccatggcggaggacgccccagcaacgtcgctgccgccgccgccgaggggagccagcacgcgtcggctgtcgcggagggaggctccgccgccgctcccgcggcactagccaccaaggccgcggaggcgctgctcccgtcgctcagcatctggccgctgtcgcagacattgatttgattccaagatttttttttttgagcaagggtcaagacccccatttcttttactagaaatgatcataccagtacaggttcagccaaaagcggcaagcgatttgattcgaagatagtatcagcttagctagcagtggctagctagccatgagtagtagtggcaaggagaagaagcagatggaccggttcatcgtgatccccttctcctccacctgccaaatgctccagcgtggacgtcgttgatgacagcggcaagagcggcaagaagccccaaggttcgtcgtttggagtcttggatgcttgttcttcacttctgctcgatcttgtcgattggtttttgcggggtgatttaggagtttggtgttagtgatgctgtgtgcgtgtctaggcggcggcagtggcgagggcggcggcgcggcggagaacaaacccaagggggagtcgctggtggcgaggcttctccaccactgccagcacatggcgcacatcggctgggacggcagcaccagcaccaccaccagcctccgctcctggaaccacgccgcgccgccgtacgtcgtcgtcctcctcctccaccaccgcgtccacctcgttagccttggcggcgccggcgacatcaagaaggagtcggcaccgacggggcctgggttgtgcagctcctgtcctgccgtctgtcgtagccagggccaactccggccgtcccttcctcttccgcccacagctgccggagccgtgcctccgccgccgcgccgctccctcctctcccgtcggccgccgtgcgccgctgcctctccgtcgcgcctggagaggggataggggagagagatgaagagagggagatagagggagaggaggaagaagagggggtgacaatgacaatgacatgtggggcccaccattttttttattaatttatgtgtgaaactgacatgtggatcccacgggtttattattttctcgggtcgaattgccacgtaagcaccacgtcagatgaagaccgagtcaaattagccacgtaggcatcatgtcagccaaaaccaccctcaaaaccgccgagggacctcatttgcactggttttgatagttgagggatccgttgtgtctggttttccggttgagggacgaaaatcggattcgttgacaagttaagagacctcagacgaacttattccaaatacaattattcgttaaaaatgtcctgggcctatatgggcctagaatatgcttgtgctttgaaaatatgggcctacaatatgcttgtgcattgcaaggcctacagatcgttgccgttaagcccatgagttcaatcggctgaagaaaactcgaatgcaactagaatccttaaatgacccagcatccattttgagcgttgttgctgtaggttttttaaagtaaatttcataaaaccctatatattaatctattattatatggttcaagttacacagaatagaacttttaacatgtgacacatagtcttaggtattatggtttgatgaaatcataatcatgatcattttgactttgatctaccacattcttaagttttacaatcacattttaaacttatattacaaccactttgttaaattttgatataggagtgttaaattttgatataggagtaagccaaaatggttagtggtgtgatttttgttaaactttaggatcataatacccagggttatgaaccacgtgtctaaatccatatggttttgtataacttgaaccacaacagaccataatactccctccgtcccatattataagggattttaagtggatgtgactcattctggtagtgttcagattcgtagtactaggataagtcatatccacctagaatcccttataatatggtgcagatggagtaggtaggattttataaaatttaattattgttttccttgaaaatatgtagccagttgtgatatttcttcatataagcatgtatgagcttatatgggtgggcagaagatctcgagggttgtatttaagatttacactataacatttaaaaataaaggatttattttattgcactgattttgttctagttcaacaatttgccatcggttttatctccctgtataatatgtcattgagtttatcaaatttttttttacaatatgtcactggggtggatactttaaaaaataaatctcaaaatgtccttcaagttacaagaggttataattaattgacctactagaagtttcaagaaaatgaaaatttttacgtaacctccttacataatatagaaatgtgtgtatatttgaaaattttcattttgcatgtattaacttttaaaaagaatatataatttatgttttgtatgctaatacaatactcttatgttaatgttcttttatgtacatcatcattaaatgctatacattatttttctgatgcagctatatgttgtgtatttgattcctcttttatatgctacataaaaatagtttctttaaacgaaacatgaaagaaaattttacacacaaacttctatattttgtaagaaggttaagcacacaaaaactacctttttttgaaaactttttagtggttcaaacaattgtcaattcttgtatgacttgaaggacattttagtcatttcttaaaattatctaccacccaaatgtcatgttgtaaaaaaaaccaacaaagttcatgggatattacatagggagacaaaatcgatgataaatcgttgaagtaggataaattcagtggcttaaaatagattttatcttaaaaatatatattttgtgtcatttataaaaaggatgatgtatttgttgaaaatatcagaaaaaataaaatgaagcatatggaaacgaacccaacagctgttgaataggtgcaaaacctataaccagcgcaattgggcaattagtatatttttacgcttagattttggatagctacttccaaaagaaaatatggacataaaagaatggggcgttaattgattacattttagtcacatcacgctcaaagccccggcccaaacaaagaaattttccgttgattaaacatactgtactctataaaaccggatgttaggcttgattagtccctggccttccatttaatccccaaaaccttcacgtcacccttgcctgtaaaacgcttaatgaatcatatccttttgttaatcaagctgatcgagagatgggacatggaagacatgcacgcatgagctagactcctagagctattaataattttgttttggtttactacctcttgttccatattaattgatgttttaaacaagattaaggtcaaacttttataactttaaccatcaataactttaaaaatatttagtttaaaggaactagacccacatatatatatatatatatatatatatatatatatatatatatatatatatatatatatatgtcttttaaagcatgcatttatttattatatatattataatagaaaaataatgtcaaagatatatcttgtagaccatatcattgtctaaaacgtcaattaaaatgaaaccgaagggagtaatttgtgctaattcatctcagccacacgtgcattgattgtacaagtcatcacagccgaccatgatgtcatcggatgttcggtagtattccctctctctatagtagtataaccatgttaacacggttatcatgggatataaaaacttgtcaactttttggattatgataaagacaagagatggtaagtgtagtatatgtatagttaatttagtgggaagtcaccttttataattactatattgttatatttgtcataaattttgaatttgaagtagttgttacctccgttagaataattgtatttctaatatttaaattttgtaaaaagaatatttctaatgagacaagacctaacaaattaattttatgaagatatatatgctgtcgcctagcctcccatctctctatccaaatctcctagccctcattttaatcaagttttacatataaaaagtatgcatgcggtgtggatattaaatagggttattatagtcatttgtgtgttgctaatctgtctctaatttttttaaatataattattttgagacgtatgtagtatatatattttaggacgagggaatgcattatttttgactcaagatgatcctttctgagtagggctgtgtttagattcaaactttttttcttcaaactttaaacttttctgtcacattaaatgtttggacacatgcatggagcattaaatgtggacgaaaaaaaacaattgcatagtttgcatgtaaatcgtgagacgaatcttttgagcctaattacgccatgatttgataaagtggtgctaaagtaaacatttgctaatgacaaattaattaggcttaatagattcgtctcacagtttacaggcgaaatctataatttattttgttattagtctagtttaatattttaaatgtgtgtccgtatacttaaaatttttttggcacactgcttgcccgacagcaaggtacctgtcagcttttgcaatggttggttcaggtctctcaggttcagcttttgaattgatagtggcaagaccatgtaagacactgggagttcttcttttttgcactgtagctgtcttgcaattttatcgtttctccactaggcttgtgtgaagagttatcatggtgcttttggagaagtttaaatgtagtcctgtagcatatgcgaaaagctccagtcctttctttaggacgctagcatctctttccgttgcacggcagatgataaatgataagggtgtcatcagcatactgtatggtggcacaggactgctgtggtagattgcttgaattcttcattttgtctcatgagttgttgcagcacattagaaactaaaatgaacaagcagggagagatggagtccttttggcgcaactgaattttttacaatttgatccttttaaaaaacttatttcgcagatagacccctaaaaaaattatcccaaaattaaaaatggcgtggagggggggggggggcagctccagccacattggcgtgctccccctgccaccttagcgccgccctgctacggtggcaggaggacggcgcttctcgttggacgacgacgccagtgcctttggcattccaaaaaggcatttctagaataagttttttcaggagtttatttatgaaataagtttttcaaaaggaacaaattgtgaaaaatccggcttggcgcaggcccttcttgcggttaatccatttttccatgtattccatttaggaggtactgctgattttgatgtctgcagtatgtttgcaatccaagtttgccaaatttgtgggatgccgtgagctttaaggatcaattgaagctgtcccaacatcttttgtcctagcaggtttgtagtagctcagtggcatagatgaagttttcagagatatttcttcctttgataaagcccaattgatcttgatgaatcgggttggaatgatgcttttggaacccctgttagccaaaatgcatgcaatcttgaatctatcagatagctactttcttttctgaaacttaattaccttttcaaatagccaccctgtagtacagaaaattccaatgatagacggaaaacttttaatttcatccattatttccctagctatcaacgtatagacggccgggtaaggtcgttcatgcagtttacaagactcctatacgtagatccaattcgatcttatccatatatttgtgactcagatgaatagtcgtttgtcaatttgaatttatagaaaactttagatacatatcatatcactatcacatatcgaactatttctcagagcacatgctacacacatgcacatttaatggataagatatgttcacttcatactctacaaggtcctttgtttgtgcacattgcagggagatatctctactgtcttaaaagcacaatcatcatcttccctcccatcctaatctcatgtatatagaaaaccgctcactagatgtttggctattccccaacgcccgcgtcgctcgccccagggcgacacgggcggcgacaccgcgcgcgccgccacaaacttctcctcctcccctccgcctcgccgccgcccgagcagccgccggcaaagctgcgcggcggcaaggacggcggcggcgggaccttctccctctctcgagaagcgcggctagggcaccggcgggacctgagcaaagcggacgacggcgacagtgtccggcgccatctgggccggatgtggcggatccggctccgccggaggtggatctggccctatcgcggccagatcaggaggggcgtgccgctcttggcaggaggcggcgtgggaggcggcgaccgcgaccgttggtgggagggacgacggatccggccactctggcggcggatccagtccccctggatggctgcggccggcgggcggaggtggccgacgccgaggaggtttgtggcggaaggcagtggtgacggcgaccgacggagtcgagagggcggtgacagcagtcgacggagacgcgtaggcggcggcagcagctggtcggcgggaccggcgacggcgtgcatggcgcggcgcgcgcgagatccggtggtgctggaggcggggtgggagatggtggcagggcacggtggctgtgctggcggcggggtgggggctggtggcggggctgagtggtggcggcggtggagcctggtggtgatggcggcagcggagcccaagctgcggtgggcagccaacgccgcacgacagctgggcgtctgccttcccccgggcaagatgcggtcccctccaccggatttggggcgagagcatcatgcttcggtggacgttctagtgccgcatcgttttggacggcgggtgcactgtggcggatgggtcaacagcacggtgcggagggtggcatggcgccggcgaagcggtctggtggtccgaggtgacacggacaacggattcgtggcggagccagcggttactctgtcagggggagccacggtcctctcgacgttcaccttcctagacatatgtcctcttgcgacggcgactttgtcggcaaaagttggccacgtcgggcaggctagtgtgggggagagggcatccattcttctctctcaccctctccccatccaacccaactgcgtggatggagccggtgtgtgtcgaggttcgagcttccccatggcgattgactggcggcgtggcgccggtgcggtggccgtgcgtcgaaggttttcgctggtggtggctgcggagcgtgtaggagttcagttcttgggagagacaaattttgggcgaaagctctgccttcgggccggcaacaacgatgcctgtgggtgccgttttttcctcttggggtgttgccgcttttcttgtctctcccaattactttcttcatgtgaaaaccttgtcctggccctctgggacaggcgacagcggcacctttggtgtcgtacccttttcgaaggtgtcgtctcgaagaccttcagtttcgctcgtgcagtgggttttgttgtagatgcgcggtgtggttgtattttctttttctggtctgtggtcttccaggactatagattgtatttttctcctgttttatcaatatatgaaactcgcgctgtcttgtgtggttcgtttaaaaaaaatagaaaaccgctcaaaaaaaatgaagctgctataattaacttgcgatagatttttgttctaaatcattcaatttttgggccgtttgatatgctgagatttgtgtttgacataggaaaaaagtttcacgcattgtgattgctggaatcaaacccttgacccaacaattgcatgcgcacatacttcccactgagctatcttggattttgtaatttatgcttcacctggatcctagttacgtggtccgacagtttcttggagaattttctatcgattgttacagaggtagttccaaaaataatgttgactaaccgataaaaaaaatatgtgagaagaaaaaaaattaaaccacgttgatcagacatcgtcctagtgtgacgcacagtcgatgactaagtacgtactacatctattatgatgccattaattttttgataaccatattcatcttattcaatttttttttaaatatgaaagaattaagtcatgcttaaaaaatatttaacagtaaattaagtcacaataaaataaatggtaattacataattttttttaatataacgaatgattaaacatattttaaaaaatcaacggcatcgtatattaaaaacggagatatcgtataaaaatgtgtttgcctagtcatactcctcgaaagaaattaaagttctgtttcgacatgttcatatcctgaaatccataggattaatccctgccgttcgaattgcacgtcgatctccacaggacagccactcacatactccctctgtcaaaaaaaaaaaaaaacctgggtttgcgtgtccaactttgactgtccgtcttatatgaaatttttataattcgtatttttattattgttagatgataaaatatgattaatattttatgcgtgacttatctttttaatttttttcataattttttcaaataagacggacagttaaacattaagcacggaaaccagagtttgtcttttttttttattttttttggagggagggagtaggcgtgcgcactcgagttgcagagttctctcatcatctgatcccatggaagtgatcactgatcatccactggatggtgtggttgcacatcatgaacagaaacggcgacgtgatcacctgaacagaacggaggtgatggaaaacgacaattcaaggacgctctgttgattttcagctgatttctgcgccaatccgaaatggatcttgagcgctcgaggttatcccacctttacctcttattttctttaatatactttatccgtcccataatatatcaatctaataccgaataaaatcttagtataacgaattttattaacagatctagataggagggtgtccagattcatcgtactattaaatgtcagtattaagttggcactcccttcgtcccatagtataagagatttttgagggataagacactttctagtactataaatatatataaagagcttgtctagatttgtagtaatatgaagtgtcccatccctctaaaatctcttatattttaagatggatggagtatattataggacggaagagtataaaaaaatataacaaacataaaagtatactaagacataaatttatatatgcggaatcggtagccaagtcttaattttgttcaactttagatgacgaaatatctatataattacctgccacgataaaaaaaatggtttctctgtttcctttttgttttttatttttgaaaattgaaaaagaactctacggaagcaaatagtgcgtgtggggccaggctgcaggcagcaagaagtggcgcatgatcgatcagcctgtccaggtgaagccttgtcgtacgtgcgtgtcggtggttggagtttctgcccattatcaggtggtaataatggcgaatttatattagttatatctaactattaactgatatatttcgccagtccctgaatatttgacgcagttggttttttaaaacatatttaaccgttcgtcttatttaaaataattaagtaattattaattctttttctatcatttaatttattgttaaatatacttttatatatacatatagttttacatatttcacaaatgtttttgaataagatgaatggttaaatatattttaaaaaatcaacgacatcaaatgtttagggacggagggagtacttattaatatcatataaattagcttaaattgtataatttactagggatcatatgacgcttgataggattaatattgtaggctagtccatatggaaaataatccgggatcaaaccaacgacttacatggattaattattatctgtcctaacatgactatgaaagcaatgccgtccaggtggtggggccagcctcaacttcaatggttaggttagtgctctccttccacggattgaatgtgaaccattgcactactgctagacatcactatgcaattgtttgctaggataactttaattaccatatttaaagtgtatcggtttagtgtaaaattttaatacctatatatatatttctcgtactttctgaaagattgaaaacttctagtactttatcatgactatgcaagcaatcgcagtacctactacctaaacatctgatcacatgccatctaaggtcttattggttatacatgtattctacctgtaattatccccatttcataaagtctctaagagaaagacaaattaatttgaagactaaagagagagaattttcatgaagagtgtaatcgttaatgagaggaacacgtatactcatagtaaatggaaaattcaagtacgcatataacttaaccacgccttatctctttcttaatttcaactggcatttaataagtgtacagtaaaaatgacctaaattaggaatggcagtgagggaaatttgcaacaattacgtccttgagct

SEQ ID NO: 49551 - DNA, 11646 bp, Oryza sativa
gtacgtacttcatcaaaggcatactctctccgtccccccccccctaaaaaaaggagaatatgtaaccctaggtcgagttttttttggacggatggagtatgatttaatatgctgtgtctactaaattacggaattttcaccaacaaattcaaaaactagaaatttgttctcatgggcaagtcctttaaacttaagggagtcgtccatggaaattgatttccaagagcggtcgttatttcgcttgcccaaatcatgtgatttttacaaggccttggttgtaggcgggtctaaaacaccattgtaaacaggttcttgaccgccccgcacaaacttttttttaagcagtggtgatctatgaacggtgggagtgattgtatttgcgcaggtggcagtgaagcctaagcccttctctccactaggtgcagttactcattgtgacacatcttcatcactagttactgacttttatatcatcatgtaggtcgaaatcgttaatgagaggaacacgtatactcatagtaaatggaaaattcaagtacgcatataacttaaccacgccttatctctttcttaatttcaactggcatttaataagtgtacagtaaaaatgacctaaattaggaatggcagtgagggaaatttgcaacaattacgtccttgagctgaaaatgctagaccgtttgcaatatctcaatattaaacttagtttgatttttaggcacaatgacggctttactagtatcctttggcttaatatatgtgccaaatttctcattaccaattacttaaacttactttttaggcacaatgacggtttacttctacctttgtcttattgataatatatatgtgccaaaattcccattatcacttgtagagaaaccatctttggtcggtcgacccaaatccacagtagtcccggttccattaaaaaccggaattaaaaataatttttagtcccggtttataagaggaagatctttagtcccggttgttgttaccaaccgggactaaaaatcatctttagtcctgattggtaactccaaccgggactaaagttcatctttagtcccggttgattccatgtcagaccgtatcagggctcgaggatctttagtcccggttataacactacaccatgacactagattaccaacagacatctgtcggtaaagataaacaattattgatagactatttgttggtaaaggcttttggtaaattatatgtcagcaatactatgtaataagacatgttatatgttagcaattccaaatatttattgggtcaaaataactgtcagcaatattattaagagtggaaaccaattatatgtcaggaaaacttaatgataacctatctgtcagcaatgtttcgtccgttggatgttgatcccacggttaggatagagcgaggtgatcggtgcgcagtaaaataaaaaaagaagcgcaaaaaaatccgcgcaaaaaaaaaaaccacgccgaaaagaaaatccaccccaaaaaggaaaaccctaggctcgcaccgcgcgccgccatttctcccccttccaccgcgcaccgcctcctccgccaaatccaccgccgcggcgcgcggcctcctcctccgccgcggcgtgccgccacctcgctcctctctccccatccaccgcgctgccggagtcgacctcgcgcccgcccaggtttgtacgggctagggtttggggggcgcccgtccagatctgggggattgacttgggtgttggggttggtgttggttgcaggtggtggtgtgtgccgggtagaggaggaggaggaagcgagggcgtcggacttgtgcgtgcgcaggtccaggggcaggacgacattcgacgcggtcgccgacgaggtctcctagttcactctgcttgttgttgctgaatgggtagtgattatcaatactgatggactgcatttctcttgcagtttttccccttttgcctttgatttcttcggccctttcctttcaagttttgatacaaagaattcagaaactcatactatatgatgggtagtttcctctgtttagtcctgtatcttggaactcatactttatgatcaaagaattcagaaaaggatcatgtaactatccagtctagtatggactgtagttgtttctaactgctttccatagaaacttttgcaccctttgtggtataaagaattagaacaaatcataagattcttaagctgctaaggttaagtatcatgaccttcactagtaaatcataagattcctcctagttcactctgcttgatgttcaacagacctcatgatgcatgtgccccggaaatatattgctctcatatttgtaggattagatattcagtaaagttccagagtttcgctctgttttttatagtacaatgggtgcttttttgtctaaactgtgtgctggtaaatataaacgataaaaccatccagaactgagaaaacctagcagccgctggtgttgtgtttaattacatattgcagatgtatacacctctgcatttctaagtttgtattcctgcagttataaactcataatccgcttatactctgcaaacacatatatgaggtaagttcagtctggctgcagttaattaagattaaggttgaaaatacggtgaactcattttggtattgatctgtgaccatgagttcatgttgaatcctatatatgcttaatttagcacatctgttgttgtctgcatagtggtcttcatggcatatgctaattctggaagtgccaccgataaggtgtggccttgctctgttcatttgtcgaaattaagaactttgattctaaatgcatgctatttgttagaggctgtgtgtggctacaagtttctatatgtcctttgggcctaacagaggcattaatatctgttttgctttttggatcacttctcattccctgaattttgtcttctgacttttcagaagcctgagttctgaaaagggcatactagaaaacatctgttgctgctctttctgctagatggagtacataattttttttatgttatgttagcttgaatattgacctggcctcaagttgctatgttagctctgaattttcctagcttaacactgctaagtcacaagtgcggcattacaaacatttcagtaactgatatttataggattagatgttcaattaagtttcaggattttgctttgtttttaatgaagcatgatctgattttttttaccaattcatataattagatggctgagatttgttgtttcatgtaatgcatgcaaaatgtttgacttagaatttttcttgtagacaactcagggacagatggagtagtagttggaggtccaatattatagcctaggacacgaacaaatgcagaaaatggaggtgttgatgctaatgatcctcgaaatatgcccttagctggtgaaggtatttcattcgacatttgcatgtatcgttaataagattaaggtatatgaatatatcaagttcttatcatctcttttcatatgtaagcagaaaatgttccaggtgttaataatgtacagctacaaaagaaggtacacaagaagacagcaaagactaaccagcgagcaggtacttaatttgtacatgatgcaacatgtttttgtgtatatattgcctctctgacttaatttgccatgccttgcatctatatccatcatcatgatatatacccaatagttagtgtgcactttataagctgaacaattggtattgttttgttagaaaggataaccaatgcttgtagcctaaaacatctttcagatttactaactccgaaggcagtatctctactagttgcaaatcagatccttaatgcatttgtgcttttttacaacatagaagttctattgtttcctttctcatatatgtactgattactgactcatcaatagggtctttgaaggtgctctcttggtagttttacaggctacaattttctttctgacagggtctttgaattagccatttgctcttcactaaatttatctgttatgctattctaattgccatggactatatatattcttctgtggttctctgtacactagatatgtttactctgtacactactgatgattattcatttcatttactctgtccattattttgcaggcaaccataaaaagggctagcagaggtgctgtaaaaaaaatcaagaacctacaagaaccataaaagagatgatttgttttgtttttgggacctcaatacacctacaagaaccttagttacatctaaattatgtaattattgctatgtacttgaactcttatgtaatagctatttgagctgatggataactgctatataggaatactgctacttgatgggtgaacaatagttacatgatgatatgtcagaatgcatttgtgaacaatagttatgaatagttgaatattgtgttatgcatgtgtgtaacttactgaaaggtgataatccgtgttgcaaaatttggagtgatattcatccatatatatgctgcaaatttaatttgaggtatggttcataaaatggatgattggtaattagtatattttttgtgtggattactgactgattgcttgttagttcttgtgcttgccatcaatacattaattgtcggtaaatctataacacagtgacatgctatctgttgggaatcttcttaagtgtcggtaaaagtctgtctgttggtaaaactatctgtcggtaaatatgtagcaacactatcggtctatctgtcggcacagatttatctgtcgggaaagacttttgccggcagcacttggcctgacagaccttatctgtcgggaaacgttttgctgacaaataatttggcagcatatagggcctttcctgacagatatgtagtaagcaaacttggggcatggtgtagtgttagtaacaccaaccgggactaaaaacctatttttagttccggttgatgttactaaccgggaaaaaaaaaattaaaaacacactatataatccctattaccgatcctcttttcccgtccacacaacaaactcatccctctatctctttctccctctccaacttcttatctcttccttatctctaactcctaccttctctttcctttttttttccttccattcgtcacagcgaagcagacggcggccgacgaggcggcgcgggggtccgcgcggaggcggccagcgcggaggctcggggggccgcgcggaggcggcctgcgcggcggcgcgggggatcgcccggtggcaggcgaagggccgctcggcggcggccggcgcggcggcacgggggcccgtgcggctgcggcgaccggccggcgcggagggaaggaggggaggcggcagtggccggccggccggcttttcttttttttcttttttttacaatttatgatttatcctgtgatgtatttgatttgtgtgtgatgggaatctgtgatgtattttttagaatttgtgatgtaattttttacaaggaagatgttaaaataaaactatctacatcctaaaaatataacaatttgtatcaaatagaaaacattctagtgctacaaatttatccagattcataatactagtatatatgttctatctgatattatgttgatgtattataagacaggggaagtacacaccatccattttcacagggaaaatgagaagggagagaaacttaggagaagaagagaatactaatagtttgatggctaaaataaaaaaaagatgaaatggtattaagagatctagtaggcgctataacctaaaaagatactcccttcgtaaaaaaaaaaatccaacttaggagttggatgtgacacaatatagtacaacgaatctagattgtgtcccatctaactcttaagttggtttttttgatagagggagtagacatctaaaagctaaaaatttaaaaaaaatgacgggggagtaatgaactaatgcatgtatcacttgtgtacttgtgtgaagttacgacaaccaaattagggtgacgtgtcaatgataagaacaatgcattatcttcatcagtcacctttcctagacgtgccaatttttctaatgttatgtgtacatagacctaattaaatacttatttatttaagttgctaaatttgtggacttttaattggcattgatttgtcgatcgtgtcactagcttccatgtacgattgaaggcttattaaaagtcacgtcaaattatatgaaaattgttgaataggaggagatggcgaaggcggcgaacacgatcgcggcgaggaaggccgagaaaggaatcgaaggtacgcataccttcttttctccatctactcttcttcttctcgcgaagagtgaagttctgataatatgttgaatagggaattgagattgtgggagcgagagaatagttgtgtactttattaatcaatgcgattatacaggaatgggtggccaccatagacgtgatggttgggaaccatcgtgcccgttgtcaaggagcgccgagaaggcgaggggtacgacacaactgttgtgcgcaaccttcggttaccgatcccatcttttatatagatgtgatcatctatttatttcataacaataataagcggtgaagctaattactaagaaactgtctggttggccattaccgtattttataacaatctgtgattagatattttgacatgcgtgtttgcgttgttgccacaaacatgacaatattacgtttctgtaatataggtcccatatatatgttagtgacttataaaatgtggcatatatcttttattttactggctcaagtgtgatcaggattttgattgcctcacttttgacaagctcgaaaaaaagtatgacaaacctacgaaaccttagttatgaattatacaacccttaaaaccttaaaaccggtaactactagctccgtttaattttttaagatgttttgatttctttccgtatacaaaattaagtttacaataacatagtaacattttttctaaaaaaatcaaaattattcgatgttagattaaaaataatcgcaatatcttataatataaaatgaagcgagtactactcatatgaaattttatgttttctaattaaaaatatgattgatctatgttttctaataaaattaattataataacaattactccatccatcccaaaaaaaaaaacaaaccctggattttcgtaccaacatttgactgtccgtcttatatgaaagttttttataattagtatttttattgttgttagatgataaaacatgattaatactttatgcgtgacttacctttttatttttttttatatttttttcaaataagacgaacggtcaaacgtggtacacggaaaccagggtttgtcttttttagacggagggagtagattgtaaaaacaaaccctgagatgaactcggttaattaacaaatatggaaccagaatccttctaagcttaaggctcaataaatataatttacataattttatttttatcttctaatttgtaaaattttatagtacaattttaatagatatcttaggtcaggagaggggctccagcttcttgtatccacgcgccccgaacagatcgatcaatttagcagctgacagaacaactctcgatttgtcaggcaagtgtttggatcaataaaaacgttagccactgacttcacacgctaaatcaggagaaagcgtgcacgacagcacgagagatatagctagaattcattttaattatattaatacatacttcctctgttttataatataaaactttttagcattacctaaatacatataatgaatttaaacacatacatatgtctagattcattatcatttaaataaatgtgtgcaatgctaaaaagtcttacattgtgaaacggaggaagtaatatactaggtatactcacgcaaacgcacgcgattaacctagctagctagcactgacaattaataaaacagttagagcaagttggcacaggcactactgtttaattgtattttatacggctaaattagttggacgaggtgtattgcgtgagtgatatctgcttccagcttcccagcaattcgccagcacgtacgtttttatataagccatggctttagaaaagattatctatatgtgcgcatctacaattattaaattaagcacattcaatttagttagagcgaaaaaattcagtggtcctgtaggcatatgctaaaatgttggaatttttttttcatatcatgatttacgcatattagatatccatccgcagaatagacgtacacgtaactgaataaataaaacttacattatatatatatacctaaaattgtttttaagtgtttttggtaaatatacatttaagttaattttattgaactagacatatgatgggatcgatctaacttcgattttaatctattcactgtggtactgcctgcatggtactgcctgcattccatattactactccataagccttttttaagtttatcccaagtcaaactttttctctaaggtataaccaagtttttttaaaaaaaaggaatatttttaatataaaataaatatactataaagacgtatttaataaaacttattaatttgatcttatagacgttactacgccttttataaaactcattctaaacgtgaagaagtttaatttaggacatacctaaaacaatttttatgatacggaatggaacaatttttagctgcactgtaggtgctctctccagtcaaagacaacagtgtttcagttgacacttgatcactggtggagaaaccatatttcgtcggtcgggctaattccacaatagtcccggttgcaacaaaaaccgggactaaagatgatctttagtcctgattaaaaagggtaacgggcatatttgatctttagtcccggttcaaatgctgtcagggcctgtcaggcccccccgggatctttagtcccgatcgtaactttagtcccggttggtaataccaaccgggactaaagatctcggcgatctttagccccggttcataacaccaaccgggcctaaagtcccacccctatatatatatatgtcttcttcctcctccagcccgagcaagcttcaaaatttctttaaaaaagaggggaggtcatgccaaaatttctagtgaatttattttggtgattatatacaaatcggaggtgcctaaaaggttagcaacttcatactaaaatgttttttttttcatattacatttggagctatgttttgcacacttttttgtctccaaaattttgttgttagttgataagagagaaaatttgtgtggagaagaaagaatatatagaaatttagtttatttgctaaagaatgttttataaaatagttgagaaggaaaatatagtgaaagttaatattgaatgatagaaaacaaagtaaaatgaaaaattaaaataagtacaacacattaatattagtttaaaactttataaatagtaaatatataattattcggtgtaatatttcataatatttgtatgaataatgatatgtcattattgtgtgagtgttgaaagagtttgtaattattttataattattgtatgactgtcattattgtacgaataattatgtgtgtatgattttttttcatatcatgtagatggatcggcaatggatgtacgctgaccggcggtccaaagagtttattgacggcgtgcattattttttgagagtggccgaagctaacaggcaaaagggttttacttgtttttcatgcaataagtgtaagaatcagaaggagtattctgcatccaggactattcatttccacttgtttgagtcggggttcatgccaaactataattgttggacatcccacggagagcaaggcgttgaaatggaagaagatgaagtggaagacgacaatattccggactttgctcagtacgctggatttgaaggaaatcaaacgggcgaggaggaaagggatgctgatggtaacaatgttgcggatgatcttggtcagatgttgcaggacgccaaggaggattgcgaaagtgaaaagggggcccataaattggacaagatgttagaggaccacataacatcgttgtacccaggttgcgagcaggggcacaaaaagttggataccactctggagttcttgcaatggaaagcaaaaaatggtgttagtgacaaggcatttggtaatttattgaaactcgtcaagaacattcttccggagggaaacaagttgcccaagacaacgtacgaggctaagaagatagtctgtcctctagcactggaagttcagaagattcacgcatgtccaaatgattgtatcctatatcgtggtgaggagtacgagaacctagaagcatgccctgtttgcaaagcactacgatacaagattagacgagatgatccaggagaagttgacgggcagctaacgaagaagagaattcctgctaaggtgatgtggtatttccctataataccaaggctaaggcgtttgttcaggaacaaggggaatgctagaatgatgcgatggcacgctgaagagcgtcaacaggacgggatgctgagacaccccgccgatggttcgcagtggtgaaacatcgacagaaaatttaaagactttggaaaggacgcacgaaacatacggtttggtttaagtacggatggcatgaatccttttggagagatgagcagcggccatagcacttggcccgttacgatgtgtatctacaacctccccccgtggctatgcatgaagaggaagtacataataatgccgcttataattcaaggcccaaagcaacctggtaacgacatcgatgtgtacctaagaccactggtcgaagatcttaaactgttgtggaagaaggaaggtgtccctgtgtgggatgaggacaaacaggaggagtttaacctacgagcgctgctgttcataaccatcaacgattggcctgcacttagcaacctatccgggcagtccaacaaggggtacaaagcttgcactcactgtatggatgaaacagaaagtacgtatcttaagcactgtaggaaggttgtgtacatgggttatcgtcgattccttgcagcaaaccacccggtacggaagaaaggcaagcactttgaacataaggaggaccactgtacaaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacgtccgccacgcaatcgacgtgattcacctcactaagaatcttgcgtaaaccttcttagcttcctaggtgtatatggaaagtcgaaagatacactggaagcacgtaatgatctgaagcatatggaacaacgcggtgaccttcacccggaaccaaaggagaaaggaagccattacttgagtccagccagctacactcttagcaaggcagagaagaaaagtatgtttgaatgcttggagagcatcaaggtaccgtctggatactccacgaatataaagcgaataataagcacgaaggagaagaagttcacaaatctaaagtctcatgactgtcacgtgttgatgacacagctgctaccagttgt

SEQ ID NO: 49552 - DNA, 17191 bp, Oryza sativa
ttcattggtggctccttacatcgaggagcacttggctctagttcgcgcaagaaacatcggtaagtctgatgcatggattactaggcatcacattgatactttctccacgtggctgcgacaacatctcatgggtaacgagacgattaaccaacaactgccttcctggcgaggagaccatttggctcgatcgcgacattccagggatatgaaatcaatgggtacacattctacacgagggcccaagacatgaagagcacgaaccagaacagtgctgttcgtatcgatgccatgggacacgatggtacaactggcacgtattacagtgccatcgaggatatatgggaacttgactatggacctctcaaggtccctctgttccggtgccaatgggttaggttggctggtggaggcgtaacgattgatgacggtgggatgacaacagttgaccttaacaaggttggatactcggacgaaccttttgtccttgccaatgatgtaacccaagttttttacgtcaaggacatgtctagcaaaggaaaaaagggcaaagggcctgacgagccgaagcgccacgtggttctcccaggaaaaagaaaaatcgtcggagtagaggacaagactgacgaggattacgatcagtttgatgggtaaccccctttcacggtgacgattgaccctagcatcctcctatcaaatgaagacaccccttactcatgtagcgatcacaaggaaggaacaatagtgaggagaaagtacgtgcggtcaaccgtcaccgccgatgtattgcagtaattgttctatacacgatgtaaactatgttggatgtactgaatatccatacaaatcaattgttgtatagcatatgttaaatatgtatgattattagaatttttatcaaattgaaatcatccatatgctagttatatatgattattagattttttgttaattatgtatgattattagaattttaatcaaattgaaatcatccatatgctagttatatatgattattagaatttttaaaggttttaaatcatgcacgtggtatttacatatgttaattataattttcaacaatttaatatcatgatatgctagttatatatgattattagattttttattaaaatcatgcatgtggtatttacatatgttaattagaattttcaacaatttaatatcatgatatgctaattatatatgattattagattttttttattaattttaaatcatgcatgtgctatttacatatgttaattagaatttttaacaatttaatatcatgatatgctaattatatatgatattagattttgtattaattttaaatcatgcatgtgctatttacatatgttaattagaatttttaacaatttaatatcatgcatatgctaattatatataattattagaatttttaataattttaaatcattcatgtgcttattatatccacgtattctactacatacaacaataatttttcgaaggttttatcattaattgttcgactttaaataattgtaatgcattatttactattttagaaacacatatgcaatgaaattcaagacacagctgctattatctttagtcccggttcctaactctaaccgggtttaaaaagaatttagaaatagcgagaaaagatctttagtcccggttggtgagaacaaccgggactaaagaatatctttactcccggttggtaacaacaaccgggactaaagatccgggggtatatatattcccggtgcgccctcgtcttctccaccaacacttagacattgttcgatctcggcttctcattcgccgccaccgtgcctagggcaaccccgcgccgacaccgccgtcgtctctcgccgtcgcttggcggtcctcgccgcctccgccgcagacgccgccgccgcatctcttgggtgagagccgtcgccgcctctctctctctatctcgatctcgatctctctctctctctccacggccgacgaccggcttcgacgcggcggccgctgccgacaacgccatcgccactgccacgaacgccgcccccgcctcgagctcgccacgccgccgcgccacgccgccgggccactacgccacgccgccgcgacgccacgccgtcgccactgcgactccgccgccaccgcctcgagctcgctatgccacgccgccgccgccgcgcgccgccgccgcgccccacgccgccgggccccgacgccgccgccgcgcccgcacgccgccgggccccacgccgccgcgcccccacaccgccgcgccagcacgccgccgggccggcccacggcgccccgacgccgccgccacaccgccacgccactgccgcgcgcgcccaacattgccgaacgtgattgaaacgtgaccgaacgtgaacgaacgtgacacgatacgtggacgacctttgaacgaacgctgaacgaacgtgaacgaaacgttaacgaacgcgaacgaacgtaacgaaacgttaacgaacgcgaatgaacgtggacgaaacgttaacgaacgcgaacgaacgtgaacgaaatgttaacgaacgcgaacgagcgtgaacgaaacgcttacgaacgtgaatgaaacgcttacgaatgcgaacgagagcgtgaacgaaatgattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgactattacaattttaatataagattattagagattaaatataagattgttagagatttaatataagattgttagatttagcatatatatatatatgattattacaattttaatatgagattagtagccatttaatataagattattagacttagcatatatatatatatatatatatatatatatatatatatatatatatatatatatgattattacaattttaatataagattagtagcgatttaatataagattgttatacttagcatacatatattattattacaattttaatataagattattatagattaaatataagtttgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtatgcacagatggctgatcgcgatgaggaacagatactatacgatacaatcgtagagggaagcagccagtactggaacgaaggagaggggaacgaggatccaaaccagtacttgaacgaggaggggaacgtggagagggatgcggaggggaacgaggaggggaacgatgaggaggaggctagtggaagtcatccctctgctggacagaagagggcacgcggacaacgaggtgccgcgaagaagatagagggtcagcacatcataactgaggtggacaaagacggccgacctagtgccccgacagaagcagctaagaattttgtacgccacagcggttgggttgtgagggacaacgtgcctgtcagcatggtgtactggcgcagaacaagggcacgcggggataatgacagctttgtctaggactcagagaaagagatgttgtgaaccacaatgctcgagacgttcacgctacccgcaggtacggagaacataatgaaacagtggactctgaagaaaatggcaaaacagttccagagcttcaagggagatctctacaagaaatacatcctgaagggattaacaccgagcttcgacgtattcccaaagctaagggatcattgggacgagttcgttgcttacaagacagggcaacaagggcaagtgatgatggccagaaacaaagaaaatgccgccaagaagaagtaccatcaccacttggggtcaggcggatatagcgtcgcgatgccgaagtgggaggagatggaggctagcttgcttgagaggggtatcgaaccggccaccgctaattggctggaacgatcgaagttctggtactatgctcacggtggaacgcttaacccagttgatggctcccttgtcttcagcgatcagatacgcgaggctgccagtcgactaacggacgcagtggtagcctcttctcagggaacattccgacccgacagagagagattccgacccgacagagagaaggatgagctgtcactcgccctatagactcccgagcatccaagacgaacacgagggaaaggcgtgattccctggaagattggatttaaggaggacatccacacatacaggagtcggatgaggagcaagagagataccgaggcgaagattgcagatcttgagtacagggtatcgagctacgagctcagcatgcaagaggaggtggcaaggaaggtggatgaacgtatggccgcacatcggtcctaggatccccagccgtacattctgtaacaccctgaaaattcgaccaacaaaaatcaaaattccaaaaatataggccttcaaaaaactttttaaataaattgcatcatgccgattttattcgattattttattggattttgatttcggagtttataaatcgcgaataatggataattagttaggaataaaccctaaaaagtaaattgacaaagtaaataattaaagtgcaatttaaaataagatttggtgaggatagaaatgtgtaaaatattattacgaccatatttatatccatcaaatttaaaaaaaaaagcaatgggatgagaattaactctaattaaattcaagtaaattacaataaaaatatataaaacatggaataaattaatctagaatgaatccatggattggaatggcacaaaaattgagtatacttcatttatgcaaaatttgggaattaaagaatcaaatttaaataataaatgggccaaaatcgggttaattagaaaacggcactgttcattgcacctaaagtgttcgacgaggtcccctagccctaaccctgccccgctgccgcgccgatgccgccccaagccccgtgccgcccctgctgtgccgcgccaacgtcgtcgcgccatcgccatcgccgcccgtccatcgcgtcgccgctgtcgcgccgcgcgccgtcgccatcgctgcgggtcgccgtcgtcccgcgcctcgtgccgcccgccgtcgcatcgccgctgccgcccgtcgcgtcatcccgagccccgtgccgccgcctcgcgccccgcgcccgtgccgtcgcgcgtcgctcgccgccgtcccgtcgcgccgtcccatcgccgctactgccgcccgccgtcgcgtcgccgctgccgagccgtcgccgtcgctgttccgcgccccgcgccgcgccgcgcgccgtcgccaccgcagtcacatcgcgcgtcgcctcgcgccgcacgcccccacctcgcgccccgcgtcgccttcgcgtctcccctctcccctctcccccttatctcttcccctcccctatataagccccactattcccactctttccctccatccttacctcctctcatctacccactccaccacgccgccgcctccacgccgccgcgccgtcgcatagagccgccgcgccgccgccacgaagccgccgcgccgcgccgcgccttgcgccgccgtcgctgccgtcgccgtcgccgccatcggtaagccgcccccccccctgcgtccatcgtcgtcgccgcccgggagggcaagaagccgagagagagagggagaaaggagccgggagggagagaagagagggaaaaagaaagagaggagaggaaaaagggagagagagagaaaaagaaaggaaaagggaaaagagaaaagaaaagaaaagaaagagggagagaaaggaaaggaaaaatttagggggaaatttaaaatatttaaaaatattagaatttaatcataggcttaatgaaaatatagctagataaattcttgctatttaaatacctaaaatactagcatttaattataggatcaattatttaagaactaaacaattagatgaattcttatagattattatagattatttttagtaaactctataagagattaattcgcggtagtgatctagatgtaattaaggactagataattagataaagtcttaggacatgactttaaatcacaaaatttcttaagaaacacaaatattttaggtagaagaataattccacttcgcgaataaagtagcctatatagaattcacctcccgcgctcgtttctcaattcggtcattatttggattttgtttgaattctaatcgaattcaaattgttcttacgcacgtaactatagagaccgagggagccgcggatccggatgaagaccaagacccacaagacctagagcaaggcaagtcatcactattccttgaacatgttgatcccaattgcaaaattgttttgtttacaaataaaattgcatgcaatgatgaacatcctacttgtgattatgccatgccttgattattgtttacccttaaatccttgtaaccatgatttacgtaaaagtccctagtcaactatgataaatgcttagaaatgctactctagatttatgcatactcatatttatcaaatgctatatgcttgggcaattatctttgggaaggtaattgagatgcggcatgtggagacatgagcgccacattgccatgatattgatgacatgatttgtgaaaggaaaatgaaactaaacaaatgatttcgactggggcggatggaggatttgggtggtatccggaaaaaggctagtgccatccctggtcaattaaggaccgagccatgaagttaagcatgaaacgaccctcgtacaaccgcacttctcgtatgggtatagacctagcggaatagatagctgagcggaggcattatccatgcatagtggtttcttgatgtgtgaggcaggggctctacggtggggcagccattggtagaaccgcgaggcgggtgtctacagtggtgtcgccatcggtaggactgccatgagagaatttaaacataattataacttaatgtatgtgtgagtctttctttcccgggtgcgccagaactcctctcactgctagaaaccgtgtacgcctagagtgcaagaggatgtaaagttcatggagcgggtactgccaatgcgaggttatcaaaaagctttgtcgtgatgcgtctcatgtgttgggacgaggctcatgtgttgggcagtcacggagtgcgggtaaagtgtacatccactgcaatgtgagtaaaccaaatctattcgaatagccgtgctcgcggttattgagcaccgggacatgtattacacttggctagtctctaagttattaacttgtgtgggatgggtagttgcatgatgaatttatatgctgttggagccacttcctgagaagggggaaagtgggcgtcctcagaaaaccataacgattcaatggcgggaagctatccttgggatcacaatggatggtggacagaaccgtcattgtttgaatacaaacactggtactaaaatttgatcagtcaatgctaggtctgaggcttgtgaaaagaattacaaaactggctttacgcaaaagagccatagccatcctttgaaatacccctttcatatgcattgttgctgtggtggcttgctgagtacggttggtactcacccttgcaattataaaattaatcagaagcgggaaatgaagcttcggaggatccctatgcctactaccaggagggagatgaagacgatggcgctcagtaggtcttagtacggtcgttgcctgtggcaatggcatgccgctgcctaaattctgctgccttatctatttctgcttttggatgtattccggaccgctcggtccgatgatttaagacaatgtctaaggtcttatggtgtaataattagcactagactctcgtgtatgtgcatttggtatttcagttatgaactcgtgtgtaccagactacttgatccagggaaatggtactgtttacatgaatgattcctgttataaaaacgggggtctacacattcatcctgcaatggtcagcccatcaggcaatcatagcagctgcgcctcaatggggcaggtcggatcacagagcatggacgccatgcaaacccagggcgaaaccacctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacgtgaaggtggcgtcgggaatggccatcccaacggacccttccgggacttaccactgcaggccgattccagcaggatactcgagggtcgaagttgagctggtggaagccgcgtacgaggacctcgagttgaactacccaggaggagacggtgagacgcatctacgagacacaagccacgccatcatactatggcgcaagcggtacatcatccttcctgggtgacaagcggcgtctcgtgcaccatctcctccggctccgccatctcctcctgcaccatctcttccggttcctccgccacgtcctcctgaaccatctcatccggctcctccgccacctcctgctgcaccatttcctccgactcctccgcctcctccgcctccaccatgtcggcttgcacctcccaagacaaggtctcgccaagctccaccgcctgcccacacaagggcaacgaagaaggcgaaagttgacgccaccaaaaacaaggagccaccgtacgattgcagtcaagaggagcttgatgcttatgtggcaggagaggtgaagaggcaactcaagcctcggagtcctgaaaagaagatacctattgacccgagcgtgaagaacttcttcaagggaatgtccacaacaaacaaggaggcgttacagatatcggactatgaccgaacacttcagagagcctatcacaagaagtccaaaccagtccctcagcttggagaacaaccaaaccaagaggtcgagccattggtgaccggtgaagattttggcataacagaattcattgcagacaccggtctaactgtggatcagttggttcgaggcgcaccaatcccgaaggcggaagtggcatacaagtttgaactcggtaaaccgcttgtcaaacctgaacagctgcagtccctaccgacacagatgtacaaattccatgaacggtacatggaaatgagcgccaagggtagagagatgttcggagcgaggatcagaaaccccgacttcttgcaaggagaagatgttctctggatccatttcaaggatctcttcgatctgtaccagttggacgccctcgacgtctctcttctgagcgcatggattttgtgagtatctttgagttcgatttgtttcgttcaataattagctcctggcatatatgtaagcaataatactttcctttcatcgttgtagaatggagattcgaagggcccgacggcggagggtctacgatactgggttcatcgaccctcggaaaatcaacaccgaaatgatcgacaagtacgagaaagacacagaggacaatctcgtccatctcctaacgcagcagcatttcaagacgtacatactactgccgtacaacagagagtgagtttttattgtcgttcgaacaaatttcgttcccatacatatagcatgtacattttcgatcatatatatatatctcatctcacgcatattccagattccactgggtcctgttattcttcgacttggacgcatgcagagtcactgtgtacgactcaatgaataaagaggagaagatttttgacaaggtcttcaaactaatagacaggtaatataatgccatctattccaaagtcgcggggaatctattgctattatgttgatctcaggtaataattaatcatagcttgcaactgcatatgtagggcttgggatcggttccgttaattggtccgcgggacttggaaataaaaacttggacggaggtttcattttccagtgaatacatgcatgatccaaaattatattgaattaatctctaattacagttaatataaagagtatattaaatctctcatcgtttctcatgtagtgtgtaaagcaggaccagggaactaacttatgcggctactacgtatgcgagtatgcccactgcttatcaaaccaaatatgcacaacacgagagcttgatgtacgtatacataaaccattcaaaagttcattgcgtatcgatttgttaagttgtttattaatttcatgtattgatacgtcattatttttcgaatgatagcgtattcacatgagggataatcttccacacaaggattttatcacggctgttcaagaacagccgatgggattcttcaacgaagaagtccttaatcccgacggtgaattctactacgacgaatcgacaattcataacgtcggtccttcctcttctgacatagcgccggcgtcgaagtcgtagctatatatagctaccgagcaaagaattgtactatatacgcatgtatatatatttatatatgtacacatttacttttgtgttaatatatattttggtaacatatatatatgcacataaaatgttaagtgctttaaattatacatatgtgtatgtaatatatgatttacacacacacacacacatatatatatatatatatatgtatatatatatatatatatgtatatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagtggatcgtcgtccttgaggccctggcgatcgtcgtccttggcgcaactcaagtcaaagacttcgcccctaatcaattaatcattgcactagaaaagagataagggacgaaattgaggactggtaaaggatttttggaggacactcagtttctttttgatttttttaggtcctttgattcatagaaaaagataaaagtttttgtataggattatattcctatggtcaattttataggaaaaataagtaagagattagatctcttcaaaactttcatttggttcatttttttcctttcgtgcagtcaaaggacatttcctcctgtttcctgtgttttcacttcatgtcggattgaataagcagttacttcaatttttacggttttttctatatccatatttttcctttcctgtggttcgaaggggctctaagactttgatttatctctagttcttcatcacaaaatgtagaggggaaaaaaagacttttgaccttagtttcttgacgtgctacttctacgagaacctaaaacacacacaggatatacaaataattactccatctaatcattgttttttttaaaaaaaaagagaagaactttgcagtatttcattgatagtgaagatagagcaacatcaacatgatcagaaaggataaatcaccgtgtccgaaaaaagatcaagaataaacaccaacccaacacacaacacctcacaaagaccggaatatccctctagtaagtattcccaatgtcatatatctatgacaagtggaggtaatatttgataatattttttaattacacgagtatatgtgggaacacacatggaaacaaacaaaaatgcagaattattttgtaccaacatttttcattttgcccctgagggattttttccatcttggctttttaccactaaggtgaaaattagtcatggtttagcctcacatttgcatttgccctttggcaaaataaatagacatagtgaatgtttatattagagtgtcatatatatgctattttttatggataagacttctgatactaatttaacagcaagcgattttcgtccaatccagatcctcagtattgcagactcaatgtggggctgaatgtggggctgagggtctgtaaggcccatatgtcagtgagcacatgcagtactgcaggagccgcatccattttcatcaccttgactcttaagacgtcaaaagcaactctacaaacaaatttaatgagctttaagatgcatttgtgaaatggggagcctaaagagtctacaactcgtccataactttagccagtaggaacagtacaactgaatggtatttctttaattttgtcttccttttctgatattaattttatcggaatatattcagggccatatagtctttgaatagtcatgtttttttatttaccaatcactttttaatatcgagattaatatcaaacattcacatatactcttttttgggtgaaacaaatagtatttaattagagctccctttaaaacatagaaataggaaaaaaaaacataggaaccaagtgacatagattttaaattcctacaggaagataaaccatatgaaagtactttaaggtcccgttcgtttctccaactcatgagttggatgaaaaagaagatttatgtgacacatttttcaaactgctaaacaatacgtttcgtacaaaaactttctatatgaaagttgttctaaaatatcagattaatccatttttcaagtttgtaataattaaaacacaattaatcacgcgttattaccaccttgttttacgtgaaatacttaatcattatcttcatcttcatcttcatgagattcaaacaccatctaaatattggtgtttgattggaacacataagaaacataggattgcaagagacaaaagattgaaaacatgaactaggacctcttggccttgtttctctgaaatcaccatataattgtccatttcatataaatttcaaagaaagtgataggatttaatcctttgtttcaaaggctctcataggaattattttataggattaagaatcctccacttcaaagcggccttcaaattgcactttgatgaatctctaccaatgttaaaaaaatctaacggcctagagaagcacaaagcatatctagatgaattgtggaatgcagaaaaaaaaactatccctagagaattattacagtgtttgtagaatgaataattatgaattacaaaattatagtttggttaaaaacaagaaaactactgagaagcacaaccttaaaaacaaaaatctccatctaaggttgatcagaggatgcataactattgtttgtaccaacatcttacaagttgtatgttgtagttatctttctcaagccataaaaatataatcttcgaaacaagtaagtaaggaagccgtgaagacaattccaggtggtggcaatagtaaaaaaaatatagacatatgagaaacacaatcatatgatgctgaaggttcaatatcacattaaaaaactacatatttaacaaaactacagatttgaagtgttgtatcacaaaactacatatttaacaacaaatttatcatggaactacaaatttaaggtagagtttcacaaaactacatatttaatactatctctgttttttaatagatgacgccgttgactgtttgtcacacgttttaccattcgtcttattaaaaaaattacataattataatttattttattgtgagttgttttatcactcaaagtactttaagcatgatttatatatcttatacatttgcataaatttttgaataagacgaataatccaacatgtgtttaaaagtcaacaatgtcatttattaaaatacggagggggtattaaagttatcacaaaacttcatattgtaaagtttcaatcactagcactgtcgttctgttggacattgtagttttgtaattaaattgggactgaaactatagtattgggataaatttgctacttaatctactgttttgtgaaactttatcttaaagttgtagttctatgataattttttttttgttaaatctatagttttgtgatacaccactttaaagttttgtaaaattttctcatatcacaaattaagaagacaatttgaactagtgatatggttcacaccagtttttcacgaaccatttctggttcactttgtttgtgcactgtcgatggttatgacccctacaattatttctatttattctaaaatgtttcaaatttcagaatacggcgagaagcatccttgatatggcatggaattgtaggggtatgactttattcatcgggttatatatatacaaatataagtatggttttagcatatcaataaattcgtaactcagagatatcgctaatctcgacatggcgatcaacgtgttaagacgacgcacttgcagtttgtgagtgtgtatacatgttgagtcgtaatcgaaatcgaaaagaaaaaggaaagaaaacaattgacgcttactgtcatcacagccattactgaagtaccgatcatgctttctactcattcggagagatcacaaacttttatcgcatcaatcatcatcaaccgatcgagctaatcaccatcaagttaaaaagcgagaggacaataggaggcatcaacaccacaataacaacacaaaagaattaaaaagcgacctctcaaacatgagcaaaatctttttctgtccccttctttttcaggtcatgcaaaagtaaataaatagaatacttcttccgcattagtttaaacttgtatctttttttaagcgcagtaattataggcatacaaatttcttcaccataatataatcatctaaaaccaatttatggcaaaaggaaaaagctagaattaaccgtgccaattattagagaacgcaggtggaagccttaaataggcaagcagtcaggcatttagcagcgcgctgcgcgcagcagtgaagccatagcccaaagccacaagctaaaaattcgtagttgtttttttaataacatcactattaaatatgtattttacgatacggtattaaatatatagttttatgtatttttatgatacggtattaaatatatagttttatgataaatttaatgttaaatatataattttgcgatatatcattttcaatctatagtttctgatagtttaaatggagttcactaaaatttattaaaaaccatgagtaaattttataaaactacatatattttaaattttaaatttgtagattttaaattttaaaagtatactgtaaaatttattataaaccatgagtaaattttataaaactacaaacctacatatttaataacaaatttcgcaaaacaatagaattaaaataaagtataacaaaattcccttgtggtgaaaccagtctatccgggtttaagttttagacttaacatgggtgctcgtatttacagctaattatttttttagtggtaagtgatgtactcatcgacagcaagatgtctatggacttcatcaatctcaagatatactggtccagtcctccgaagatgcttatagaggtagggtatgtgtgtatgtgtttatagacgtgagtgtgtgtgcgttatgggcacctggatttatactacgcttctcaaaaaaataaattataacaaaattgcagatttagtaacaaaattattataaaactacaacattttataatttggagataaaattagtgctaagagtttcaactttgaaatctgtagttttgtaatagcacataattctatgatactccgcattaaatgttttgtgaaaaaaataatcttaattttatgatatgacgttttattctgtactatctccgtcccataataattgtatttctaagatttacatgtgtcacaaaataattatcataatagagtactaattgtctcataatcacttctcatttaaatttatttctattttacccttaattgtccttctattcttacctatacaccatttaatgaggggtatcgtaatctcaaatcttaatatatgctaatcaaaaccatatatcgaaaccatttattatgttaaatgtcgattactccctctggttctataataattgatgttttagataagattgaagtcaaacttttataactttgactatccataactttaaaagtatttagtttaaaaaacaagaacaacatatataaaagtatttagtttaaaagaacaagaataacatatatagatttgtctttcaaaacactaaacattcatttatttattacatatattataatagaaaaataaggtcaaatatatgttttttagatcgtgtgattatcaaaatattaattaaaataaaatcggagggagtattatagaacggagggggtggaagcccataaataggcaagcagtcaaccagatggtcggtattcaggcagcgaagcccccccaaagccgagctcgcgcgcggcggcgtcgtcgtcttcctcctcttccccccgagttggattcgtggccgcgcggcggatgggaggggaggagggaatggcggcggggaggaagaagcgggtggggaggtacgaggttgggcggaccatcgggcaggggacgttcgccaaggtcaagttcgccgtggacgccgacaccggcgccgccgtcgccatgaaggtgctcgacaaggacaccatcctcaaccaccgcatgctccaccaggtaattcccccgcttctcctttcccgctac

SEQ ID NO: 49553 - DNA, 10615 bp, Oryza sativa
agaaaaacttaattcgagcggtttgtttggtgtttcatctcgtttgggctgacagaagctcagttgcagaattgaaatggttgggtgttgaaagtgattttaccaaaatttggtctgttgtagcttaattcgatttgcggtgtttgcagaaatgctacaaatagttggttcatatggttatccaacgacatcttttgaggatgcatcttgttgcaaagtgctcaagttctctaattatagtggtgtaaatcttttcctaagcttcctgatttgctagttgctatggaacttggtttctctccaattgtgtttgcaattgcaagtatatatttggtttgtttaatataactgttctataatcctaagcctactgctatgccatgaagcttggtttctctccaattgtgtttgcaattgcaagtatatatttggtttgtttaatataactgttctacaatcctaagcctactgctttgccatgaagcttagtttctccccaattgtgtttgcaatttcatgtgtataaatttggtttgtttagtttaactgttctgcaaatcaatgatgaccaccagttttacctgattttgctgtgagcacccatttcagatttccagtttatgcgagatgtactttctttgtgttgtttatgcaatatcgctaatcatgataacaaaaaaaaggactaaaccattctaattcggcattagattacgaactcacttctcatgttacttgacagatcaaaagggagatatcaataatgaagattgtaagacaccccaatatagttagactaaacgaggtatgctaaatatttacttgccatctgtcctatataacttttcattattaacaaaactcctatgttggctatcttaacttcctgtgtcactactttgttaccattactatgattttgtaggttctagctggaaagacgaagatatacataatcttggagcttatcactggaggcgaattgttcgataaaatagtaaggagtctattatatacactaccgaaataacgatgagctgctgttctacttgaactaaaaaaatataagaattgtgccaatctggcagtgtctccatatgtaaattctttttatcacccatatataccagaaactttctgttcagtaaattataggcccattatataatcccaataggcaatataaagaaaggaacatttttttattattgtgcattttcttaaaatatgaacctatgcgatcaaatatctgtaggctcgccaagggaagcttcgtgaaaatgaagcaaggaagtacttccagcagcttattgatgccatcaattattgccatagcaaaggagtatatcatagagatttgaaggtccgttactgataagagacacttggctatcatttgtcctattcactaggtgcaatatctcatgcttaccctttttttgggcatgttatgtagcctgaaaacctgcttcttgactcacgtggaaacttgaaagtttctgattttggacttagcactttggcccagaaagtaagctcagtaattgcttttaatgatgctgtatttctatcctagaagtgttctgattgggatttcttttttgagggatttcagggagtaggccttcttcacacaacttgtggaacaccaaattatgttgctcctgaggtatgatgctctctctctctctatctctcaatgcatggtaaattgaactgtacgaaatgttttttttttggcaaggagctaattgattagctacactacatgcaagaaatatgtctgcaaaattagacgagttactcgggatgcaattcaattttcctagattttctttatagatcatatttgtatgtatgatacaaatgtctgttagactagaaagagattacctatttctttgtttctctacctgtctcgcagttatttggttggttagttctcttcagggttctaaacctcatttttatgcatatttctgccatcatcactaaataaatatctctagctgtcttatttcaccatgttcaagctattgtgattttaattgtctgaactagttcataaaattgtgatatgggcatttcaagccatttccttagacaagattaggggcatttttttagtacatatatgatatgcgctttaccatgtgtcaatgttttaggtgcttagcaacaatggttatgatggatctgcagcagatgtttggtcatgtggtgttattctctatgttttgatggctggataccttccttttgaggaagatgatcttccaacactgtatgataaggtattggcttcattactaatgtgtgcagcataagtctttctttccctaaattgttgatgtgaacacctacataatcgttctactcagatgagattgaaacctgatatgtttactcctacattaaaagattactgcaggtcagttttcatgcccttattggttctctccaggtgctacatcgcttatccacagaatactcgacccaaatccaaaaactgtaagtacacacactaggttgtttcattgcatcttcaagaaacaaatcatcctttatagtaaagtttacctcaagcttccaaagtactcttgtcaccaatttaatacttcagtctcagtctgcatggctgcagaaattatgtgagagaatgcagaaaacaaagactaatttcttcatatcagtgctgccatatatgttacagaaatactgtatacaactatacatgaccagtgacagaatcttgctagaatcaaatctaataagtctaacgcatagatcttcaaccagcatagagtgtttgcttttgcaaattgccgtctccagtttcttaggcctttttcactattttgcagcgtatcactattgaacagataagggaagacacatggtttaagaagacttatgtagccattaaacgtggtgaagatgaaaatgttgatctggatgatgtacaggctgtttttgacaatattgaggtttgtgtatgccattggtatattgccaattgtctgtcacctatttgcttctatagttatatttatacaacttttctggcttcaggacaagtacgtttctgagcaagtgactcataatgatggtggccctcttgtgatgaatgccttcgagatgattacattatctcaaggtttggatctttcagcattatttgatagacagcaggtaatttcatagttccactcttccttttagttggtaacactcttggtatggttgaccattttgctgttggagaaccattagcgcaatgaaatttgaaacgctgatgggtttatagtgtacggagatctggcatgtcagcttatttcatttacttacaaggctgtgaggcactgggtttagtgacggttggtcgctcaggggtttctatcttgtttataataaatgacttaaacgaacatccatttcaattggcgttagtattatgtggaactatattctagccactgtatatggattaaccgactgtagatcgatcccattgtctattctcttttcttatcgcttagtgtactggttggtggcagacggcttctgttttttgccaaatttgaatggaaatggaaaccctgcataaaaggagaaaaaaacatctgattgcttgcttcttagctaatctccatggtttaaattgcacctgtttagtttgtgaagtatttgaccacaccaaccatatattcattctagttgcaatgttctcgtatagcagaaagaagaacccacttttcaatgtttgtgctcttacattagatcttcctagacatgtttagtatgtatttttttattttacgtggaccatacgtcatagtgtgccacacgtcatgaataactttggtgtttgctttatgcattaactgcagtcctcatgaataacttatgttgtctgatgcaactttcatcacatggagtgctcatgttgcaataatgatgggttttatatttgtaggagtttgtcaaacgtcaaactcgttttgtctcaaggaaaccagcaaagactatagtagctacaattgaagttgttgctgagactatgggtcttaaggtccactctcagaattacaaggtaattacaaaacattttcttcaacaagcaactcatttcttactcttgatgtaatgatacttattgctaactcttttctgcagttgcgtcttgaaggtgtatcttcaaacagaatgagcccgtttgctgttgttctacaggtagtcttacattgccctttgttggggaacaacattttgctgtttgtcattcacaaactacatttttcatgctgtcttatgctttgaaatgcatcattcgcaggttttcgaagttgctccttctctgttcatggttgatgttcgaaaggttgctggtgacacactggaataccacagggtctgtctttccacatatcgtcttgtatcctaatcgaatatagtagcatgattgcctagactagttcataaatctaaaaaaatgactgacactgcctgactgacactgataactttcacacaatgtgtcaaaatgctcattcgaaggtgcaacatccaacttttcgtccatccggaacgattgctaactcagatttacactcattgcagttctacaagaacttgtgcaacaagatggaaagcataatctggagaccgattgaagtttcagcgaaatccgcactgctgaggacagccacatgctagcctggcgctaacgcagctgcaactcctgcatcagtgggattttcaggttttcaggttgtcaactcctagcccgtccaccgaagttgctcttgcaggcgctgcatgtaccacatagctgagtcagttcttcagtagatcagtgtaccattctagtttcatgcaccagatgttttggtagtattgttaatatagaactgtagatagtccatatagcggccaattgtgcagtctgtatgtaacatggatatagataggtttcttgtgtagtagtagtaaataagctggttattttgctgccatgaaactggaatgacttgtgaacgtcgaaatgctctcgtgtatgtcggatcttcttcacttagccgttctcaaggatgagagcaattaatcttgtgatataatcctatatgtatttccagggcagaaatggaaaagaaaagggaaacctgcctaccacaacttttaagcctttgatctattgattataatctgaagttaattttgattttttttaatttgattcgtaagaataatcttaggtatatttcgcatctcctttacttgcccttttgactttcttggaaaaaagatatagcaaccaaagtgaggaagaaaacccttggtatcagtttgaaatcaaattctaaaattcaaaatcaaaatcagctttcgacgaaactagtttaactcgtttcgtccagcaacagttaaactagtactcctagcagtctagcagattagcatccatggaaaaaaaaaacccatctttgagtcccatcatgcaagccaggtacatagaatggtaagaagccttaaactaatccttccaatccataatcaaattagtggctgttaccaaattgtcatgaaatttctacctctccatgaccacatcaaccagaaactaatcccatgcatcttttatcatataaactaattgccactcaaatactgcaaccatggaaaaaaaaatcctatcttttgtgtcacatcattcaaggcgggtagccaggtacacagaacggtaaaagaagcctttaactaatccttccaatccataatcaaattagtggctgttaaattgtacttccttcgtcccaaaatataaaaactcagattcgtaatactaaaaaatatctcattcggttctagattcttatattttgcgacgggggagtagtaggactcccttcattttttaatagacgatatcaataatttttaaatacatgtttgatcatttacctcattaaaaaaaatttatgtaaatatataagatacaaattatattttaaatacttttagtgataaaataactcacagcagaataattactattttttaaatacaatagatagtcaaacgtatatccaaaagttaacgacgtcatccattacaaaaccggaggcagtaataaatttctacctctcctctccatggccacgtcacccagaaactaatccaatgcatcatttaccttcaaactaattcccactcaaaaactgcaaatctatctccaaacctttcccaaaaggttgctttgcttctctctccctctctctctctctctctcttcccccaggttcagatgaacctgtccagcctctccaaaaagaaggtcaagagaggaagcctggtaataataattccaatgcagaccaaaatcagagtcctttttattattccaagagacgaaatggtggtttcgtcacgccagtgacgtagtgggttagcgttgggaatcaaaagccaagtgcatgcatttaacccaatggtgagtgcagggttggagatgtgccagcccataggtaggaagggtgagatgaactagacgaccagagttttagcaaagaccagcaaaaattttctttggaattttgagaggacgacgaatccggcagcgaaacttcatgctctggaaaagttggttcagacagagaccccctccaagattgtccggcttgaagcagctcgtttggaacaaaggatctttcgaatgatggctcctttgaaatataggaatttcacgtggaatttccaggtctttatctttcaaacattgggtcgtttggaatacacgaatttcatgtgtattttatgggggttctaatcttttgaacggctcatttaggatgcatagaatttgtaggagtttcacatgaaggctgtgttttcacgtcagaattgaaagtttggttgaaattggaacgatgtgatggaaaagttggaagtttatgtgtatagggaagttttgatgtgatgaaaaagttagaagtttgaagaaatattttggaactaaacacggtggaattttgcacggatttcattctcagaagggtttgaagagtaaggcggtcagcttcagtaaaattctcaaccaggtgccactgtaagaaaatccaggaaactaattaagcatcactggaagatcttgatctcagtgaaaccaagcagccgcttcaaatccatcaggaaaacaaagcaggcacaacaacacaggcaaaaccgtaagtttcgagctccacttcaaacagagaatcgacttgcatactgtcatactgatacagcacaattgcacaaacaagtgatgacatgattagaactcaaatcacacatcaaagtttaactgaaacaccacattttatttaatctgggaaggttacaaagattacagcattcaacaatctgccagcaaaaccagggatccggagtagaaaaacaaccacacagggttgtcaatggcaaggcccttcagaatgcaccttgcaaaggccggatccccaaggataatatcaggagacccctacaaacaccataagaagcaacccccattgcaaacacaaacacacacacacacacacacacacacacacacacacacactacccacgataccgcaagccgcacaagacctgaactggaacaaacatacgcacccgaagagatcgcgaacacctggacactgaagaactggagcagccaagtttctacgaacggtgttgatgtccgcgactaacaagaattaccggaaaagaagaacacgctttgacaatatttgagctccgaacacgacgcaatggaaaaaaaacagcatgatgtaatgactgtaatcaacaaggaccaaggttgggatagaggggcaggggtgccacgctaatggcagccgaaggctcaaggaacaggcactatcccaagaggatacctgcaaaaaacgagcactcggctaaaaatgccccccggaaaacaaccggctctaagacgaaggaagtccaccatgactcaaagacaggacccaagaaaccaactctgctgctgcgaagcttgactgaagtaggagtactaccgctacggtcgtatatttgcatctggagatggatgacccagcacctccagcaactagttgttgttcctctaagcaaggatgtcgcaccaccagagctgcttctccagcgatgcaatgttgtggttgccaatgaagttgaactggagattgaggccctccaacgatgccgacatgctgcctaagaaaggaacactcttttgggtaaccttcaaacaaccagaaagtgagaggacacgaagtttgagctgcctcgctgacgccaacactgcaacaccgtagtcgctgaccatgcagtttgagagatcaagttcggcgagatcggtacagccctcagaaatggcaaacaggcttgcatcagtgatcctgctgcaaccttcgagactgaggcgtgcaagcgaactaccatgtgccttcaccaaggcagaaacagtagcatctgtgagattctcgcagccgttcaagtcgacatggaccagcccactttcggaactcttgatcaatggaaggagcccgttgtctgtaactgcaccgagaccactcaagtcgacattctccaactgagggcagatcatgccgaccacggccaagctggcatcggtgaaacctgggcaatccttgatggtgagggatcggagagacttgcacaggggaagctgcgcgggagcagagcagatgtccttgatcccgttgcacttgaccagtgagagggccttaaacttcgggctgcagttgaggaggaaggccagaatgcccatgagagtaaccttgttgcattcctcaatctgcaaactctccaagacctttgccgattccgcgaaatccttgagacggccatccgagacctgaccgcatttcttgaggttgagctgcttcaagctcgggcagaacttggcaatcgatgcgagcgcaagatcagtgactcccgggcaggagctgacactcatgaacctgagcttctgcaggccaagggcgttggccatcacccaaaaacccctctcgccaaccgcgggaaggcgagcgagggtgagatcggtgatcgccttcccgtagtacccaatcaccgaaagagaagcatcggtgatgctcaatccctggaggcgaaccttggcaagcgatgcggccgcggagcagacaaggccggagacaccctggtcaccgacatgcgcgcaattcttgatgttcaccgactgcagcttcgcgcagcaccggccaatcgccttgaggccctcgtcagcaacaccggggcatgcctcgacggtcaccaccttcaagtccgggcaaccctgagcaattgcagcgaggcccttgtcggtgatcagcgggcagccggtgatgtcaagcctcgccagcgaggggcagccggcggcgatctcggcgaggccggcatcggttacctgagggacatgccacagggcgagcgagaggagcgacgggcagccgcgcgcggcggccgagatgccggcgtcggtgacgccgcgcgtcgggtggctcccacggatgacgaggctctcgaggcttccccggagcgcgtcggcgacggccaccgccatgaggccgacgtccgtggcctcgcgcccctcgaggcacctctcggaggagcagccgccgccaagggggacctcgaactcgtcctcctcctcctcgtcctcgtcgacgaacacctggttgaggtccggcaccgccgccgccgccggctctcgcttgatctccgacgagcggatgccgccgaggagagcgagccagcggcgggagacggccgcggaggcgcaccgggcgcgggcgcccttcacgcggcggaggatctcgaagaggcactcgtcggggagagcgtcgagcgacggcgcctcccgctgctgctgctgctgcttctgcctcttggccgccgtcaacccctcctcctccaccacctccaccgcctccgcggcggcggagacgaagccgcagggcggcacggcggtgacccgcgcccgcttccgcgacctgacgccgccgaacagagccgccgacgccgccggctccatcacaagaacaccaccatctgcacaaagcaaacccaaaaacacacatcagcatgaacccaaacccaaatccattaaaattcctcatcttgtttacctacctctgtaatcgtggaacggaggcatgccgacttcttcaagaacaaatcagaccaacaaatttggccccaaaaaacaacgcaagaatcaacaagagatgaggagaacgccgaacccaatcgccaggaggcgagaggggaaaaaagatcgcagatttagtgtgaggagatcaagggaggtggaggaggtgatggaggagagggaaggaagaagagggtgggtggtttttatgtgctttgggtagagaagaaggggggaagccaaagaatggagaggatgatgaggattcctgccaacttgcacaagttgtgtgtgtgtgtgtggagggggggggttgtttttggcctccctgtaacactggatttgctggatttgcaatggattcattgaatctctctctctctctctctccctctcgggggggggggggggggggggg

SEQ ID NO: 49554 - DNA, 5805 bp, Oryza sativa
ggggtgctgcagtgatgcagtgtgctggacatgcctgatgcatggacctctttttttcccctctttttacagtgggatggatggggaggaggcattgtggagttttgattgtgtttgaatttgatagctttgggatgaaaaaaaaagaagaagtgttcttgttagatttttattttgaaagattataattggatgcatacggctgtataggcatgtagtagtatgcgtttgttctcttggttgttaatactacttatgttttttaatatttcatgtccttaattttttatgattcgtttgattattcatcttattaaaaggttttgtgcaaatatataaaaatatagtgaagatttaataataactcaagtcataagaaactaaattgtaataaacatatgaattttataataagttgattggtcaaatgtattactataaaacaacaacgaagttagatattaaaaatggagagagtataacctcggacattagaacatcaaagagaatcggtaattcgtgtatgatcttgcacatttctccattaccattctgaaaaataaaaatctttaaatccaacttctcaattggtttcgtcatcacaggatattcaattaaaaaaaattcaacaatttactttttttcacactagaatttcccacaatttttgcatcgtttttgtgttgattaatcggcatatgatttttaatttaaagatgctttgttttgatacataggtcatgttcttttttccaataagagttgaatgaaaattaagattttcgtggcacgcttttcaaactactaaacggtgcgtttagtgctaaaactttttatatgaaagttgctctaaaatatcatattaatttattttttaagttttataataattaaaactcaatcaatcatatgttaataccatctcattttacgtaaaaaacttaatcttcatcttcaaaagaaaagagcaccaccacagtggtagcatggctttactaggaagctgtctagtacattaccatattcattactgaacaagtttgcatttatgcagttcacgatctgatttttactcctttcatttttcaactctccttttacaaaaccgctttcaatatttatcaatgctctctattattagtttacatttaaccaccgataaattttaaaaggttaaagcaatgatgaacgaaagctatgcagcataataacttttataaataaaatggccaaactttcaaatatatactaccagttaaagcgaattcaactaaaagctactaacttcataaattattaagtgaagtgttactgcagattaaacttggatgaattaatattttcataaatgcacttaacaaaatagcttaaaatataaacacaaggtctacgcaatgtggtagaagatttttttctagaaaatgtatttttcaaagcattgagcaaataatatgctttaaagtttggtgaataatttgaaaggaataaggctgagttattttgagcactttgggttagctactcccttgtattttgtgagaatatttcccgaagtgttaaatggtatgtgttttgcaaaactttctatatacaaattaatattctgaaaaatcaaataagtttattttaaagtttataataattaatacttaattaatcatgtcctaaaaagttttcttgttttacgtgcggttgtttagcactgctcgaacgaacggtgactaggccctgttagaggataattaattggtaatcagcttctgataatagttaagttttataacttcttttagtttttactaaattctataactcaaaatcaaatctgaatgagaatctaatttatttaaggggattttaggacaacttacagtgcccagaaactccccaacacggggcctaagcccagataaattaacaaagccagtgccccagtataccaccctcaagtttttttcttttttttttaaaaaaaaggcccctactgtggacatgcgccacgcggatcgatccgtggaaaatgccggttcgatcgcccaactctgcctgctgccaaatacgcgcccgcgcgccgcttgatcaaccgatcgatcgagactgatctccaggtgagaaacctgcgagaccgatcgatatgatcgaccgaccacgcccgcgtccaccgctcgtccatcgaacccaacccctcgcgctcgccgtcgcgcgtgcgtgcatgcacctacatcaacaccaccctccgcgcgctgccacggctgtggctggctcgcgctgcgtgttccgtgtgcgcacaagtgcaacgcacctgggctagctgggcgcacccaccacttataactaacggaaagaaagaaacagagaaagaagagagatgaaacgggaaaaagaaaaataaaatgcgatacgacatgcaacggcctgctgctgctgggtgtggtggtgtgggtggtgaggtcgtccagtcctgtccaggtgcatgcactattgcgcccctttttccttcctcccccagcttctttcgcccttatcaaatccacagcttcgtcttaattagacccctgttaatttaaaaagcttaagaggcagcttgtcagtcattagcttctgagaatccagcttaagaacccgcatgtgacttctagtttattttcttttttaataattttttagtttattttttaagtccgtagttactccatccatccctaaatataatggattaatgataatctgaaatgttcgtgtgagctaaaacttctgagagaagcggcagcatcataagcctcccaaataaaaccttagattagattaatgttctttagagcttacttttcttgccgtttatattaggttgttaaccaaccagtaggactagctaacttatatgggcatttaactattttttttgtcacttttagattgaacgtttaatcatttgtcacctatatggcaacgacatgtaagttcaagtgttaaataattatttgtcacgtctaaaattagcaaatagttaaatatcttgacttatcttgttactctagaatcttagatgcacttaattatcttactactatcagcctagtatctctctctatgtaaaactcggtaatttcaagttggaataattttgtggttcttaattttcttgatgcaccttaattttttttaataaataaataaattatgaatagcaacaaacataagagaacattattaagcccttctcaccaacttaggagttgggagacaaaatgagccaaaaatgaagcagttgtttcatagagtaaaaaaaatgcattcgttatttttcttccattttcttgtactatcagctagggttgtgtttagttcagcgcaaagtttagattttggttaaaattagagatgatgtgacagaaaaattatgtgtgtatgataggttgatgtgatggaaaagtactgaagtttaatccaaatttgaatctaaacataacctaggttgatctactacgcggtttcgtggtggcctcttgtgggggtttgattaatgactcggtgaacagaactactaataatcgagagtactgaaacttacacgtgggcccatttcagaccagtgtttgtgcgtggggcccactgtcagtggctctacgcggtcgtccctcttgttgaacgagctccggagtccaaactaccagtccaccatggaaaggtcgagctgacgtcgtgtgaattgttctttttttttccctttcaagaattatgatttgtttgaccaacgagttgactgggagaatttttattttttttataggtgagttgggttgtatacgtagaatttgagtaaaggtaggtagctcgaactgtttttctatgttttgatgctattataaacatggattttaattgtacggtttggagtttttacctgtcaatctatatattgctcttttaattctccccccccccctcctaactcctaagtggctttgtttggttaagtgaggtttaaatataaactcataaattgaagcatttctcacatatttatgcccatctcacattacacagatattaagaaatcaggtaaaattaaataaaagaatattgtgattggtcgagaaaatgaagaggtgaagaatttgaatggcaaaatattataattgattaaaaagggaatatgagtggagaaattgttacactttggagtataggacaaattttgaatggtataacattattatattttaggacgtagggagtaggtgattaattaatacatcgccaatctgtatgtaatggccaagcttagaaagcttaatcgataaaaatttcaagattatgctaccaagtatattagaagaagaagaagaagaagaagaagaagaagaagaaagtgaaagaacaataattttgtccaaaagaagtgtactccgtattctctatagaggagggaggtaaggtacatatcaaaatgagatgtattcatcggcagacggcacgcctatagttgctcctattctacctttcaatcttctcccaacaccaaaatagggtgtatttgaaaaagacatatgatttatttttagaaaaagaagataccaacgttattactatttcgtataatggactataccttattgatactactgctttcaataaaaagtttacactgtttagtgataggcatgattagctttaattatttccccagaaatcgacattgcagaaactaggtcagcttattgaataaagatcacttataagatgattattcttccagcagaaatttatttacatgtcaaaatttttatcatagtcaattatcataatcctagattatatatatacttgcaaactcatatgcttgtatgtcacatatcatttaacaatagatattccgatcaaattatcacaaaattatagatttaacgtgtaatttctcacataactatagatttaatatagagtgtcacaaaaataaaaatcaagtagcaaatttatcacataactctaagtttagtgccaatttaatcacaaaactacaattatcatagctccaatatgatggcaatgctatggatttaaactcaatagttttatgataacttcaatataaatagtagtttcgtgatattcggttttgtgataattttaacgttaaatatgtagttttatgacacataaattaaataagtatttttatgatagtttgatcaaaatattaatagttttgtgaaatttactcttaacaatattatatatgctattcaatagcaattgctgaccatacaaaaacataacacttaatttgcagtaaagaaattctctgattaattatacacagctgctaaattctctcctcacttcaatccaccgtgcaatacagctgtttttcaattcgcaacgacccccatcgctgaagatgaaagacaggtacgcatgtactattcttctactacaaatggagcttattgcagctttgtgggacagccaaacggtcagccccggcccggtggttgatctgaagatccattgcatttgcacctgacgcgctcacaacaatttgacaatttgaacctgatagtgcatgtctcaccaaactatatagtactatcaattttacatgcatgttcatcactgaattggagaaacatgcaatgaagagagatcgacatgacatatactagtacatactattccatatgcaactctagatctgaactcaacttgtgaaattgtggcctaaatagtctgtacttcagcagcacacaacactgttgaaactctctgagcttcgatctaggacaggcaaaattaattgaatta

SEQ ID NO: 49555 - DNA, 6995 bp, Oryza sativa
atgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtcctaacagaggtaaggtgtgcgcgcgcatttagaaagatacgtgagttagggtttttaggatttttctttttggaatttttatttatttattcaaaaattctttatttttcagtcgggtaaacgtgtcgtgtgtaaaaatcctattttcacgtgtggttgtgttacctgtctgggaaatccctatttctatatacacctgagggcatgcagttgctacatccatctgcagaaatgcattttagccgtttaggaatattgtttatattgtagtgtcttttgcaacgcatagacatattactagtaaagataaagtataagaattggacgagtcaagcattggatgatcgtagataagacgatgaagtcatgggtgcatatctccaatcaacagggtgtttaaatcaataatcacacatgtgtatgcacttttaatagaattttagcggaacgaatttgtgctaattttcgtttcttccaatgtgtggacttctcttatgtgctctctccgtctcaaaatataaacatttttaacaaagtgacaagtcaaatattttaaactttgactattaatagtaaaaaaaattaaaagatcaatcatgtaaaattgatattactagatttatcattaaacaaattatcataatatgcaaatctttttatttaaaacatcttacttttatagatattgttagtcaaagtaacatatcgaaaaccatgtcagagtcaaaaaaaaaaaaaaagcttgtattctgggatagatggagtaattaattaacaaaaaaatatgttttgattgataaattggtatgcataaagatgcttgcactagaattttaacactttggcccttcttacatttactttacaaatgtaaatccatgctgaaacttattttgaaaatgacatatgccaagacttgtttcacaaatgctagctaagcgtgtactcctaggacttttagcctgcaggccgatcggccgctctcgatgccggcgacgtacgagacagccaggttcatggaacgaaaatgagaggtgcccgggcggtatgacttttcagtcagactattattgtagtagtacgagccagtttcaatttctctacagtacgtaatttgtgcagactattattgtagtggtgctttttctgtagcagtaaaattgtgcagtactccctcacagccggaatgagttcatttttgggccgttttggtttgctataaaaactgggccataccaatattttagttatcagaacaataccactgtgagtttggattgtgaccaaatcactggtagtgcctaggtttaatttggtagcaaggcataggctggaattggcagccatccgtcgcccgccggaagtgcccagaagcaggccacacaacttggctaagcacaaactagttcacgcacttccgttaaaaaaaagaagctagggcttcatcttttctctacttcaataaatacccagccactactcccagccactactcgtctcctcggctggccgcctcaccgctctgtttatttgtgcttattctgcagcaaatagtaccaaaactattacaccaaaaaaaaatggtaatccttcattggtaccaatccaaatggaaattgacccataaaaatttggcacaacattggcactaatccaaacactcgtatttactgtgctaccataccaaaattttggtagtgccaaaacttaccaggttttggcactgccaaaattttggtagggtaccaaaccaaataagccctttatttcttcctatatgttctaagataaatttatttttaagtaaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattggtctaggtgcaggcgcattcacgtactacgcgagcaggtgcatcgctgtcgacgatgccggcgacgtacgggacagcgaggtttcagggaagcgatggacacacgatgccgatgcctggcagtgcatgatcacgacttctcagtcaagaccatcaattatcgtccgactagctagaggccgggtccttgtggtgtttttgctggagccgtaaatagtagtgcactccctccgtacttgttgactgaataactttgaataccaagtctgtttagctttaactggttgggttctcttaggccatgtttagttcacatcaaacttttcttcaactcttaactttccatcacatcacatcacatccaaaactttcctacacacataaactcccaactttttttccaaactaccaactttccctaaacttctccccaatttaatgaactaaacacagcctaaggtgaaaccgatcgtttgggtttactggcttctaatttaactcaggtgctcgtatttacggctaagtagatttaggtgcactagcgttcacgtaaattattattttagtggttcgcaagataccaatcgataacgagatacttgagatttcgttaatcccaaaataaaatataccagccatgtctttaggaggtgatcatgtccttacagaggtaaggtgtgcgcgcgcatttaaaaaatacgtgagtatgcacacgtcgtgagcgcatatatgtactgtgttttaagaaaaatataattactacctctctagaaaagttttacttttatataaatctagacaagtattattattattaattatgtattgtttcgtgaaagaaaaacaaacttcttcctaatttattattaatgatagttgtatgattatatttacagtatgacacaatcacattattacggtggctacacagttttttaagaaaatacttatatcaaagttaaaaagagaatagtataaccattgacaggtatttcaaacaaaaaaaatatggagtaataaatgcgtgtagttttactttttagctgcacgtacgtgtcggatgtccggagaattgggccaagctggtcgtcgctggatgctggcatgcaacgcacccaaccaaagctgcaccggcccgtctctattcgagaaacaaaaactgccaactggtgactgagaagtgagaaagccatacgggcacaagacaacgtgcaaaaccagctggatactcgggatttgtacactgtcaatacaagctccaaatgaatttcttacttcaaaatttgtatccttttcaaggcaacttcacaacttgttgagtgctcttattacacctttttttttctttctgacaaattgatcattttcagaaatttattgtgaaactaagaccgtgccaaaaaaaacttcaataaaaaattaagccatgttctcagcaccagagacattggcgctgaggttaaacataccaacgttagctatgttgacgttgagccccctatccacatggttccgaggacgatccccctcacttacgtgacagggactcatcagcaccaagacggttggcgctgacccaatggcatatttttttgttaaagtttttttttctgcacggttagtttcgaaataagtttggaaatgactaatttgtaaaataaccaaattattactagtatagtaaattaccacgttgatcataagaaataatatatactggactgtcttcataacagtgtggattatttatatattgtgttgtgaactaaccaacgttatacttttcgagacggagggaatatatagttgtattagaaaatacaacagaaaacctagacaacggtatcctgatagaacgaaatatgtctatcatgttgcaacgagattccgttttatagcagccctcaaaatacaaatatattcttgataatcccatacaatttggtggaaaattcgaccagtttatccgaaacagaaggcgtgaacacaagtcatcagcatcagcaaggcataaagcggacaacttgaaacactttattgaatcagctaaacttgcggctcgcttcttcttttcttttcttttttcttcccttcactttcttggacctgtgacttttagttggccgtccaggggatctgaatccatctactgtagaccatttgtacaatcaattgttacaaaatggaccacttaatctacccctaaatgctaaagcaatgactaattatgagctactcctagctgctatattcagctcagctcttgcaagttgccaggcaaaagggctactaaaaaccaatattaatttctagcaaattgctctagcaggctcttcatcttcttggaccatggcttggcgtttgtgtcccggtgagctgaaccatggataagaatgcggtttagtgcaacaacctgcaggggaacaatttgatgacattatcctaataaaatatatttttagtccatgctaataccttttaggacctggtgtctcttacctagccacacacatgtacaccgtttcaccgatttaattatgtttttaccgagtcatttgttccgtatgagaataatctatgggttggaatgatcatcaattacatacttcttcgtcattgcttcttacagaattaatcaaagggggaatatgctaacgagtataatatagtttgaggttgttgtgtttgaagtttccgatcgataaggtgttaatggtttattttcgaaactattggtgctggtaaaaaaaatgttctgctattcctctatcaaagcatgtcaatgtcaaacatttgctaaagttgtactccctctgtttctgaataaaagtttagctttgattttttttcttagtcaaactaataagattatataaaaattagtagcattttcaacccaaaacaaacatattatagatttaatgaatctaaaatttggtattttagatgttgataattttttctataaatttagtagtaaaatatcaaaatgacttctaatataaaacggagagggagtatatacatatgccaaacaattttaccaaaatttgggtaatacccatatatacacatatattaattccacattggctcaattttccaaatggcacattaattcacacaattattttttgcacgatatcagaacaacttctcccatttatatctctactattataaaaactgaagatgtttttgccagaactttggtacgtcatccgtatatgagtcggtttttaagttcgttcgattttagaaataccaaaggagtcgcatagaaatctcttaaaaaaaactcgcatgctaacttgagacgattggactcctaataacaactcatgattttctaaaataatatatccaagcgaattctaacggtgagttttacctgaactaaaccttataataattataagattagaatagccttcacccgttgcgtcgcacatgcattttctctagtcttataaaaaaattggcaataccaaatagaggtaaggtagagaagtttatataatctaacatttatcatctcaaaaattgcctcagcctacgaggctacatgccaatatatcctgatcctacacagtggcggagccaggataaaattatagtggggtttctcagcctttgggccttataacattattagataaaatctattttagcccccttacaatagatatatggatttaaattttaaggggtcttaataggggctctaatgatttattagggggtagggg

SEQ ID NO: 49556 - DNA, 15111 bp, Oryza sativa
cccccccccccccccccccgcgcgagatgcagcgcacctgcatctgcgtgcatgccgcgctagctagccgctagctgctgcgcgccgcgcgcggcttcgtcgttgatcgatcgcgttcgctttccggacggatcgagctaggtggccggcaggagtcgctgaggttgatcgatcgatcggtcggtcgtctccgccgcgcacgcgtggttttttaactaactaatcggacgctctcaaaatgtatcgttctttttagggattcagggattgcgtaattacattgttaatccggtatatccacgcaaaatcatagaagaaaaataatactactatatttttaaccttttttttccagctagtcaacggccggcgcacgtgcacgcgcgtgcgcaccgggcggtatctgcgacaagcgtacgcgcccccgtgttgcctccctccatgtgtggctgtgggctgcaagcctgcaggtggcacgaacctggcccgaccgaaacaacgcgcatgcgcaagtcgtcgatactctacgtactacgcgcgcgcccgcgcgactacggacgtcgcccttgcggagagggacacgacggacgagatcttggctactacttcctccgtcctaaaaaaaatacaaaccctgatttccgtgcccaacgtttgaccgtccgtcttatttgaaaaatttataaaaaaaatttaaaaagacaagttacgcataaaatattaatcatattttatcatctaacaacaataaaaatacgaattataaaaaaagtttatataagacagacagttaaagttggacacggaaatctatggtctaactttttcttggacggagggagtacgccgcatgccgcgcgccgccgcgccgcacggcggtctttgcctctgccgtctccgtctccgatcccgtcgcgcgcgcgtcgtgttgaagttgcagcagccagcaatgcagcctgactcgactgatcgcctcgcgggccggcacgcagggtgcagcgagcgagcggccgacgtgcgtgcatgcgccaacctcaaactacttgaaatttgaaaagcatatgcacgcattatgccttttttatttgccccctttcgctttgggctttcagtaattattcatgtacttacttcttacgtctcataataaatttatttttaatccattttatttgtagaaatgaatactataggaataccactggcagaaaaggatgtgaatcaacaacaagctgtgacattaccgtgatatatccatagacttccataaatgtgcacaccgcttgacaaacagataatctgtttcgaatggcttcacgggaaacaacacaaatgcgaggtttattattgcatcctagattttatgtaagcttcatcggacaaaacaaatgatcgttttcaggaagttcaccactaaatctaagaaacactcaatgcagtcctgtaaaccaaggttacacaggtggatcgtgctcaatccgaatggcaaaccctgtatggtacccactatcgaaatgaaaaacgtcaccccatcgttacaagttaaccaatttttttaaccgataatcagcagtaaaaaaaacttccattcgaaatacctttctaaaattttttgtagcgggccagcagttagttccaccttttcagtgctgatttgaattttttggcccgctccgatataagggtgttacacgtacgtttgcttgtgcacataataatcgttagtaattcattcgtttgcacatggatgtacagctatctagcgagttgcgctgttgcgttccactgtcacgcaaattggcaaccaggcaaaattcggggatcgaatcaaataggacgtgtgtgcttcatgccttcatccaatggtggctgccctgctggttggtggtacagtgaagcgcgctggtgcatgattttaggatgtgagcattatgcagtgcataattaattaagtactccctccatcaacttttgatagtcatatttcatcttggcacaatgaggtgtgttcggcaccctctttttctaacccctctcgatcgttttccgtgcgcacacttttcaaaccgctaaacggtgtattttttgtaaaaaaatttttgtacaaaagttgcttaaaaattgtaattctcacaaactctccgaaacctgcagccacagccggccacagaaaattcaccgagtcagactcggcttgccttgccacatgcccaggccagccgacgccctgcttgcatcaccaagccgagccgctgcatgctgcacagtacgcatacacacatgcatagcacaacatgcatcaccacgctactgcaattcatagtaggcacacatatatgcatgctacagtaccacgtgtactgtagcaccatatactcttactttccaatttccttcgcgaacaccgacgcttgcacgcacacctcgtgaagcccgttgcaaagatttcacccacacggtatccatccaccgtatgccatctcgtatccaacttcgtcacccggtatccttgaccgtctggacctcaactcctcactgagtctagaacttcaattctccccttttcaagaagtatgcattttgtatatttctccccctttgacaataatttcatcaagatgtaagttataaaaatctaaatacacccatagcatgacccatcaatattaataattaagaatttagcaagaaaatgttgacacatctagctttttcctaactattgaagttaccaaaaattcagtaggacacgtgttggcttcaattcaaaacaaccttaatatgagagaacgtacctaacattaatttcagcacgcggaatatatatcctttgtttcttttaaatactaagatatcttttccacgtttcatccatggaatttaatattaaatacatatatcctttttttaaaacattatcctatctgaatggatatataataattcttccatggataaaataaacaagagggtttgatatttttttcctataaaaaaattacatgataaaccttagtaacgaagcaaaccctagttgggccgcctcgagatggcagcccattccggcccaggacacgagccatcgtcatcgggggtcgtctactacttgcttcctcctccctactccgcctagtctactactctacttcgctctccgccgccgccgccgccgccgccgccgcccacctcgtctcgacgccggtgagcactctcccccgctggagatccacgcgccgctggttggattagttcgggctagggtggagcgagattggatcgttggatatttggtttttggtttttgattttttttttgttgaattgttggggggatttgactggattttcctcgtgcaggatgaggatggagggttcgtcgccgatggaggaggaggaggaggcggcgaggctggcgggctcgcagggggagtcgccggcgatgctgcacccgaacggagacggagacggcgacggcggcgatgatgagggtgacgccagcggcggcgaagaggagcagggcggtgtggctagggcgggggttcgtcgccgcggcggcggcggccgtgtgcgcgtgcgtggcaggattccgctgaagaaggggccgtggacgcccgacgaggacaagcggctgcgggagtacgtggaggcgcacggcgaggggaactggaaccgggtgcagaggaacgcggggctgaaccgctgcggcaagagctgccgcctccgctgggcgaaccacctcaagcccgacctcaagaaggggcccttcagcaaggaagaggaggagatgatcatcaagctccatttatggctggggaccaagtgggctaagatggcaaactctgtaagtgtgctcctcctcctactctttcatggttccttggttttgctagcttgtgcattgatactccgttcattgttagtttagattagtagcatgcttaatatttaggtgcattggtgtattagttggattagagcaaaaatatttaaccacctaaattaaagcctaccaacagtttgcctagtggggagaatgcatgctgtccactccaaatataggggccgcaaatataccacttgctcgtagatagatgtattcagagtacatcaaccagtattttcttctgtattggcgaaagactttattttattcatttaattggctccaacttgatttaaatagagaatggccactgggcatacttttttctgagtgtggcgtagtgccatggtgcagacacatttgacatgctgcactcttgtaaatggccttgttaaaaggagtagacaaatgctttgccattattccttgtttgcagagaataacaaagtaagtcgttcttttacaattgttgttagtcttgtctgaaatagtatttggtcctccaacaaatcgaaagaaaattgattcagaccaattatcctttaaatcttcttgcttgtagtggctttacataagcaggggcagagcctcatggctgcctacctggacactggcctccattggctgcaaaacctttgcaagttacaacttagtcgtatatatactacctatctagaagcatgatatactgcttgattaatataaattgtttagtttataatcagaacaaacggcatattgtcagtcgagtatccgtagaaaaccaaacagcgtatctaaactgttttttaactttgatttgatgcgatacccgtgaacaaaattcagctaagctttggccttctatgaattaagtagacccaatcctccatgttggacgtaagctgtctgttcaattctggattgtcgtggctcgagaattttgtagataatggatagaaattcggcatctgtagactgtagtcactgttctaggttcctattaggatcattgtttgttagtattgttactacatgaaaatcggtgtgatcgaggctatatatctttcatcttctgaatctttagggacagcattactggtgtgatgtgagtgcctgagtgagtgagagtgagagtgtgtcctagttgcggactgaacacataaagaatttgcaaaagttaacaatcgttttctccatattgcatcacgatatcacatcactaattcactatttgttggtggtttgtactacgcatttgcaaacaccacgtagctagctagatcaagctagatataacaccaaatctgagttctatcctgaagactagctagtaatcaatcgacttaattaggatataacgtgaaaatcgatctttggctgccgtttgtgtcaagttaaccattcattagcttaagtgaatggttttacttttcttttcagaaacgatactgtcatcaggtgaaactgcaactaatattgatggtgaagtctgaactctgaaatggatggtgaaatactgaaattaatggaagagtgaatagtttacctgacaaccagatgaggtcggcgaggtcgagacccttgctctggatataatctattaatcaagcagtatataatctattaatcatgtatccgtagaatagctctcgaggtgtggtcccgagaatagcagtcgagtatccgtagaaaaccaaacggcatattgcaatcatgtatctgatatttagatgcattggtgtattggattagaggaaaatattgtctctagattaaagccagctaacagtttgtctagtgcagtcttctccatatatactatttgctagtgtctggatataatcagtggacattaaatagttctttcttatgtatattggtgacagactttattttattcaatttaattgtcttaatatcgttagttgctaaggacttaaatagagaatggttgccgggcatactttttctttagtgcgttgtggtgccatggggcacacgtgcttgcagtgctgcactgcagaaaagaaactagatatatattttactgttattcctcttctgtagagaaggaactcggcttgtttgagcattcagagcttgcactaattagaaaaaaatagaatacctattttcttgaatctatacagtcagttaacacatggaactgtctttttcccttgtgttactgtaagcaggcggatgtactgtgactcgctagctagacacaatctcgaaagatgtgaatttaattttcaattcttagttttctgagccatgttataagtagtgtcaacttttaaactgcaacaggaaaagctgacatctaggccacaggataaggtagggtctgcaattattatgggaggattcattgacatggtcatatatatttttaaacttttattgggttcctttcctgcctcctactaaattcctatgagtttttgttcatcgaataggacttcatcatattttcatttatgtaaagacaatatcattcactgtttcgttaggtatgtttaaatcctctccaactattgcaacaccatgatacatcttgctatatttgccattctaacatctgaggtacaatgcaaatgcttattaggctaatgccttaaggttctttagtctaattgcctagaaaaatcctattagatcatatgttaacttgcatatctgaacttctgttgttgttattgcagttgccaggccgcacagataatgaaatcaagaacttctggaacactagatgtaagagaattcagagaactggtgaacctctatatccgaaggagtttaatcattttaagttgacagatctggaagtgatgaactgtgaaagccctgatgaatcacgtgccaagaaacgaacaaatgaggttttacagggaaatggtcaaagttacaaagaggtttttttcgataatttagactatagtagaccagaaaattatattcggccaaattgtgtgactccaaattctcttccagttgatgccacaagtccatttggtagtgccattgccacacaagatcagtcagtaccttttggtagtgccattgtcagtggacatccaattcttgatggcaacttctctacttctgggaccatacagaggcccatgaatgtagagctcccttcactccaatatcccaactatgactttaacaataataatgcatggtcatatcacgaccccttaggacatcctattgaccaggttgactttggctccctgagatcagaatatctctctccaaacaacaatggtctgctggatgcattggttcatggaggacatggacaaggggaacttgcaaattcccaaggatcttttgatgcttgttttcctcgtgttcaatgcaatcaagtgattcaatcgaatgctttctctctgagttcttcctttccaatcattggtgatgatctcctcgagaacagtaagtgtactcactcttattttaacatgaacaatatcacataaaacttactgttagtcttttcaggttgtcatgcttttgttggcatcaacaataatgcaagcagcctattccttgacagccaacctccacccttggtggaccctactttctggaggcacgatgtatcactagaaccgaatttgccagtttattgccagtttaacgaagaattgccgccctcaaatgagcagtttgccaaagatgcagatgacgctttcggtcatgggggtctttctgatgagaccaatctagctgctgcaggtcaaggcgatgaacatgaccttgaggacccctgggcgagcatgcccggtgcctgtgacatacctgattttccaagtgaatgacttgcatagagtttgtgcgtgttattgattttgatctcaaccagtgagagaaccaagaagatcctttttgcaataaccatgcctttcaagatcgtccaataagtttgtggctgcgtatgctattactatcttaccgtggagttgtgtgctatatgctttgctccccgaggaaatgtggcccttgaactgaatgttgccattgtttgtgtcggctacttattcgattcattaatgttacattgtttgctagaatatgctgaaattgtatattcgattcattggttttgattaatcaaagactattgtcgtcatgtggcaattggtacaacttgaagggaagtgaatgctctaattgcttgggacattggtagctccggttctggtgttggtgttgcacctgacgaggcgatgctccttgttttacctgctaataattgctcctgttccgtgaacataacttattgggtaagatgaggaatgctgctcttgaacgaactatgtgatgcctaaattgagctaaggatttgtcaactgttataaattgtgcgaaggatttgtcgacataaacaatcagttccatctttgaaaatggtttgatgtgtgccttttgggcttccggtttcacatgatcgaagacggattcacatatacgtcttccttctttagtactatcatctcgagtgtgctgatgtgtgcctttttgcccgatttctctgcatcttgtcattcaattaacaggctgttgcatcatctcgcaagttgcaactacatttcggttatagccattatatctaaggcatactctctcatttcggttatagccattatatctaaggcatactctctccgtccccccccccctaaaaaaaagagaatatgtaaccctaggtcgagttttttttggacggatggagtatgatttaatatgctgtgtctactaaattacggaatttttcaccaacaaattcaaaaactagaaatttgttctcatgggcaagtcctttaaacttaagggagtcgtccatggaaattgatttccaagagcggtcgttatttcgcttgcccaaatcatgtgatttttacaaggccttggttgtaggcgggtctaaaacaccattgtaaacaggttcttgaccgccccgcacaaacttttttttaagcagtggtgatctatgaacggtgggagtgattgtatttgcgcaggtggcagtgaagcctaagcccttctctccactaggtgcagttactcattgtgacacatcttcatcactagttactgacttttatatcatcatgtaggtcgaagctatcttgtttcaaattatgatatcatttatgccgacaacactcactctttgtttctttagatctagctctttctctctttggatggaccctacaaattttgaatgcatgtgcctataggcttgctcatcacttacactgataataactcttccactatttagatgcatcacttacactaacaataactctctctctttagatggaccctatgaattttggccatgtgcctattggcgtgcttgttaagagcatgaattttagcagtgtgcctatttgcttgcttgtaagtgtacggggtatggaagaaccgccttggaatggtggggcggcatgcatgtttatttgcttcctagcttgttgaaggtattatatagagttagaagagtttcttcatagtgtaactacaacctatgttatggtatatttactgattggatcatggcaatgtcgatacgtacacacgttgttctttttttagagacgatgttttagaagagctgttttgattgtccgaggatgatgatccctagtggttatagttcggacggtatgatatttgttgtcttgtctttttatttccttttcttagaaagtaattcatatgatgcgtgcacagattgagagtggtcttgcactaattataccgtcttattagttgtctaagataaataaaatttccttcaaaaagggctccaaaaaaacaaattggatgagtttagaacatataagtcacaataacagccaaagatatataatggtttctatcacgagtagccactgaaaacaattgaaaatgcaactactcccttcaatagtatgaagtgcactgtgaagcttggatccttcagtactttgtaaggctaagtgctactttggaaagtagtaatttcatagggatcaaaacaattaattactgtgaaaaacctccaaaattaattccttgaatctaaacaagccaaatatttatttaaaatttataaattcctcatacccctcaagaaccttttgcacctccagcttcctcctcgcctcctcctcctccctcctcatggccgcctccgcctcttcctcccgccgccgctggttgaacctctccaccctcctcagccaccggacccgcctccgcacgcagttcctcatctccagcgcagcgtacaggatgccggccacgaagcgcctctccgtcgggttcgccggcaggctctccggcttgatcccgaacgcggcgagcagcctcggctggccgtcgccggcggcggcggcggcggcgacggcggcgttgcccctgttgatgcactcgatgagaacctcctcgatccctggccccgccatgaacccgaggccgaggagcgcgggccgggtcgcctcgtaggcgccccacgccatgacgtggtactccaccagcctcctgctgccggcgtacatgtcgatggcctgcgactccaggcggcggagcagccgcgcgtacatgcggagtagcttgcccatgtcgtgctgcgccggcggcggcgctgcaagggagggaggaggaggtggctggcccacgtcgtgcgtcgccggaggagagggaggaggaggaggaggaggtggtggaggtggagtctgcttgatgagttccatggcttcttctgcagaccacgcaattacctcgtagatggaaatctgccaaaaacgtaaatattatgctcataattaactactccctccgtcccaaaatatttgacgcagttgactttttaaaatatgtttgaccattcgtcttatttaaaaatttttgtgaaatatgtaataagactatatgtatacataaaagtatatttaacaatgaatcaaatgataggaaaataattaataattacttaaattttttgaataagacaaacggtcaaacatatttaaaaaagtcaacgacgtcaaatatttagggacgtagggagtaattaataaataatattcgatagatatcatacaattgatacgactctatatgagtaaatcagattttttttaataatgaaaatatatcacacaagcaaataaataaattagatctaaagatattctctccatcccaatttgatcatcacctaacgattttgaggtcttcctaaaataattatcatataataataagtgtctctttatttatttattatgcaaagggtaattgggcatcgctgaatggaatgcatgcatgaagccatatgcatgctacgactgttagtgcaattccatgcaacatttaaagtgtgatgcaatatccactggatatatggagcaccttgattggtgataattaatttaaaaacatgaaaattttattgtccttgtctttgcaccttttatttaggggatgatcaaattgggatgaaggatatactattaaactaataataaatagaaatattagttgtttcaacggaacatcgaaaacaaaatgcaacaattttagtttaagttatgaagttagcaagatggatcagcaggtgcctaactaatttaatcgagtaatcgatcggcagcaaaagaaattaaacaacaaattaatttagagaataatcaatatggattttctatattgtatttgtattgcatgatcgaaggaaagaattaagagatcatgatcgaagatgagatcgatcgatcacctcggtgaggtcgtcatcgttgacccatggggacgctacggacatgttggggaggacggacgatgcctccgctgtcagcctgcagtgcggcggccctcctgtggcggtgcacctcgggaggtggacgacgacggacggaagccgcgagggggcgcgcgcagccatggttgccggccgcacgactacggagccgccgctgatgaggaggccggaggggcgcatcatctctcgctgcccgcctggtcgatcggtgtagtttgttgcaggccggggcttagggtgtgtatatatatatatatcgatcgagttggagaaggaaattaaggtaaaaccctaagccctaggagattatatatatatagtatacctattattaattactagcaaaaatacccgaaattgctaattcgccgacgtccgcgcggatgaggagggcggcagaagccgcgccgcgcgtgggatttttttcggttttctttgtatcttttcggtatttcttcggttttttccttccgttttttttttgttttttttacgggatacaaagtttatatacgtgtaaaaaactttttatgtgtatacaaactttgtatacataatatattttctagtttttttattttttaatacatacttatataaaatttatatacgttatatacttatgtatatacgccatatttaaccaagaaccccagcacccaaccttggaaacgaactcactacgagagggcgggctctaatccttaagagtattttaatagtatagccaactactgactctaaattatctataaataatctaatagcccatttatacaatagttaactataaaaatatactacaccattaatacccggtcccacatctcatacacacataacatattagagtccgtgttgcagctagctataaatttgtagcccgcttttttctctcttctctttttttctcgatatatgcagtggttatagctggtttatagtctactactattgtacctgctctaagcgaggagatgacacagggtgccaaaggttggggccatcgtcgcggccggtctttccccggcctccgagcgttgtaaccagtgctaggagaagctggatcgggaacaaagatctgattggcacggagcagggggaccggcgctaggagatgtagtaccaattggatcaggaataaagatcgaattagaaatggtaataaaattggtcgctagcatgcacacattctccgatgttgcattaattgtattccgatgaaatccgcgtccataaagttatatgatgatcaatttgagaaattttagatttcattatataatgatcaatttgggaaggagagagtacagtactctttagctagttggagccactttttaaataaatggttcaaagctaataagaacgtgaattacataatactttaaagaaattggaactgctagagaatttatagtccgggttgcaacccctttagtcctaggttgcaaaccaggaatacgaatctgggtttgtgaagggagctatctatttttgatttcctattttttttcagcgtcattatgtcaggtgagatgataaaaacactacaaatattttaaaagactataaaaagtgcccgtgcgttgcaagggaagaaaaaacgagaaaattgaggaacaattgagaaagatttacattttgtagttaattaaattataaatttcctgagatatctaggtatttttaaataggtagatgtataattaaattaatttataagtaaagtaagtgtgggaaataaaatagcatggctgaatttaattttttattaaattcttcatgattatttacactctttgattttttctcggaattttcaaagattaattgctattttctataatacaaatatcatttcagcatttatttaaaacaaaatctaaataaaaatcctcatttgtgtatgggccttttttagccaattttcttcctcaacccgtagctaagccggcccattttcctcctttctccttccctccgccttcccatatctgtccagattctctcagttgcccaacaccggctgaagccacctcttgtgaaatcaggtcatttccttatagataatctaaaattgatcgagggtttcgattcttatcttttcatttttccgttgtcccaaaaatcagagaaaatccattgtgtatcaaactcggaattaagccctattctaaacaagcaaactctaagtttagtccatttcaattgaaaaaaaatcgccgaaagctttacatattttctttaattaggtatatgatatagaccatttgctataagtatattggtatggatgcatgctttgatacgtccaaaagtgcgacggaaattaaaaggaaaaatataaagcataccatgggacccaccatatgctggatgcaccacaaaaatctcccatcaatggtcatgccctgtcctctatcccattccgtttctcctctctctttctctgcgatacgatcgctccttctcaggcttgtgacgtgcacctgcatcccgcagtcctggcaccttttgcatctttgagtctggtgttaatagagatggcaatggttaattcaccgtcggggtcatgcccgtgtccccgtcaccacggtgaaaatatgtcactgtccccgcccccgtcaactacaacggggctataatttctctagccccgatcaccacgcggtgaatttttctccatggtgaacacgtccccggttaaacaacatattcacaatcacattatatcaaatatatccaaaatactccactcaacaaatcagcaaattatagatcacaatcacagtaaggatcattatcatttgtcattacttcattaggcaaaacacaaataaacatcacctgatgacatgagccacaaaattgcagtctagactctggagctaatattaaacatcacatgatcacatgagccacaaaatgacagtctgaagctaatattagtttcacaaatcacaaatgagcatagtcactaagtcagcaacatatgagtctggggcaccattgtcgcgtcccaaatcgactctaaaatacatcctctaaattatgattagaataattaaaatccatgtgaaagccttcaaaaattaaaatgtgcaaagttaaaagtcaaataaggcttggaggatttttgtatatttcctaaaaagcctaaaatgcgtaaataaattttagtggaattttcagagcacaaatgataattaagaagaaataaacaaagttaaaaaggttttataaaaagaaaaaccctaaaaagttccctttccctccccctccccctcttgggccggctcggcccagctccctcccctccctctcctctccccgcggcccactcggcctcctccccgcgcgcgcgccgctgacgggcgggcccgctccgccaccctcgctgacgggtggggcc

SEQ ID NO: 49557 - DNA, 6009 bp, Oryza sativa
gcgccgtcgcactctctttccgcggtcgccgccgagctccggtccgccgccgccgtcgccccggaccatctcccgccccggcgccgcctccttcggcttcgccgcatcctcgccgacctcgtccgcccctccgcttcgctcaccgaccgccggaacgccgtcgaccccgtcgacccgagccgcgccgccgccttcctccgctccggccgccgttttcgtcgtcgccttcgactcggggtgagccgtggaccgccgcttcgtttccccctttccctcccctctctcggtcgctgttccgccgtgccggtggtcgccggcggtgaccatcggggcacgggcgccgcctcccgccggccgcgccgcaatggccgcccccccgggcgcaccgagcggctgccacgtggggctcggccgtcagccgcccgcgccctcgggtgcggctgacgcctggggcccacggcgccggtcggcgtgagccgcgtgcacccggtccaccgtgggccgtgaggctgccgcgtgggccccgctcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcagaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttctgaaattattttgatttaaattattgcattatcgctttatttaaattcccgcgttatcactgttttatttagccatgcctattacctttgttacgaccttattatttttattgctattattaccttgttcaccctagaataaacaaaacccccaactagtggacactctatttgtggtatcactagtatgattttaggtagatgcttcgctgattaattaggtaacattaggtggttttaaaaccctagactgtggtaatattcatatcacctggacactggaattgttggattattgtggaattggattcaccccgccccctctattcaaaactctcaaaatggttttaggctgggctcggggtgcatggttttgatagtcgcacctcggccatataaggaccggtcttcgggcctctgttgcaaagcaccaccgtacttccacatgtctaatgggtaaggcttagtttgtggctcagtctggttataaacaaaagtacacggatggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccggccgtaggtgggattgggtcggtactcttgtctatggctaggatgggttgggaactatgtcacgtcttccgtctgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattttatagctctaggatcgtgtttacaacatagctttgagcaactaagtgtcttttaatgctatttactgcaactcctaacccctatattataattccattgtactcctttgcaattatgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttcttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccgttgggtgatttccggtcgtgacaaccatcatccaatggatcatcacaataaacaaaatacacaaataggcatcatgcacacgttagcttagaaggcactgtcttcgactcttcatgtctcaaactagtgcaagtctctgcatgcaaaagacaagcaaaatacataggcattagtcaattatttgatagcaaggaaatgaagggagtacaatgcaatagtcaattatttttagtttgaaaagaatacctccatcttatcttggatctcttgaagacagctccaaaaatcttgcaggttcttcattatcagcatctacaaaattagttgtaatgattattatgcaaccatgacaatggaaaaatataaatgatcacactatgtttgaatggtacaacacatacacctttgtacttgtttcgtagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagtttgtctgtacactcctcacttgattggctagtaatggactcaatgaacccaaggaggtagtctgttttaaacttaggatcaagtatggtggccaatcccattggtccttggatctccttccaatacttatcaaacttcgcaatcatctcagttgacatttcctctataatattattgccacatgcagcctgtcgacgggggatacccgtagacaggatatagagggtactggggtacgctggtacaaggatctacatagtacgacatcaagcaaataggaaacagagattatactggttcaggccccttggtaggtaatagccctaatccagttgatatgggattatatgatggaaaccacagattacaaagggaacagtggaactcgacgataccgacaagatcgtagtcgagttgatccgactagatctcccagcgacttggctccgataagctccggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttctccggcgatctccggtggccatggatcttgacaagtctacctccaccagtgtgtcactgaagaaactgcaggaggatggcgcccttcccagtcgcgggaccgcggagagggaagtaggaggtactgaaccccagcctgtcctgggtcgcatggttgcggttgaggactttattctctgcggttttcttcctccgccttctgaatttctccttttggtcttaaatttctatggtctttccttgctccatttgaaccccaactccatcgccttcctgagtatttttcacctttgtgaggcctacattggggtagagccgtttcttgacctcttccgcttttactatgagttacgctggatggaatccaaaaaggtgtccgggtgtgttggtttccgacttcgggatggcctgaagtcacgatacatcccctttcagtgcccctcatctcgcagcaaatggcgggggaggtggttctatcttcaggtagaggattcggatcctgccttcgttgttcctgaggagcagccagacaaggttccatcttggaccaccaaacctgccttgaccccgtccctccaatctttcatcgatatcgttgacgacctccgagaacgggggttgtcggggtatgaagttgctgccgatttcattggtaggcggatccagccgcttcaggctcgagcccttcctgcctttgattattatgggccagaggacgcgacccgggtttctcctcgaggtatttcctttttagttaaattgactcccttatgcgcatgttcttcccggcttatcggattctgttctcgatctacaggcttgaatagtgcaaccgtggagcgccgcgtcagccaactgatgatcagcggcccgacaacggcgagcaacgtccccgtccccctttgcgagaaaggggcagccgagcgtgacgctgccatcaatgtaagtgtacttagcggtccttttgcatttttcttccgggatcgcattatgacttcatgaaacataggctcttcctctgactgatatcatcgggccgctcgtggaccatcaggtggcagcgtcgctgaaggagaaggtcgccaaggaggcgtctgacactgctgctgccgctgccacgacgagtggcagcgatgttccgaaaaaggggaggaaattctcctctgtagtcggacattgtcggaagacacccaccccctcggtaagttctcctgttatttgatcacgtagtcggaaaacttccacctcacatcatatcgattgtactccaggcctcggacgcgtctcccccgcctccgcgatggcagcggcttgtgacgctcagcgagaagtaagtgaatgaatttgaggtttcgtgatttcgtcgaactctgtctcaatcgcagcctttcgcagggcggcgcgggcgaaggcagcgcaagatgggtctgggggacctccaacgcgtctcctgccgtggcctcaacggatgtcgttgtcgtgcccaggagccatgaggcgacggatgtctgggggatcttgtggctgattgtggttcgccggctgccgtcctcacctgggaggagctccaggttgagatggggcgcctcctcgaggctggtgctcgcggtgttagccacgaaatcgcggaggcgagggcggcggctgcgtcgtcggcgaacaagcacgccgatcggctagcgcgcgacctggcggaggttcgcgaggacctccagaag

SEQ ID NO: 49558 - DNA, 13015 bp, Oryza sativa
cgacgcgcgcaaggatgtgatggaggaggtcggcgatctgggggagtccgtcctctcgctttttgaagagtagggtcttagctctcttgtactctttagtcatgctttgtaaaacttttattggtctcaaccgccctagtgtgtgcggtcattgccttagctttatttagcattttgatcttgagtactttgttgtcctttgttaccatttcctttgcccttccgtctggatcgacttgatttgttgtgttctcgggagagaagagcagcttgacttagtcgtttccatgctgagcagatctcgagagtgcgcttgctgaccaggatcgtcgcatccagtattggaggacgaagtttgaggtcgcggaactcgagaggactatgctggaggtgagaaaggaccaggccgtagagacactccggggtcgtgaggtgtggttcaactcgtatctgaagagttgctgcacatccatgtcgagagtctgtagagagctccgaataccccgtggggatcccgaggaatcggctgccggatacatctcatggctgaatggggcctatgcccagctcgaaggcatcggtcaacatatcgacgaggccttgaagcaggagtgtcgtcgctcaagccgatatgccggggggcacgtgttggcctgcatacgagatcatcgttcgcagctgcatctcgagttcctccgcgaagggttttctcgttcccagagaactcctacggagatagatggcctggcaaagtcgatggcgccgctggcggagaaggttttccagtcgatggactagcgttgtccttcctggtagtctccgtatcctgtgacaaatgtctttggaaaaagtgtaatatagttttgaattttgatggaattgtaagaaatacttgtggaatagaaaagaaatctatcttactaagctttcttactctggacgtagtgtgtatgagtgtcttctcacttcgcgacttcgatcagtcgtttgagttatacactctccctagcctccagccttgtcatcggagaattcttctcggaagataaggctcttggacctttgacctgcctcggttgaacaagcactgatcctagcccccagccgtgaagttggaaagtttatttccgattacacggcttggttaatacgcacggcgagaactcttacacaaccagatcttacatggtctttcgtctctacaggatccgacaaggccttatcggctctgggtgtccccgccgaagttcccttaggttcctcggaggccttgtcaagacggcgtaaagagacatgaggataggtttcaacgttaggtgtcatctgggtaagggatcatcgaaaaggaacactttgattgtagtctgtacctaaaaaataggctttattgaggctgtaagatgtcttacaagtatggatactattgacttatacatagaatttacgtaattgatcaatgttccaggaatttgccaactcgcgaccatcgccatctgcgattttgaatgcacctggccgcaaaacttgcgtgatcgtgtacggtccttcccatttgggtgagagcttgttgcgccctgcttggctttgaacccgtcggaggacgtagtcgccgatcgaaagcatgcgtgctcggatgcgcttctcgtggtaacggcgaagggcttgttggtagctggctgctcgaacggcaactcgttcgcgatgttcctcgagtagattcacatcgtcgtatcgctgctcttcctgatcctcatcggaatacttctgtactcgtgtactttgatgtcgtagctcggtggggagcatcgcctctgagccgtacacgaggaagaagggtgtctccttgttggacgttgtcggtgtggtacgcacggcccatagtactgatggaagttcctcgacccaattcttgtcgtgtgacatgagcctgtcgtagacgcgggtcttgattccttgtagtattatgccgttgccctctcgacttgtcaattgctctgagggtgagaaaccgagcgaagcagatcttgactcccagcctgatgcagtaatcctggaaatcggcactgatgaactgggagccgttgtctgttatgatacggtggggcaatccgaatttgcagaatatccctttgatgaatttgatggcgttgtcggccttgatttcccccgtgggtgtcgcttcaatccacttggtgaatttgtcgatcgccacgaataggaacctgtagccgccctgtcctcgtgggaatggcctgagtatatctagcccccagcacgataacggccaagtgaaagggatagtctggagtgcttgcgctggcagctttgtgtgtttactgtggaattgacaggcttcacactgttgaaccatgtcgcaggcgtctttgagggcgtttggccagaaaaacccttgttggaaagcttttccgactaatgtccgaccggcggcatgtgacccacagatctcttcatgtatgtcgaggaggaggtgtctgccgtcgtcggacaagatgcattttaggagtaccccgtttggtgccttcttgtatagatcattgccgatcatacagtagacttttgctttacgggatattttctcgacttctgcgtcgtcctcgggcaactcttcgctgcctatgaatttaatgagtggggtgcgccagtcgtccgtggtctcgatatcggcaacggtgcgctctgcctctatagcccccgagctgatgtcgggggcgaccgggctatcttcgccgcttgcctctttcactgatggcctggttaggacgtccagaaaggtgccaggttcgagtggctctcgcctggacgcacgtcgtgctagatcatctggttcgatgttgtctttgcggtatacatgtcggacctcgatcccatcgaaccttttctccagcttcctgacttctgcgagatacttgaataactcggggctagagcacttgtagtctttatgcacctggttcgcgactagttcggaatcccctttcacgatcagtcacctgactacgagcgcagctgcaactcttatccccgcgagtagtccttcatattcggctgtgttattggttgccctgaagttgaggtgaattgcatgcttgaattgatctcccgaaggtgatgtcaagatgaatcctgcccctgctcccttgctgttgagtgcgccgtcgaatgccatggtccacgtttcattgtcgatttggttgtctgacctgttatcgggcatggtccaatcggctacgaaatcggcgagtacctgggacttgatggctgttcgtggcacgaagtggatatcaaattggcttagctcgactacccatttggcaatgcggctgacaacatctttatttctcatgacttcaccgagagggaaggaggagacaactgtgaccctgtgggcttggaagtactggcatagctttcttgatgtcatgattactgcgtagagcagtttttggatctgtggatatcttgtcattacgtcgtggagagcttcgctgacatagtagactggtagttgcaccttctctctctcaacaacaatgatagtgctaacggaatatggcgtggcggcaatatagagaaataattcttcattaggttgaggggcaacaagtacatgtggatttgataggtagcgcttgaatgcaatgaatgcctcttcggcctcctgtgtccatacaaatttgtcttgttttttcagcagagcgaagaaaggttgtcctcgctctcccatcctagcgacgaacctgcttagtgctgccatgcatccggttagcttctgtacttccttgagtcttgtaggcgacctcatgttctcgattaccatgatcttctcgggatttgcttctattcctctgccggagacgaggaagccgagtagcttgctgtcacgcccggaatttctatccaaaattccaaacgcttacatgtgtgtgaaccctcgtccaggaatcagccgaggcacacaataacaaattgataatagagtacaattaatactctaatttaaacgaataaaatattattacagaggtagatagttcctctcaatcaataaagatctaagcagcggaaaataaaataaacggcgcggacggctccactccacaggcagcttgaccaaggctacacctaatcctccacaccatcagcctcattgtagaactcttcctctgatgaatgattgcaaggtgagtatatgacatactcagcaagtcacgcagcaaatatgcaagtgcacaaggataccaaaggatggcataatagggttttattttgcaaaagcagcatttagtaaacatttgagaatttaataaaacagtgaagtattaaacaatattaaaccaacgctatacaacataccctgttgtataggcccaaccattctgaacaaccattcccggctgaacagatctaatctccaaaccaggaattaaccattccaaaccaggagctaaacaaattataaccaaataaagcatcatttactatggtgagaaatgtgagactaatcacgaaaaacattgttagacccgcccataaccgcgggcacggctattcgaatagttttactctgatcagaggtgtaccactgtacccacaagacacagccccacatcatgtcaccatgtgccttagtaccaccacggtacctcggaaaggagctgtgacattacctctcgcacaacacaatccactacagtgcaccgttcctggatcataatctccccctcaaaaccagaggtaatggactccccagcgacccccgtgggcttatctccgccacttctcaacctggtgctctgcaatgaaccatgctatacaaaagataaagccgttgcccacgctagcttgtggttggcacggttaatgtttcacaaccgaaactcgtgaaccggtccttaattgtcatgagcacgaccaacaaaaccatgtgctcacaacccaccattatcaggttttagttagcacattaattaattaactaatcacgattaaccatcgtgaactatcattaagccatcattaaattatagtgagtcattagttaacccaaaagtgaactagtgtttctaagcagggctaagcaattacatctaatatctagctgaaccaatccaatatgtaaggtccatgctagtcaaattataataacccaaggtatcaaggaataaggtaaacaagaacaaaagggccataacaaagaataggttaaatccacccaatgacattcgaaaataaatgcaatagttgaatagaaacaatagctttaaataggatcaacatgctcaaagggttgtttgggatctgtgtgacttgccttgctggccttggaactcttcaaactcttctccggcgaaaacgaactctccggaaacgacggaatctaagaagaaaagagaaaaatcaccaaaacagcacataaacaagcatgaacagtacatgtggatatttttaacatgtagatctcaattttagaaaaatttagagacttgaaccaactaaatcggagctaatatgaattagttatgaatttttaaagattaaatcggattaaaacacttaaaccggttttaattgaattatgacgcaataaagaattatttttgaaaggaaaaggggatttattgcgtcagcggctagggtttgcggtggaccgagcgcactggcggcggttcacgcgaacggacggccgagatcgatccaaccaaaacggacggccgagatcgatcgggtccacgacggctcacggcggacggccccgataacgtcagcgatgacgtcatcatcggcggcggcggctcggcggctcgaacggctcgggcggcgcacactcgccggcgaacggtggcacgaggacgcaaacggagggcaccaacgggtagcggacggcacggcgaactcaccggcgaccaaaacgacggcggaaacccaacggacggcggcggcgacgaagaagaagcggcggagctcttcggttcgacgacggcgatggtgctccagcggtctccgacggcggcgaagcaacggacgaggacggcggcgacttggcgatcccgacggtggccttcccgagcgacggtgacggctggaacggcggcggcgcacggctggagcgacggcggcgacggctgagctagggcgcacggcgctagggcttctccgacgacgagaggcgaaggcgaagggggcgacgggtagaggagagctcggggggtccttttaaaggggctcggaggcggcggcgaaggcccacggcgaccggcgacgagaaggaaagatcgggctcaaagccgatccgaatcgacctcgaacccatcggtttccaaaccgatttagccgaagattccaaaggagaaaaggtggaggagatcccggagatcatttcccctctattgattcggccggaaacggaaagggacggccggatttggaaaggaacggcggcggcggcggctagggtttcgggcggaggccgacgcgaggaagacgacgacctgacaggtgggacccacctgtcagcgaccgaacgcgcgcgcgcggctgcggactgggccggctgggccgaggagagagaaaagagaggtttttgagccgactttcggcccaaagccaaaagaagatttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattattaaaattagatcttattttcaagacttttaaaaataaattctaaaaattccttttaaacaacaatttataaattttgaattttcagggtgtgacaaacctaccccccttaaacagaatctcgtcctcgagattcggaagaactggcgaacagatacggatgagctgacttcaattcatcttctcgttcccaagttgattcttcttccgagtgattactccattggactttgcaaaaacggataactcgattcctggttcttctctcatcagtttccaaaatacggattggtttctcaacataggtcagatcctcttggacttctatctgttcaagattagcttcttcggtaggtacccttaaacactttttcaattgcgacacatgaaacacattatggactcctgccaaagattgaggtaactccaactgataagcaacctctcctcttctgctgactatcttataaggtcccacaaaacgcggtgccaattttcctttggtgtgaaaacgatgaacccctcgaagaggcgtgacacgaagatacacataatctccttcttcaaaactcaaatctctgcggcgattgtcagcataactcttatgtagagactgagccacacgcaatctttcttgaatgattttcaccttttcttctgcttcccttaagatatccgtcccgaaaacctgacgttctcccgtttgatcccacaaaagcggagtgcggcactttcgaccatacagtgcttcgtaaggagccatctgaatactagcttgataactgttgttgtacgaaaattctacatagggtagattcttatcccaacttccaccgaaatctaaagcacaagctctcaacatgtcttccagaatctgattcaccctttcggtctgtccgtctgtctgcggatgataagcagtactaaagttcaacttagaacccatctcttcctgaagtttcttccaaaaatttgaagtaaactgactgcctcgatcagacactattttcttagggacgccatgcaaacacacaatccttgccatgtacaattccgccaaccgacttccagaataggttgtctttaccgggatgaaatgagctactttggtaagtctgtcgactatcacccaaatagagtcatggcctgatgacgttctgggtaaaccagtgataaaatccataccgatttgttcccatttccattcaggaatcttcaaaggttgcagcaaaccggcaggtttctgatgttctgccttgattcgctgacaaacatcacatactgctacgtattctgcgatttcacgcttcatacttgcccaccaaaatctttccttgagatcctggtacattttggtactaccagggtgaatggaatataaagtatcatgagcttctttcagaattgcatcctttaaatctttgttgtcggggacacaaattctctcacccaaccatacagttccttgctcatcctccaagaaaccgatagcttttcctcttctcatattcttcttgatctcttgaatatcaggatcattaatttgggcttctctaacttgatcaattagagtgggcttcgcttctaaggctgcaacgaaacctctactgacaattcccaaatttaatctttcaaattccttgcataattccaatggcaaccgttgtccttccgtagcattgcaatagcctttcctactaagagcgtctgctacaacattagcctttcccgggtgataatgaattcccatgtcgtagtccttaattaattccaaccatctcctttgtctcatgttcagatccggctgggtaaagatatactttaaactcttgtgatcggtatatacctccgttcgagtaccgaaaaggtaatgatgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcacaatacacttggaaacccttctttggatcaggcaaaatcaagataggagccgatactaaacgattcttcaactcttgaaaactctgctcacattcttccgaccacttgtacttcacatctttctgaagcagtcgtgtcataggcttagcaatcttggaaaaattctctataaaccttcgataatatcctgcgaggcctaggaaactgcgaatctctgaaactgtctttggttgcttccaattggttacggattccacattactaggatcgacggcaactcctcctgctgagatgacgtgaccaaggaacttcacttcagacaaccaaaattcacacttgctaaacttagcatacaaccgatgttctcttagcttctctagtgcaaggcgaagatgttcttcatgctcttcttcagttcgggagtagataagaatgtcatcaataaagaccaccacgaacttgtctaggtattccataaacaccttattcatcaagttcatgaagaaagcaggggcattggtaagtccaaaagacataaccgtacattcgaacaatccatacctagtggtaaaagctgtcttaggtatatcttcctcttttattctcaactggtgataccctgatcgaagatctatcttggagaaaacagtggcacctttaagctgatcaaacaaatcatcaattctgggtagcggatacttattcttgatagtcacatcatttagggcacgatagtccacacacatcctctgggtatgatctttcttttccacaaaaataaccggagctccccatggtgatgaacttggtctgatgtatcttttctgaagcaaatcatctacttgccttttgacttctgccaactcattggctgccattcgataaggtctcttatggatcggagttgttcctggtaccaaatctattctgaactctatatcccttttaggcggcataccaggtaaatcatctgggaacacatcgggatactcccggactataggaatctcttccaaagttatttggttcagtctcgaccttaaagattcagaagacaatgcatgaacagttacaactcgaccatcattgctggtgagagttacttttctgttagcacagtctatcacacctttatgtctggctaaccagtccatccctaggatgacatctaggtctttggattctaacaagataagattggccagaaatggtactccttgaatttctattctgacagaggggctacgttgcaaagagagtgcttgattacttggggtactaaccatcaaaggacgtctaagatcttctacttccatcccatgatttccagcaaaactcatagataaaaatgaatgtgtagcaccagaatcaaaaagcactgttgcaggaactaagttaacaaggaacgtacccaaaatcacatctggagcatcttgagcttctgcagcagcaacatgattgacacgggcctttgatactggtacagtagagttgttctgagcagggacaaccttcacgcgtcggggcttcggacacttgtcagcataatgtcctggatctccacagttgaaacacaccgcgggcttgctgccttgctccctcttgataggttgttgctgtgttggagctgcaacaggacgcggaacttgattacgtatgttgttgccagcattgttgttgaagaactgacgctgcggacgaacaacggacgaagaacttccatgtggtatggactggggtcctaaagtaagacgcggcttctgattattcccctgttgtgtcttgaattgagcaatccggcgtttcttctgctccatgcaattgtacttgttctcctggcgaatagccttatccactagcttctggaaatcaggataatctccaatcatgagtgaataagaaagctcatcattaagtccttctaagaacttctcctgacgctcttcgtcattgcgcacatcttccggagcataacgagcaagacgattgaactcgtgcagatactccgtaacagagcgtgatccctgggtgagcgacctgaattccttcttcttgagagacaccactcccgatggtatatgcgtcttccggaaagcagcggtaaattcaagccaagtgataggttcagcagtagttctgttaaggcggaaatgatcccaccattcagaggcagggccatgcaactgatgcgatgcaaatgagaccttctcctgatcagtgcattgaagcaaatccaacttcttctctatggcatgcaaccaatcacctgcttccactgggttggtagtgctagaaaaggtaggtggcctcacacgaagaaaatcagttaacctgttctgcggaggtgcatggttatttccttggttctgctgattctgaagttgctgcatcatcatgttcataagttgcacctgttgagccaggacttgggcaagagttgggttcccttcattgttattattattgggattgttggggccattcccattgctgcgagtattcaccatcttgctggacagggcacaagaagagaaaccggggggggaaactacttaggacagagaattactttaacttttattgatcttaactgagttttattacaaaactgaaaactctcacaccactaaactcaccaacttcctaacactcaaaagcaaacaaacacatgcacttacatcccatcactgatgtaaattacatgcgaagcacacacaagcaacttaaagcaagcaaactaacacaacgatctaagacaacgacttaacaagtcactctagttcttccgagcatcggaggtcgattgaaggctctttcggctcatcttcatcatcttgagttgctacccactcaatcttggaatggttgcgcttggattcttcttcctcatcatcacttatgatgttgaccggaggatctgctagagttggggcaacttctttctccaccacacgaacctttggcgccaattgatagcgagggacaaatagagctctcttccttgcggtaagacgaatcctggccttctgcggtggtgcttctcccttcaatgcggctagttccttctccaaacgatccaccttgtcttctagcttgcaaatcttaccacgattccgatcttcacgatcttgagccgctaacacagtctccgcacgactttcatccatagcccacagcatctcaaccaaatgccttgtggtagcatcattctcaattccttcagtctcaaggtagctgccacggtcacttccctggggttgacgaggatgatagcgatactcagtatcggccaactgatcactgtaacgatcgcggagctctcctatggcgatccttgccacctcctgacttgcatggatgtagtttcttcctccagcttcgaacatcactgaggggatatcttcactattactgttcaaggtgactttgactcggcacttctcttcatgacgatcatgaggaatctgggcataaaaaggggcagtcccaaatccaatgacaaaggacattgtacgcaactcctggacaaaaccctcaacaccaaacaagtactcaggcttgtagcgcggcatctaaagacaagtgaaaagagggagttaagacatttatccaattaatagcacaagttttgggattaatttgaataaagtttagaagatcaaagtaaaaggtaattaaataaagtaaaccaagcttgcaagataagttgaaacagttggaaatgaattttgtacttttgaacatcaggttccaaaagaaataaaagaaagttataaaatcaacatgttaaatttattttattgcagcaagattaaataaaacaatattgtaaaacttttgctggtaaaatgagccattagtacagtaatagatgtacagtactaataacactggaataaatttttgaacgagaaccattaaaacagattatgaagtgcatgtgctattagtttggtttaattaaaagagaaagggaggagaacagttctatttttccaacatttttagagggcttctatgggtaaccatttggcataacctagggtcaaggaagctctgataccaacttgtcacgcccggaatttctatccaaaattccaaacgcttacatgtgtgtgaaccctcgtccaggaatcagccgaggcacacaataacaaattgataatagagtacaattaatactctaatttaaac

SEQ ID NO: 49559 - DNA, 707 bp, Oryza sativa
cgaccacgccaccttccgggatgctagctcggaggatgacgctaccatcgtgcacctggcgcgcatggtggaggcgtacgacgcggctcgtatcgacttccatcagatggtgcgccgcgggatggtcgagaacaacttgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctggagtggacttgcttcgtcgagacccctcgtaccgagcccgcgcccgtggttcctcaggagggggaagcctccggcgttggtagcacggaggatgcgctgttgctcaccttccgtcctggcccgtcgcagcggtagacgaccagttagtaggcttgcacgtgtgttctttctcgtttgtcttcttgttggagtcgtgtggggcatggttatgccggtgtgtggtataactgtgtcagagcctgtctttattttatttgcttaagcaacttgaacttgaactttaatgaacccatttaatagcagtaataaattcaagaattatagtagtcgtgggtggttagttttaattgtcagcttctctcttgatgaactgctgtac

SEQ ID NO: 49560 - DNA, 10652 bp, Oryza sativa
cgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgagccggccgccgtcgctgacgtcatgctgacgtcaaccttagggctgacgtcattgtttccagggctgacgtcatcatccctttttccttttcctttttccttttttctaatagatcaaatctttggaaaatcataactaaataaccgtagatccgttccaggtggttcaagttgctaaattcttctaaaataaagatctacatattaaaattgtccataaattgagttaaatttatttaattctttttaaatgggctttaattagatttaatcttgtaaaattcataataaattcatttgaagtcagaatgaggccgttcaagtctcataattcatctaaaattatgatctacatgtttgtttactttttatgtactgttcatttggtttttattagtctttttcttcgttttgcgtgttagcttgtcgtttccgtcgttgcgaaggttcgtgagtgcgccggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgtcatatatatatatataattgcttagcaatgcttagaaacattagctcattaatgggatgaattatatacactacattattattatggttatatttaatggcagctcacgatggtcaatcgtgattggttaattaattatttgccaattaaaacttgataatggtgggttgtgagcacatggttttgatggttgtgctcatgacaattaaggaccggttcgcgagctactgttgtgaaacattaaccgtaccaaccacaagccagcgtgggcaacggctttatcttttgtatagcgtgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacagcctctattcgggtactttccagtatcgcgacgcatggttgacatgatgttgaggctgtgtcttgtgggtacagtggtacacctctgatcagagtaaaactattcgaatagccgtgcccgcggttatgggcgagttgagcaatgtttttcgtgattagtcccacacctctcacaatagttatagatgttatacctggtaataatttgcttagctcctggtttggagattagatctgtacagccgggtatggttgttcaggatggttgggcctgtgcagcatgggtgtgctgttcagtgttgattaaaatttctgattaattactccactgttttacttctcttaaatgttttgctaaatgctgcctttgcaaatgagcctatattatgccatcctttggtatctttgtgcacttgcatatttgctgtgtggcttgctgagtatgtcatatgctcaccttgcaataatcaatcaacctcagttgaagaaaaaggatccagaaggagaagacgtttggcttaggcttataccccagttgagctgcctgtgggagtggagccggagcttcgctagattttattttcccgctgcagttttcttcttggtgaggactaagtgcctcttaagtaagtatttatcggtttagttattatgatggatttgtatattaaattgtcagtttgtgtacctcggctgattcctggacgaggattttatgcacaaatcagttcggaaattattagtgaatttccgggcgtgacaagttggtatcagagccatctcgactgtaggataagccaaatggtcaaaccttaaggactaattttccgaaaacataatttgtgaaagtttctcttttcttccttatctagaattcttcgcaaatcgttttgtcgttctctcctcttttccctctttcaacgtgagtagttgttaaacttgatggagaaactcgaaggcgtcgatgttgtcaacttctgcaagtaaagtggatcgaggaagaaccgaagtgcccagatatcaagatagagtgaagttggatcctagtttagaacctatgccgccaaagtgtctttgaagaatagttagtaggatagaacgtttgttgcttgcttgtgtgtaggtatggttgcattcccgtcattggagtagtccaatgatgagtgtgtaactatactaggttgtttgcttaatcaacttgaacaatataatggtttacacacatcagatcagtgttaaactggttaaggtcttgtctttagtgtaacccctctccttctatcttctctaatctgcaacagatggtgaacactcgcactagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccacctactttttctagcactaccaacccagtggaagcaggtgattggctgcacgctgttgagaagaagttggaactgctccagtgtacggatcaggagaaagttgttttcgcttcacatcagttgcaaggacgtgcttcagaatggtgggatcatttccggatgaacagagcagaaggacaaccaatcacttgggcggagttcactgaagcattcaagaagacgcacatacctacaggagttgtttctttgaagaagcgtgagttccgggcacttaagcaaaaggatcgtacagtgacggaatatcttcatgagttcaatcgtctagctcgctatgctccagaagatgtgcgtactgacgaggaaaggcaggagaagtttttggaaggcttaaaggatgagctgtcagttatgttgatctctcatgactatgaggattttcaggagttggttgataaagcaattcgactggaagacaagaagaacaggatggacaatcgtaagagaggaaggattgttttccaggaggcacaggatagtagccagaggtagtgtatcaagccactccaaattggtgaatctttttctgctggtcaaggacagtcacaacagttgggcatcagtggtgagattaactcagagactaatgcaagcaatgaaggcaatgatgagcaagctactcaatcagtgtcatttcagcaggatcagtctcaagaagataacagtaatggaagggagcagcgggtgtgtttcaattgttatgagccaggtcacttcgtaaaagagtgtccgaagccgaagcgtcaacagccacaaggccaagtcaacaacattgtcctcacaggagcaaatgcagtgccggttgtgtcttcaagtgttacaactcagccactagtatcaaagcagcagtagttttctttaaagccttagaataattatcgaagttatggaataagatagactgcagtttatctatgccctttttctttctagccgttccgaatctcgggacgagattctttgtaaggggggtagatttgtcacatcctgattttcgtttcaggatttataaattatttaataaattattaatagaatttatattaaatgttctttaatttacaagtgaagttaaatgtgggaaataaaatttcctaaataaaaaaaaagcatggatggatttaatttttattaagtcctccatgattaattatactctctcgaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatccggcccaactcctctctctttctctctcttcccgcgcgcggcccacgccggcccagccgagccgcccgctcctcctctctccagccgctgacatgtggggcccacatgtcagggccgtcttcaacctccggccgccgcgccgccgaagcccgaaccctagccgtttttgcgccgccgtttccggccgaatccgaccccatctcttccaattgattgaggggttttgttcctctcggtctcctctttcttttcccccaagaatcaaagcaaatggttgaggattcgatccgaatcgaactcgttttgttttatctctaaaaaacgagtccgagttcttcccgattcgattcctctcgtttgcgacttgatctcttcgattcgagctcatataaaccttccccgtgatctcctctttcgtttgccccctttcctgagtcctcccgtgcctcctagcgccgtcgcgacgagctccaagtccgccgccgccgccggccatcttcggcatcgtcgcgccgccgtctccgtcgtcgctgtcggtcgccgtcaccaccgttaggtgcgccgtgaggagaagaagctcggccgcccctccgtttttgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgaaagctcggaacagctcctgcggtcggtggagtcgaaagcgtcctcctgctcgtcaccaggtccctctgagcgactcctggagcctggcagatacgtctcgccgctgcctgactgcgagccactggagctgctgctgctgagatcgctgctgccactgggagtagcagacaaccaacccccggtgccactggctggacctctggcggctgacgctggagcgaaggagagagcggacgcgggagctggagctggagctggagctggagctgcaggaactgcgggcagaactggaggtgctgcgggagctgctgctggaggtgggtttctgggcgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtccccacgtaaccatggacctccaagcggacacggtgaggaagctcgccactgagcggtggaatggtcgtgtactccggcgcgtcggggtagcccaccaccagtgtcatgcgtgccaactctgccacgaaatcgatcatgccttctccgcggtggttgggtgggtgaccggccatctagagaagacaaaggagtaggatcaatgcatgctcaaatccaaatttaaataaagcaataaaagactcaaataagggaatcaaataagagcagaattttatgcatagatcattttacatgagagcgaataaataagacagactcacataacgataaaataatgagaaattagatacataataataataacgaacaaagcataaataccttgcaacccatgttacagagctaggacctaatgcattgcacccatcaaaccccaactaactgacgaataaatcccaataattttactaaaaccctagactgactcgttttgaaaaatctcacttaaacgagcgaccaagatttttcccttgaaccacaagaacagatccccattttcccggaacaaaaccaattgcaaagaacatatgcaatgacaaggattcagagggctcttaggtttttccatttggcttgtcctacggtcaaggtcggctctgataccaacttgtcacgcccagaaattcccgaatagaattccaagcagaatgtgcaataaaatccccgtccaggaccagccggggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaacagttgtaataagtaattaagcagtattaatcatccactgtccaacgctacaccacgttgcaacaggcccaaccatccacctaaactatccaaattaaaggattacactaaggtgagactaatcacggtgaatctggttgaccgcccatgaccgcgggcacggctattcgaatagttttactctgatcagaggtgtacaactgtacccacaagacacagccccacgacacgtttccgtgcgccgacatgccaccacgacataccgaaaagaggccgtgacaggacccttcgcataaccccctctagccaagcacaccacacctcaggtttcacccccgtccccagcgggcgacgggcagtcccctctcgtgcctaggtgaatccggaagtgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgaccagcaaaaccatgcacccacagcccaccatgtgattcattttatttaaccaacaccagagcggtggtattaaaccaacattatcatataaacttatagtctaggttttaaatgagattccccattgtgtgctagttgaactaggcatggctaagcaattcctagtccaaagtctaatcatgttataacccaggctaacaaaggagaatgatatccaaaagcatggctataacaataggtaaccatcccatagtactattataaaacaatgcaatatttgaaagaaaacaatagagcatttgcaatataggatcaacatgttcaagtgacaagcatgacttgccttgctctgctgctggagggacctcggcgactatctcgaagtacaccgaagcgtcggaggaatcggaatctagcgacatacaaagcaaatattgcaaacaggctataagactactgaaacagagaacaaaaccatttttaatggattctacacatttttcttgatttactgagacttgaatggacttaaacggagctcggatgaattagttatgaattttagaaggttcactgtgtttattactataaaagaaaaaccttaaacaatttattgcgcaatattaaccagggctgacgtcagcacgggcggcgcggcgccgacatgcgggacccaccggtcagcggcacggggaggacagaggaggcgtcggcccgcgggcccaccggtcagcggcacggggagggcggtctaccgtggaccgggaccacgcaggtgatccaccgccgatccacgggaccgacggcccggatcgccctcgggccgatcggacggacggcggcggcggcagcccccgggctcggatcggcatcaaagccgatcggccgacccggggctagcggcggcggtgcgtgcgcgtcgcgtcgctggcgacggcaaccggcggcggaggcgacgcgaaagcggcggcagcggatggcggcaacgacccaaagcgacggcgagcgcgggcggcggcgacgcacggggaaacggggaaggagaggagaggagatgcctcaccgagggtggccggcgcggaggaagacgatggcgaatggcgacggcaagccacggggggcgacggcgaccggcggacgagctccggcgtgccctaaggaaggagaagggagggattagagagagggagatagaccccggcgaccggcattcgaggccgaaagcggcggtagggtttagaccctatcggagcgcgaggagacgggggttccggcggcgaacctcgacggggaaggggcggccgaggtagatctcgaccccgcgaacccgacggcgacgacggaacggtgcggcggcgaccctagcggtggctagcagcggccgaagtagcaaaaacggcggcggcgggtggttgcacggcgcgggagcgttggggggctcgggagaggtcggcgcaatggggaaaaagagagagggggtgccggcgatgcttaaataaggggagagggggccggacgtggccgggagcggcgggaatcaccggccgacgtgggggagtggggaggagagagaggcgggattcgattttcgaatcccggccatctcgggcgcgggcgcgagcgggagagagaggggaatgggcgcgggggatgcggcgcacgcgcgggcgtggtcgacgtggcccggggaaggcggagacgtgggcgcggcgacggttgcgggcgcggcggcgcgccgggatcggcgggaggagggagacgggcccgacaggtgggtcccacctgtcggcgaccccgggagggagggaggcgggcgcccggctgccgggctgggcctcggcctgcggccggcccagcagagaggagggggaaagagaggggaaatgggccgacggcccatttaacaaaaaaggaggaaaaagaggggaaaaagaaaaagaaaaaggaaaaaggattttccctggaattaaaaattgcactttggtgatttttaattggttacaattgtttctagagctctgaaaattccattaaaaatcctgttaatgaatttcgacatgtagaactcaagaaaaattccacatgtcaaatccgattattatttgcattattttcttagggttttctcctgatttcacctgcattttcttagggtcttttataaattacaatttggcttgggaggaaaacttcggggtgtgacatcagcgcaccttcagaggcggacgacattcctgtcccactctgcgagaaggactcgaccgaacgcgccgccgcgattaacgtgagtgtactcgatgattcctttacatctttcttctcgagatcgcgttgtgacttcatattgtgcaggctctccctctgacggacgccatcggaccactcgtggatcactaggtggtgacgtcgttgaaggagggcgtcaccaaggaggcatcagacgctgttgctgccaccatgtcacgactggaaataacccaacaggcattccttatgtgcgtgcattattccttgtcccaggaggcaaggtacaccaaaagttgatacaattcagagtttaacaagcggaagcgtaaataattaatttattacatgggcggcgaaggcccagcatacacaaagacaaacgggaaacagcggaagactagggcgatgaccacaggcgcttaacggcaggcacgagctaaacaccaaagccttcatcattcaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttgtaaatacgatcctagagctataccagattattaatgagggccgtcaacccacacgaatctgccttaacccaaggcctacgatgattcag

SEQ ID NO: 49561 - DNA, 6088 bp, Oryza sativa
cttcctcttccgaatgatgactccactgaactcggcaaaaccgggtgaccttgtttctggttctcctttcgctggtatccagtatacgaaccggcttctcaacataagttaggtcttcctggatatcaatgtgttccgaatcagcctgttcttcaggtacccttaagcacttctttagttgggacacgtggaacacgtcatggatgccgatcatgttggatggaagttctagctgataagccacttctccccttcgttccaagattttgtatggtcccacgaagcgtggtgccaacttgcctttcgtctgaaaacggtgtactccccggagcggagtgacgcgaaggtacacgtgatctcctgcctcaaaagtgagctcccttcgacggttatccgcgtagctcttctgtcgagactgagcaatcctcaacctttccctgatgattctgactttctcttctgcttccgctaatacttctgttccgaatagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgacccgctcggtctggccatcagtttgcgggtgataggccgtgctgaaatttaaacgggtccccaattcttcctgcagcttctgccagaattttgaggtgaactgactccctcggtcagatacaatctttttgagtactccatgtaggcacatgattctcgaaaggtaaagctccgccaaccttttgcccgtatatgtggtatgtactggtatgaagtgagcaaccttagtgagtcgatccacgactactcagatcgaatcgtgacccgacgatgtccggggcagtcccgttataaagtccattccaatttcttcccatttccattccgggatttgaagaggttggagtaaacctgtgggtctttggtgctctgccttcactcgttggcaaacatcgcagagtgcgacgaattcagctatttctctcctcatgctgacccaccaaaacttttctttgaggtcttgatacattttggtgctgcctgggtgaatggagtactgggtctgatgagcctcggtgagtatcagatccttcaattccttgtcgtcaggtacacacaatctttctcccatccagattgtgccatgctcatccttaaggaaatcccgagcctttccgactctcatgttctttttcagttctgctatttccggatcatttacttgagcggctctgacttgatccacgagcgtaggccgtgcctccagagcggctacgaacccgtgttcaacaattcctatgttgagatgttcaaactcctgccgcaattcctcacacatgctctcgatgcatagagcagtgcagtaacttttccggcttaaagcgtctgccaccacattggccttacccgggtggtagtgaatactcatgtcatagtctttgattagctccaaccatcttcgttgtcgaaagtttaggtccggttgggtgaagatgtatttcagacttttatggtccgtatatacttcgcagcggttgccgatcagatagtgcctccagatcttcaaagcatgaaccaccgctgccaactccaagtcatgagttggataatttccttcgtgtggacgcaactgccgcgaggcatatgcaaccactctgccctcttgcattaggacacatccaagtccgtgacgggatgcatcgcaataaacttggaagtctttcatctggtcgggcagaatcaaaactggtgcggatactaatttcttcttgagctcctcaaagctcttatcgcactccgctgtccatttaaatttctcatctttcttaagcaactgagtcatgggtcgggcgattctggagaagtttccgatgaatcgacggtaataacctgccagtcctagaaaacttcgaatctgcgacacagtcttcggtggggtccacttggtaactgactccacgttcgatgggtcgactgccacaccctgagctgtaatgacatgacccagaaatttgacttccgtcaaccagaaatcacacttgctgaacttggcgtatagctggtgctccttcaacttctcgagtaccagacggagatgttgttcatgttcttcttcggattttgagtagataagtatgtcgtcgatgaataccacaacaaacttgtccagaaattctatgaacactttgttcatcagattcatgaagaatgcaggcgcgttagtaagtccgaaggacataaccgtgcactcatataacccgtaccgagtggtgaaggccgtcttcgggatatcctcttcccggattctcaactggtggtagcctgagcgcaggtctatcttagaaaacactttagcccctttcagttgatcaaataaatcgtcgattcgcggcaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgttaattcgttggccgccattctgtacggtctcttatagattggagcggttcccggtgccaaatcaatccggaattcaatctctctcttgggtggcatggtagtgaggtcttcggggaacacctctggatactcgcagactatgggtatatcatccaattttctcaagttcttctctacggtgtccactgggatttccgtctcaatctgattcaacgagactcctttctttggcgagactagagatttgtacaccacggtttctcccttctcgttggtcagggtgactgtgcgattcgcacaatcgatgactcccttaaacttggtcagccaatccatcccaagaatgacatctaggtctttggattcgagaaggatgaggttggctagaaccggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaggaccctggttttgcttccgtctccttcttggcttgcgcgggctggcctgactgtgccgatgccactggtgggcgtggagctgcaccgcggttgggctgacctccatggtggttctgactgtcactggtgccctggtagaagttgctagggttgaacgggcggtgctgacggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcagcgtagtacccggatatcagctggttggtcagctcatcatccaggcccgccatgaacttctcctgcttctcggcgtcggtgcggacatcctctggtgcatatcgcgtgaggcgattgaactcgtggaggtactctgtcaccgtcctgttaccctgatggagtgcacgaaattccctcttcttttgtgccacgaccccatctggcacttgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctattgcatggagccagtcatttgcctccatagggttggtggtgctggagaaggtgggtggcctgactcctaggaactcaggcaatttggattgagggggagggggaccaaagtgctggtgctgctgttcgacgtgctgcatcatcctctggtgcatttgctggtgttgttgctgcatctgctgcatcatggctgccatcatctgagtctgatgcgccataacttgggcaagggtcggattctcgggaagtggtggcggaccattgccggaatcactgttggggtgcacgccatcaacgcgttcttcgccgttgctgccctcgcctgtcgtgcggttgccagtcctggtgtagaccatctggagggaagagcagccggggtaaagaagaaaaacagatgctcaagaactaagctttattacaaaggaatttaaactgcaattgttctgatctgaattaaaacacttaaaagagcaagcaaccaatccttattaagacagccataccataggcacatgatatcgaccgtcgtctgacccaaacaaacaacctaaacacacaaactaacgaacaaaagctagacagtcggtaaactagtgggaaaacgagcataatgctcggaacggctcctgcggtcggtggagtcgaaagcgtcctcctgctggtcaccaggtccctctgagcgactcctggagcctggcagatacgtctcgccgctgcctgactgcgagccactggagctgctgctgctgagatcgcggctgccactgggagtagcagacaaccaacccccggtgccactggctggacctctggcggctgacgctggagcgaaggagagagcggacgcgggagctggagctggagctggagctggagctgcaggaactgcgggcggaactggaggtgctgcgggagctgctgctggaggtgggtttctgggtgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtctgtcacatcctgattttcgtttcaggatttataaattatttaataaattattaatagaatttatattaaatgttctttaatttacaagtgaagttaaatgtgggaaataaaatttcctaaataaaaaaaagcatagatggatttaatttttattaagtcctccatgattaattatactctctggaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgtgggcccaatcc

SEQ ID NO: 49562 - DNA, 3837 bp, Oryza sativa
aatagattatactctgatcagaggtgtacaactgtacccacacgagatgaacaaggatcaaatgctgcccaccacacaggtgcgacctacaagtgattcaagctcatcacatatcctttcctagcccgaccccaaccatttaaaccacaccgaggcccccgacgactcagtcacgtgcgtgtgatgtgactaaggcgggctcaccacgcgggagataccccatgccatacctcggccaaccgggcactccgcggatccgaaatcctcacgtttctccgatgggtgtaaatgatcacggtaggtctagtaatcaaacaagccggtcccatgatacggcatgtggtaagtacgtaggttgcttgaatagacgtcaaaatgttcagtccttaacgacccagacggagctactgcatcaggggaaacatacctcccatcatcgccctaccacccgttcaagtcaatcatatttcatcaaccattatttaatgtaagtgcttcagttttagcccattaaccaagttgtctatatcccagaattaacaaaactgtccagccatatagttgtatccccactaagcaaaactaagcataatgaataaaacatcccaactattcccaaccaggagagtaataggtatatggcagctatatataactaaggtaaatgcaccaattaattatataccatgtcacccaaaactattaactaagcaaatgcatatatatatatacatatatatatatatatatatatataggacactcatatggggcaccatggtgcccgggcaccatggtatcaaatgcacaaaatcacttaaattttttaaaattttcaaattgtgagtatatactagttataataactcgattcatacctatacctatcaacaaaacaactcaaatttaactttatttcacaatccatgattacatacctaactaattatatgtatggatgctatatacctagaatcaaaatctaacaaaaataagttcaaattcagttcaaacttgctttgaactagttagtaaagtagctaatgttaatatctaagtaattgaaaaagtttcatactcatttgaattgggtatatactcaatttcaacaatggtgcccgggcaccatggagcaccaaacaaatttactatatatatatatatatatatatatatatatatatatatatatatatattcacaaccaaagtaatttaagtaaaacatgggtgctagatgcttaggtgctcgccttgttgttgcagatcatcagactcaatctcaggttcttgctccacgtactccgaaacatctgaatctaccgataaaagacaaatatgtaaataagattcaaataaacatgcatatgcaacatgctctataaattgatagataaatacagtggacaacgtacaagttgacataaaaactacatttgctgctctagcttaggagatacacaactaaccagtcatatacactaaaatggcaacttttgaaaataaaacaaacagacccaaccatatactgatatttttagcaaccttacgtgaataaaacttatatcacaccaaggagccaaattcactggttctaatataatttgaatcacccaatttagacttggaatgaagtaactatgcgcgttgacttaatgtgacaaatggaactgctactcgctgccccttagcagaaatttgatttcatagcttacaattgaaagaaatgatataggtgcataagctatgtggtgggataattgatttagttcggtaattattagcacatgaatttagtgtaattacattgtaactccagttatctctttctcatatattaccaagtgactttagttccatcctcctctgaatatccccatgcttcttgctaattaacaatctacctaaagcaccaagaacagtgttcctagaattttgcaactactagctattggtggtggagttcagtggcaaagcaatctttgtgaggtccttttgtgtgagagaaaacaaattgccgaggtgctgaaaaatctcaccaaaggatgaggtgcagcaggctggccctaattttcttagggacgacaaactcaacaacaacttggatcactaatgcaaatcaccatgatccactgatggctgcagaaggataggtgtgagctcatttatatcctacatttggtgaggttgcagtgcctggtacacgggtttaccggagaagggtatcaaactatcaatatagaaagagcacgatcaagtagtacaaggaagaacaatacaaaactcaccttgcgctacttgcaggacaaaagcaccgtgagtacttgatcctaaagctaagaacataaatctacaggaggtagagacatgagaactcaccaaaacagaggaactcaaaggaaacatgggttattgttgctggagtggagatatatgaattgtagctgctctttgctctcaagatttaaatcggtgacccatagggagggggagaaataagggattgttagcattataggaactcaagtagggagccatggatgtagaaagaacttaccaacacagaaaagaaacgtgtcatccagctgctgcaacctcgcagcctgcagctccttgctgttcctccttcccgatctctctcaaatggccatgcatgtgcaagatatttggatggatggaaaacctagagccccagggatccaaaggtgtgacatgcagggtttggttttggatgtttgaagaagattttgggggagaaagtggggagggagctcagcctaaggaagaacgtaaagtggctagcaatggaaagggaggaggaggaagatgaagggtttttcttgctgtcttaagttcctgaggtggggttgcacgcccaagaggtgatctaggagatatggaaccggccaggtcagtaagtcgaactgggcccataggacagataaagcaaggttagaaacatagatacacaatgaaattagtgaattttcaggaattttctctctctccttctggttaactagtttgacctagctacaagaattccaaaaatgggtgatctggtgtgtgtgcatagcttgagttacctagtttccatttttcaaagtttcactcaaaaattcgaaatatgttaattctggcaaaaaggtgaaaagggatatgctgagaactaaattgaatttcaatgaggtcaaaactaagtgtaaaaattgtagaaaaattatattaactcatgataaataatctagtatttgaataaattataaaacatatatccttctgatcaatttttaagcacatttaggagttgcttcattttcctgatcaggtttctaattaatcaatcactgtgactatacttgactgatatatttgaggtagtaaaaagagtgataaaatgatgaaacctttacagtggtcatcttaggttgtctaattgacatgaggacctttatggaattttatgttgcttagatttgttacagagtatctatgttcatttaacatgtaccaattagccaaacaaagaaaatcatttaagccaataaattggactacactacaaccaggtacacaagcatacattcactagttactcaatctactagccaaaagctatgcgtgatcgggtagattatcaaataagcgaaatatgagttacaaaattaccgattggtcattcattatagttaaatacaaagaggtttcaatttggctttagagctaaaagggagaaaaggaaaggtggatcttcgtgaattatctggtattgagtcgtgaattatctggtattgagttggcttagtctcttatattctcgttccattcgtgcaaggaa

SEQ ID NO: 49563 - DNA, 6852 bp, Oryza sativa
atgatggttacaacctatgcgaaatgaccaaactacccggaaccgccattaggatgtgatcagggccgtccacacaaaatttggcgatcaacggccaccaaaagggttcgaccgaactaggggacggctccgttcggcccatttttcatcgtggacactaattttaaggccctcagcccaatggcatgatagttgggcccatttggagttatttaattgacttatagggcctccaatccgtgtaaatgtgtcatgaatgcgcggaggtgcactttggcgcttgacggatgtgttttcttctcaaaatacctgcatacacatatttcaccaacactagtggaaataattagtaataatacctaccactaagttggataccatgttttatttcattatatgcaggtattgacggtcagatattataatttaaggaccgtcaacactctaacacgtgaaaaaacaggattcttctatttttatattattctgggtaagataaactactccctccgtcccaaaatatattctttttagcatagtgccaagtcaaatattcgtaactttgactattaataataaaaatataaaaaagatcaattatgtaaaattgatgttactagatttatcattaaaaaaactatcgcaatatgaaaatctttttatttaaaacatattacttttatagatatcattggttaaagtagcatctcaatgaccatgtcgaagtccaaaagtgcttatattttgggacggggggaaaagatagtagtatttaggagtactactgtactcaaagcaagacctgacaattgaggaaaaccaactatgtcacttactgaatgggagtccaaacaaaaaaaaaaaacattttctctctctcttttgttaaccaaaagttgcacatatgataaatgaaagtctagaagccttttactcttttttttagacgaaaacttatatttctggaaaatgagtctattatctgaaacaacctaaatatttcattggcatatagattctgtttttttttcttttttcacatcatcgctctgttttacattttcctggtatatgcttagaattcacaatctactagccaagtctcctcttctgaagattaacaaacaagcaatcatgatgcaggactcaatcagctgataatttctgaaacaaagatggacttgaactgctttctacaaattttctgaacatgaatttgattacataaatatgcttgcaatggataatctgaagaataagattagactgattgcagtgccaatgtgctaatggccttttgcaatcatcacccctaagagcaggtacaatagtgctattaagccggctacaaaacttattaatcagcttaatctgagattaatgaaagaaaatcacggggaaaggaacaagcaggcgcttgttttggcgccggcgcttgcacagcacccgaaactgtacgctcacatgcagccaaaaagacgataaaaaatacatttatgtgggtcccacatggaaccatgtaactatttaatgtatatatgtatgctttaaccaatgcagcttatagctaacttgtagttagtttgttgtatgagttgtctctttaagttagctctattttaacatgacaaaattttggagcttgctgctagctatactattgaccttgctctgagacaagactaccaatattgctaagttacagactgacagacagaataggtggtgtgcaggatcctgtgggctgtgagcctgtgaccatgcattccaagctgccagatcatgatactaattggatgaactacagttattacattcaagaatcaagatggaagttcctgttccttttcagaatacatcgctccatgtcgtctgaagaagccgatgttgttcagtcttataatatgaatatgccttcaggtagtacaccaaagaaacaagattacgctagtcaaatgcctatattagtgaatgcagagtactctgctttcttcttctttttctatcaaaactctgattctgacagatgaagtctattgtctgaaagactgaaacaaccaaaatactccaacagcagtgatcacaattcacaatgtgtccttttgcacaacggtttccattcttttggatgtcacttttcctgaagactaaacaaacaaaagcatccatgaagcaggactcaaaacaaactgaatattgtaaaattggggaacactactctactcaagcaagcactgaagtctgaaagtgcccaaacaaaaaagatctaaaactttctctcttttttgttaaacaaaagctctagatatgataaatgagctataaaatttttttactccatcttttcacagaaaaactcagattctgacaaatgagcctattgcctgaaacaaccaaaatactccattggcatagacgactctgtgtttgatattcctggtagcttatgtactcaagacacaatccataattccaaatactacaaaactattcccttttcctgaagattaacaaacaagcagtaatgaagcaggactcacaaagctgaaaaaaatatgatatttttattgaacaaagagggccttgaattgctttgtacaaattgaataggatttacataattatgcttacaaatgaataatcagaataataagattacactaattgcaatgccaatttgcaaatgcaatcatcagtcctaacacatctaactgttctaagttacaggcggactgtcaaactgaaactgacactctctgtcttcttctcccagagctatccaaacagaggcacgaagccagggaactctgctttcttgggctcctcggcgaaccacctgtgctccagcgcctccaccgccgtcatcctcttctctgggtcgaaagccagcagcccggacaggacctcgcgcgccgccggcgacagctccggcaggacatcatagaagagctcgttgagctggtcatccaggttggtggacaggtcggcgagcagctcctcctcagtcatgtcgcctccgaagagcggcgcgccggtgaggagctcgcccatgatgcatcctaacgcccacatgtccaccgcggggccgtagcaccggttgccggccagctgctccggcgaggtgtacggcagcgtgccggggcggcacaggtcgtacggcttcccggcgggcttcatcagcgtggcggccccgaaatcacagatcttgagctgcccggagaagctgacaaggatgttctccggcttgatgtcccgatggatgacgcgcgaggcgtgcatcttcttggcggcgtcgacgagcggccgcatcatggcgcggacgatgtcctccgggtgggccctggggaactcatcccggaggctgcttccgacgaactcgaggacgaggaagaggtcacctgtcttggcgtcggcgacgacgtccttgatctggacgatgttggggtggccgcggcaggcgtgctggcaggcggcctccaccctgagcgcgtcgaagtcgggggcgaagcggccgccctcgtccgccccgatgaggcgcttgagcgcgacgaccttgccggtgcggcgatcccgcgccctgagcaccacgccgaacgcgccctggccgaccacgtcgaggcgctcgtagtcatcggcgctcccgaagttgtaccgccgccgcttcggcccgctcgccggggaggatccgcagcaggcacggggctccagatcgtagggcgccgcgcgcttgcggctcgccaccgccgaggacgccatgggcgggggaggaggagaaggaagcggatgggagaagaggatttggatttgggaggagcaggcgcgttggttggcggcggatttggagaattggcgcttggcggtggtcggtggatttatttgggggattggtgagtccgactccgactcgttctggtagataggctgcgtcggacggtcacgatcgcaccaacatgatcggtgattctagaattctggagtgtttttttagataatgtttttattttcctttttgttgcgaacgattattatacacaacctatgcggcacatgtagcggtttaggagatgtgttcatcttgcttttaatctgcttcacacattctgttagatccatgggcatgcatatgctattatttgcaaaattatgatttaaaaaagtctttatgtggttcatttataaacaaattaatcctaacaaaagataactttaaaaaaaattggagaggaaacaagcaatattctttttttactatgcatgatattactaagcatcttttcttggagaatttaactatttacaacttttaggtttggcaattataatttttttccctcctaagaggtggtctgttaactattcgccacttttgcccacatggcatgtcagcgtggcaaactcaagtgaaaaatggtgtgggactcactcatcaatctcttcctccacttcatctctctcctcgggttcgcgtcccgcgcccatggtggctgccgccgtcctgagcccatcccgacgcgcccatggccgtcgctattatcctgagtccatcccgacgtgcccgagaaacccagcacacgccgaggccgctactatcctggcgagccccaggatcgagaggatcatatgctatccctcggcgctcctgcgcctatcgctgtcgcctccaccgtctccacgccatccgcgagctctgcgccgtatttggtggtggtgtaggagctctaggactgcttggtgcgccgacgccgacactgacaccgacgccgaggttgaggttgaggttgagcgcgccgtgctgctatcgctgctaccgaacatcacggcctcggctgccacagcagctgaaccgatgggcgtgacagggacgcgcgtggcgccgggccagcgggttggcgtcgtggatgttggcatcgcaggcagcacatagcaccgcggcgttgaccttccaggtgacggcggcgggcgccaacttgcacaccttgcacatccatacccactcgtgcgccctccgcgtgtggtacaccccgctgtagccatgccagtgcatggctgctggccacgccttgcatgccccgcatcctcgccagcccacgcctaggctctacgccgtgttcgacgtcatcgcgctcaccgtcatcgtggtgggctctcctggcgctcgcgccacccgttctccgcatacatgcactcgtccgaaccggatttccccagcatcacctccgtcgtcgccaactccaaatggtggcgccgccaaccctccaccaccaccgtagcggcggcggaggccaaggacggtgacacgggcccgatgaacgcccacgcccagcccactacctagctccgttcacaatgtcggctcggctgtgaggcggcgccgccgagagatatgaagggaagggaaagactgacaagtgggtcccacactatttttcaccccaagtttgccacgttggcatgtcacgtgggcaaaagtggtaaatagttaagaaaccacctcttaagaggggcaaaaaaaaagtgcaaatctgtaaagggcatttggataattgccaaaatctaaaagtggcaaatagttaaattcccctctttcaccaatattatgatttcatgtcaagatctatataatggttatttccttagttaatgatttatagtcgaatggaaccaatgagaaatttgactagaattaaagcattaagatgtgaagttatatttaatccacgttattataatttcatgttaattataatttttttgttccttagttattttctacccaatggggtataattaaggaattaattttaagattattcataattatttatgaccaatggtgctttgactatgaaattctaagtttattttgcatacgattgattaagccaaggtaaactaattatatgcaattatcaatgtttattatttaagatcaatttcaatactgagtaaattatttctagattaatggagccaacaagaagtttatctagaaagaaagatgatctcattaagattgttatttccttaattatttctgcccaacggtgttgtaattatggaaaaaaaatctaaacatcgtcaatcattattttctttgtcattttttgcctaacggtgatgtgacttagaatcttctatatgccgaagtttcgccccaaccttacggagaagtatgatggcagcatcaatccctccgagtttctccagatctataccacgatcatcgtggcggagcggggggggggggggggaccaccgagtcatggcgaattatttccccatggctcttaagggtcaggcgcgcggctggctgatgacccagcccctcaactccatccactcctgggaggacctgtgccagcagttcattacgaacttccaaggcacgtacccccgcccaggagaggaggcggacctgcatgctttgcagcggaaggacgatgagtccctctgctcgtatatacagcgcttctgccaggtccgcaacactattccgtgcattctggcacgcggtcgtttatacgttttggaatggcgtgcggcacaaccacatgctggagaaaattgccttcaaggagcccaagaccaccgccgagcacttcgagctggcagacaaggtggctcggaaggaggcgtgggcctggaactcccccggcactggcgcggcgggtgcggctgtccccgagcccgctccccgctctaagcggcaagataggagggggaaaaggaagccggcccgctccgatgacgagggccacgtccttgcggccgatgggccctcacgggccccgcgcaaggaaaaagccaccggcggcaggccgagctccaccgctccatccgggaaggtcggtc

SEQ ID NO: 49564 - DNA, 5854 bp, Oryza sativa
tcgggcgccgcgcgcttgcggctcgccaccgcgggcgccatgggtggagccggcatgatggggagaagcataggagagctgatgggagaagaggatttgggtgggaagatttggaaagggagcgtggatggcggcggagaggaggcctcgctggatgacttgattttatagggcatcggtcgatcggacggctcgaaggcgctctccgacttggaagtgggctgcatcggacggtggccgagtgcactccgactccaacttcggcgacagatggatggagtaagcgttaagtttacgcgggtcgatttggaaatgggaaatcttttcagcgcgcaaacccctggcgtagtacaattaaaagggttggaatccaaatacatttgcacttaataaagacagcttgtaccaaaacgaagtggagaccaacatagattcgttgtattaggatgtgtcacatccagtacaaagttgctatattttgggacggagagagtattttttttcatacactctcgagggacccattcatctcaggaggcggacagtggtcgagacaaagtgagcagtggcgtcgcacgcagatagagcgaagggagcagaggcggaggcggcggaaacgcacggaggtgcagcagcggtagcgcacgtcgagattggcgacggcggtgcgcgacgagaccggagggagcataggcaaaggcagcggcggcacacaaaggtggcggcggtgataacgcatgccgaaatgggcgacggcggtgtgcggaaggagcagggtccacggcggtgcgtggcgggcacagtgcgcaaaggtagcattgcgaatggcaacagcagcgcatgacgagatcggcgatggcggtgcttggaggtagcaggtgcggcggcaatgaccgccaactgcgcatcaagccaggatagtggcacaaggaaatcgcaggcacaatgacgatgatggcatgacagtggcgatgacagcgatggcatggtaggtgggatcccgcatcgagctcgacatccacctttggctccttctatcaagatctagccgggtcctcatggtgcgtaggccaggtgacaaggtcagtgggcggctgtaggcggagggcgagcaaggggcggtttggcagcgacattggatttttcccgccaagcatccccatcttggagctctatatgtgtttttcttcactgtatgtagtcttggatgaacaaaaatgagacaacatgttgtcaaaattttacaaaaaaaagcccgtttaattttgtcaaaatcttgctaaatttgtcaaaatggagtcaaatctatcaaacctatctctaatatgtcatgcttgattcattacaaatatataaaaagttttgaataaacaaaatatttttatacaacaaggtcaaatgaacaagggcaaaaaaggataatttggcccttagttaactccgttttcttgccattatggaatagggtcagccactctgattttaaaacgaggggtcaaataaacaaaataaaaatattagcagataacaaaatcaaatcggttgccccaaaatcaaagccaccaactgtttccttctggtatagaagtatattgccactcaatttttatagatttgtattgcaatttactagagatgttatttttccagtaactactgaaagtctgaaactacttcatattttctttaaggcaaaatatgcttcaagacatcgcatggagtgaattttaggggaaaccactttataaatatggtaatttgcatgcagacaccgtgccaattattttagtgtattcgtgctgacgtcgtgcacttttttaccagtgtgaacaaaatgcccctatcacgttgtgtcctcaagttgcgatgaggtcatcaccaggggggatgggaagccgacggatggattgtggaagccggcggtggcaagggggggagggaaagccgatgaagggcttgctcgctgccaccgagttctccacatgccgtcggggtcgccgagggacgtgtgctttgctacatccctccacgcaccgctacagtccacgtgcagttggggttgtcgaggccacacaccgtcgtagctcccatgttagccccgggtttcgattcatctttccaaccaaaccagagccaacacagtcttaaggttcgtgcaattttttccaagttcaagattccaagacccccataatcctttggcttgcaaacatagttccaatttagaaggcagcttcccgcacagacgttgtccgagtcatcttctttctagaggaaagctcgtctaaaatgatcaatccgcttataaagccattcattctatggtagaactgtaaggtggtagataggtgttgccgacaaggtcgatttgacgaggacctccgggctagccgatgtgaaaaatctgcccttccaactcggtattctcaatcttatcttatccactaacggttgtagatcaactttcatcattttatggtgtgaagcagcaaactgagatatttgcgagggaatgactttttatttactggaaagaacagcaggatgccatcgaggtctaaaatatctcccgatcttcgttttgtccatgcttgtctgcagaacattagaccactgattgggctagccaagtagggtcgtgggggagatgggccgaaaggggtacgaatcgattcggtaaggaataagttcaccggaggtccctcaacttaatagcgagatttttttacgtcccttaactacaaaatcagaaatcttcacccctaaataataaaaaaccatccaatttagatcctatggcagtatacatgtctgtcagtaaaataaaaaaaatatatggatcccacatgtaaatgaaaatagatagaaaatgtggggaccacttctcttcttctctcttttctctttttttcttctcttcagctcctctccagggaggctgccgccggcggcagatgggggcgaggcgagcctggccgagctctgccgccgccgccgcactgacgcacacgtgctcgtccgctgtcgcttcctctgcccccttcgcccccgctcccgacggcgaagaggtcccctgccccctgtgaccccgctcccgacggcgaagaggccttggtggctacggcttcactagccgccatccccatccccatccccatccccatcgtccaggaaccacgcgctgcagaagacggacacgacgagaaagctgtgcgcgagtgcgacgcggagcttgcggccgtcgacgggatcctccggggcggcgggcagcgaagggcggatggggcaggagtgggcgcaggtggaggtgtgccgggtcgaggacggcggctggagatggtgatgggcggcggcatcggcttgcccttggcgggcctataggaaccgaacggcctcggggtcgggaagaggacggcggaggtggtgaggcgcgggagcttcgcgtcggcttcaacttccacaagtcctcgtcgtctctcgccgccctcctcgccggcggaagctcgccaaccacgcgctcgtcctcagtgccaccttcctctcaagcttcaccgccgtgatgaggtgctcctccgctccgacgacaacggggagctcgcccacgccatgggcgtcgagctcaacgtttgctcccgccgctgccgccgcctcgtcgccgactgacctcctcgtcgcctgcctcgccgccgccgccgcctcctccccatccgccggccgctctacagaacaaaagtgagagagagaagggagaggatgcacaagacagatgacgtggggctgatacgtggcccctttttttttttctgactaggatgccacgacagtaaaaccgggcatctatactgtcatgagacctaaattagacggtttggtatagtttaggggtgaagatttctgattttacggttaagggacgtcaaaaaatctcgctgttaagttgagggacctcgggtgaacttattccattcggtaaatagttaaatatctcacaattggtatgggagatgaaaaattactttttttttcttcacgggaaaatcaattgttcttctttctcagggcgtagacgtgattggatatttccaagcctaatcggactcaaaagtctgaattggactctttttattattgttttgaatttcttttatatagtactttcttgtggccagtgcacgttttgcgtggcccaaattaaggcttacggctgactgtgtgtcgattgaatctccaatcccgtcgccactcgcccccacctccttcgccgccgccccgccgccgccgaaccgcaacgcggcgaatctgctcccctccatcttcggcggaagtcccagtagatcgaggtatgatcctcctccgtcccctaccatgttcgttatggcgtccgactcgctgatacgcgtcgattcctcgccggaggaggcggctgctgtttagggttagggttccggcaggctctaggggcggaggagccggtgcaacgcccacctgctaggccgccagaaaagataatactaataatttcggccatgctctgttagtttatgaatccatacagctaggtctcctgccattgccaatcttgctgggctgaagctttgaaatttacatgtggtataatagtattctgttgggtagtataatttaataaaagtgtcatccaccatgactgaacgctactccatgtttcaacctcttgttatgtttacagtgcaggttcctctgtttagttttatgttcatggttaaaccagtatcagcactttatttttaccaaatattattctgatagtgttgtatacttgtattcatgattaaacaagtgtcaggcttttctttttaccaaaacacatggaatacaagttgatgtgttgtgttcatggttgaacaagtgttagtactttccttctaccaaaacatatgacatgcgagttgttctgcaagcagaataacgatagtcaagtacaaagtacctgagcagtacaactgaactaaaaaaatacatatttttgttcaatctctatgcacaaggttggagcctgtcagatcgctgtcaattgcatacagttttaggcttttattggagctatgcaggttctttgagtgcagagtagtaaaattatttcttcttctgaaaaccgttagttaattgttatagcatgcttcgtgttcatctggcattttaaattctgaacacatgtgatgcttttaggaagaggtcagtagagcgtgagcaaatattgtgtacagcggttggttcatataacttaatttcatgcacgtacagtattcttctatggatagaactgatgccataccatagatactccttttctttttgcaggatctatcataacacacttgcagacatgccttggctgtgaagatcatacactaagatgcttgcagacagaggctataccctagaccctctacagctgctgtaccagatcagcagtgctagtgctaccaacgatcagactagaagcgcgacgcagttggtgcctcctgcactgacggttggaaaagcaaactccaagtctcgcacatcccgttcggtgatgtgggtactggcgatctacttaccctccatgtcatcgccggttccacgtacttggcatatgacctctacatccgccctttcgatggtgctagctacccatggtgtctgttggctgtcatgtgttggctgtcatgttatggggagtctacatggcgctggtcgctgtggtaagacaatacatggacctgttcttgccaagtgctcccgctgccgtgcggcacacactcgtcgacgttggctggctttgggtcggcgtacctgtgtttttcgtagactatattctgatgaactactg

SEQ ID NO: 49565 - DNA, 2159 bp, Oryza sativa
cttgtgtgcgtgtatagctggtttttgtatgtttttttagggaggtttatgcatgtacactcctacagaaagtgctatagatgtcggttgtaaatatcagtttttccaaccgacacctataggccggcagtgatgtgaagagatataggtgtcggtttagaaaccggcacctttgacgatccacgaatcctgatgcatcgagtcaactccatcgaaatcatcacgaaaatcatccaaacacaataacaaaaatcgattcccctaccttcccatcgttgatctagctgcccccaccatcatggcagccagcggcggagaggaggcgccttccctcttgctggcactgccactgccttccctctcgccggatctagtggaggggagcccaacgccaccactcgtgggtagtttgccgtcggtcgcgggagcccgctgaatctagcgaaggggagggtgggccgctgccgtcgtcgggcggcggccgtgagagagactaagaaagagacgcttgagagagaagcgtgggacaaaggagaagacactagagaaaagcgtgggtatatgtgccggtttatttttaaaaaccgacacatataatcagtcctttaattaaccggtaactataatattataggtatcggttcttttaaaaacctgcatctatagtatggttttttctctagaaccagcacttatagtgtttaaaggtgtcggttctatattttttttatcacaggggtacggcaaaaggtcgataggtgttggactaaaatgaatcgacacctatgaacatttctctatgagttttttttatgtagtagaggtatttttgtcattgccttttgtctttaactggtttaataattacaaccttttgttacattaaaaaacattaaacatactttctctctgtttcaaaataaattaatatgatatttgatacatttttactataaatctagcatcaagtattatattaatttatattggagcggtggtggtaccaaggtatcttacaacacacaccacaagagatgacaagatcagtcatatcgcagatcagattgcagcagtcttctcccaccttgttttgatcgcacgaaaaaaatggaaactatacggttcacactttcttgtctcaagaatatactgattgcaaacctatatctatactagcaaaatacccatacgttatcacgaaaaaaataaaaatacgataaacactagattattagggtctaattttcctaattcaggactgggtaaattatgcaatcctagttagcaaaatacccaagtgttacagcgagacgaaaaattttggcgtgtcatatcggatatatggacacacatttgaagtattaaacgtagattaataacaaaataaattacagattccgtctgtaaattgcgagacaaatttagagcctccccattccgctcgtcagcctccccacctccttcctctctgtgtgtgtgctcgccggcctccttgcccgatggatgctgcccccgctcttctccctctctacgtgtgctcgtcggtgggtgcgcgtcgtacgctgctttcgagccgaggaacacgagcgtcgctgtggagaaaatagagaagaaggcacatggaacttggtgatatggcaattgtacagtgttttgggggctgttacatccaatcgatgctatagcatctgccaacttattacattcacgaggacattagctaactcaaaaagaaataaaagccgaggttataatcttcttcgcttctaggacaagaacccccatcgctgcatattgtagattcccttccttcagggcttgaaccagcatcagtaaatcagactctagatggatatatgccatacccccgtgagatatcgcttctactgccttcaccgcggccaaaacttcagcgtggaaggcatcctgcaaccgtgatgagtttccggcacccgcctggatcacatgcgcgtccgcatctctgataacataatcccagcccccgtcagctcatttggtctaaagatccatcaatattcagtttcaggacatcctcctctggtctttcctattttctcaacaccctcgccggcccaatgtttactgcttcactgacatcatatggaactcgtcagattgcttcgtgatcatgaaagcca

SEQ ID NO: 49566 - DNA, 1129 bp, Oryza sativa
tccccaacaccaccactgctaccaccatttcgtgcctctgtggttgagatgcaatcagtagcgttttagaacttcctcaatttaaataactcaaaggcaggggccgcctaactcaatacttgtgcgattagtggaaccttttagatgtctgtggaacaacttttctcgtaattgtgagaattattatcatcagggtgtagttgtgtatgcatcaagttccactgttgttggagcgttgattgttagtactattgctgttcttgtcttccagtggtaggtgtgagttatccatgaactttttattcacctgtcagcctttattctttacctaaatgtttttcaaataaattctagtgtaccaaaaatgttgtggttaagaaaataccaacgaaatctatgttgtgatgtcatatagttcaatcactctcataacctttctcttatgcatgtccctgtgatgtaacatttcctgagttatgtataataatagaaaacaatatcgtaaagagcacactatatgtttagtgttgtatatgttcttgttttcctgatgcaatgttgtcatatgttgggcaagcttatcctgcccatctttctgtccaacttcttcaagtctgaagatattcttttttggggcccatttgtttttattcaacaaaatagttgcacacgtcttttgtgctgcagcatttcattttatatgttctcttctgtcagaacttggatgaggtgcaatcgtacattctggttaagagaacttcagaaaacactccaacagctcttgttgctgatactgaagagtttcttcgcctggtatgtttatgtgttttttctcccgtaaaatagacttctttatgcactgcagttaatgctgactgtagaaaattagaaagtaaaatgctgcaacataattcattatgtatggtacaattgcatatttcttttggaggctttttatctaatttcttttcatactacctgttaggagtgctgagagccatctatgtattggttatactttagcaaccaatagttaaaattttgaatacacttatgaatagattcttacttcatcaaataatttgaatctgagatctcaagaaagaaatgtgccaagttaaattaaact

SEQ ID NO: 49567 - DNA, 1863 bp, Oryza sativa
  unsure (1)..(1863): unsure at all n locations
actatgaaatataaaaatgctgggaaatataaaggcactttcttcaaaatagacatgcttttgtttaacaaatggcacttgtggtctacttggttttaaagtgcacatctcaagctgtcttttttctccatatgcagatgattgttctgattcaattgatgccgttagagaagaggcctcagttttagttagggaagaggtggaacagagactactatccattgttcgagattcccttgcatctgcattctctgtcaaaggggtatgttatattacagccctagcgctaattttatgaaaatgtggccattgcatgtcaatgtaccaaattatcattcttgtattattcagtcacgacaacttttatggttcactgtccatctttaaatttcaattcctgcttcctagttggctgtattgcctccacatgtgtatgcccttcctaaagaagtaacttgatatgatgattgattcaacttcagtactctgtcttaatttctaatatattaggaaatgaatgtcgtctacagcctgagattctaggtggtacattgcgatatgtatatgctttattttacatgatgaaatgaatttttgaagggagttgactaaagtaatcacttgattagaaagaaatagatattctgcagaagaacataatcttgtaggaaaggaataaaacaattaatgaaggaattgttatacacaagcgaaatctcattttatttttctctgctctattagagaatggactaattttgcttctctactgaacccctgataggtaaagcttagaccagctcaaaacggtcccaaaacaacaaaaactttttataaaataagcataatcattgctagctactaaagaaaagcgggctatgcctaggttaaatgggtcctaaggatatataatgaaaaactaggttgggatggttactgaggaaagcccatgtgcttgccttaagtctgctgattttattcgtaatagaacatagatgacaaataagtatgttgtactcagtcaagcttttgaaccttccatttgctgcaaaacaaatttatgttcatggtaattctgtagggcagagcaaaactagtgtgtcattttccctagaatcaacttgaactgcactgcgcatattttagcatcttgttaaatattgatttacaagatgaatgcatttcctgtaaactgtagcagttcattgatagtattaaccgtgccctagctacctgcttgtntcaaatatgtttatgagcaataaatctgcttgaaggtcataatgttgagtacacagacaagtacatgcaattgccttatactctttttggcgttgccgttgtggttttgtgtcctctgcacacactgatatactcatcattttgcagggagctgaattgacgatttcttggctggaagaaacactgattgaaattaacctgatttttgacatcttgtttctttttttctatgataacctttcaaggtgtaatggtggactgtggataatgttgcgttccatttttaaggtacatccttttggtgtctattcattctgtgggaatctgagatctcttcacttgatatttcaatatttatttcttgagcacttatccttttaggacatgctatctggttcttatgatgttggaaaatttgctgtatctgttgaagcaaaaaattcgtttcattatgctaaagctcagctgctgtttattctcattcaaaccttggactttgaaagtctactccggatggttcgtgatgaagttccttttaggtatttatgactaacttggctttttcatttatgtatgggagcatgccatattagtatcttattaatatgtcagtgtaacttc

SEQ ID NO: 49568 - DNA, 3020 bp, Oryza sativa
  unsure (1)..(3020): unsure at all n locations
aagtgtcttccaaaaatttgaagtaaattgactacctcgatcagacactatcttcttaggaacgccatgcaaacacacaatccttgccatatacaattccgctaagcgacttccggaataagttgtctttaccggaatgaagtgtgccactttagtaagtctatcgactatcacccaaatagagtcctggcctaatgacgttttgggcaaaccagtgataaaatccataccgatttcttcccatttccattcaggaatctttgaaggctgcaacaaaccggcgggtttctgatgttctgccttgactcgctgacaaacatcacatactgctacgtattctgcgatttcacgcttcatacttgcccaccaaaacctttccttgagatcctagtacatcttagtactaccagggtgtatggagtataaagtatcatgagcttctttcagaattgcatcttttaaatctttgttgtcggggacacagattctttcacccaaccatacagttccgtgctcatcctccaagaaaccaatagcttttcctcttctcatattcttcttaatttcttggatatcaggatcattagtttgagcttctctaacttgatcaattagagtgggcttcgcttctaaggctgcaacgaaacctatactgacaattcccaaattcaatctttcaaattccttgcataattccaatggcaactgtcgtccttccgtagcattgcaatagcctttcctgctaagagcgtctgctactacattagcctttcccgggtgataatgaattcccatgtcataatccttaattaattccaaccatctcctttgtctcatgttcagatccgactgagtaaagatatactttaagctcttgtgatcgatatatacctctgtacgagtaccgaaaagataatgacgccaaatcttcaacgcatgaactactgcagctaactcaagatcatgagtagggtagtttttctcatgcggacgtaactgacgagatgcataggcaaccaccttcccatcttgcatcagaacacaactaacccaagtttggatgcatcgcaatacacctggaaacccttctttggatcaggcaaaatcaaaataggagctgatatcaagcgacttttcaactcttgaaaactctgctcacattcttctgaccacttgtacttcacatctttctgaagcagtcgtgtcatgggcttagcaatcttggaaaaattctctataaacctccgataatatcctgcgaggcctaggaaactgcggatctctgaaactgtctttggttgtttccagttggttacggattccacattactaggatcaacggcaactcctcctgctgagatgacgtgaccaaggaacttcacttcagacaaccaaaattcacacttgctaaacttagcatacagttgatgttctcataacttttccaatgcaaggcgaagatgttcttcatgctcttctttggtcttagagtagataagaatgtcatcaataaagaccaccacaaacttgtctaggtattccataaacactttattcatcaagttcatgaagaaagcgggggcattggtaagtccaaaagacataacagtacattcgaacaacctgtacctagtggtaaaagctgtcttaggtatatcttcctctttgatcctcaactggtgataccctgatcgaagatctatcttggagaaaacggtggcacctttaagctgatcaaacaaatcatcaattctgggtagcgggtacttattcttaatagtcacatcatttaatgcacgatagtccacacacatcctctgggtatgatctttcttttccacaaaaaataaccggagctccccatggagatgaactcggtctgatgtatcctttctgaagcaaatcatctacttgcctcttgacttctgccaactcattggctaccattctataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaaaactcagaagacaatgcatgaacagttacaactcgaccatcattgctggtgagagttacttttctgttagcacagtctatcacacctttatgtctagctaaccagtccatccctagaatgacatcaaggtctttggattctaacaatataagattggccagaaatggtaccccttgaatttctattctgacataggggctacgttgcaaagagagtgcttgattgcttggggtactaaccatcaaaggacgtctaagatcttctacttccatcccatgatttcccgcaaaactcatagatagaaatgaatgtgtagcaccagaatcgaaaagtactgttgcaggaactgagttaacaaggaacgtacccaaaatcacatctggagcatcttgagcttctgcagctgcaacatgattgacacgggcctttgatgctggtacagcagagttgctctgggcagggacaaccttcacgcgtcggggcttcggacacttgtcagcataatgtcctgggtctccacagttgaagcataccataggcttgctgccttgctccctcttggcaggttgttgctgtgtcgaagctgcaacaggacgtggagcttgattgcggatgttattgccagcattgttgttgaagaactaacgctgcggacgaacaacagacgaagaacctccttgtggcatggactggggtcctaaannnnnnnnnnnnnnnnnnnnactcccctgttgtgccttgaagtgagcaatccggcgtttcttctgctccatgcggttatacttgtcctcctgacgaatagccttatccactaacttctggaaatcatgataatctccagtcatgagtgggtaagaaagctcatcattaagtccttcccaagaacttctcttgacgctcttcatca

SEQ ID NO: 49569 - DNA, 2131 bp, Oryza sativa
tttgtttgtagatggccggcagcatcactgtcacgaccggaaataacccaacgggcgttcctgacgtgcgtgcattaatccttgtcccaggaggtaaggtacaccaaaagttgatacaattcagagttcaacaagcggaagcgtaaatagttaacttattacatgggcagcgaaggcccagcacacacaaagacaaacgagaaacagcgaaagactagggcgacgaccacaggcgcttgacggcaggcacgagctagacaccaaagccttcatctccaaggaactcctcttctggggttgggaaaaattgagcaagactgagtacaaccaccgtactcaacaagacaaacccgcaagtgcagaataaatgcaagggagtacaagggaattatactataaagggttagggttgcagtaaacagcatttaaagacatttagttgctcaaagctatttggtaaacatgattctagagctataccatattattaaacaaggccgtgaacccacacgaacctgccttaacccaaggcctatgatgattcagaccgaactggcaacccgacccagggtcccagctcgtcccaagccaacccaggccaaccattccaccttttagttgttaagaaggttttaagaattaaaacactaacttggatacattgctcggcttgcccataaccgagggcgcggctattcgaatagattatactctgatcagaggtgtacatgtttacccacaagacacatcttcctcacgtgcaaccacgtgccacataccaccacggtatacaaacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccgcagctcgtgtagccttcatttgccctggagatgtccatcgacccccgacttcttccatctccatccgtgtacttttgtttataaccagactgactcacaaactaagccttacccactagacatgtggaagtacggtagtgctttgcaacagaggcccgaagaccggtccttatatggccgaggtgctactatcaaaaccatgcaccccgagcccagcccaaaaccattttggggattttgaatagaaggagcggtgtgaatccaattccacaatatccagaccattccaaggtatccaggtgatatgaatatttcccaaagtctaaagttgaaaaaccacctaatgttacctaattaagttgcgaagcatctacctaaaattaaactagtggtgccatgagtaggggtccactagttgaggttttgtttattctagggtgaacaaggtaataataacaataacaataataataaggtcgtaacaaaggtaaataggcatggctaaataaaacagtgttaacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaaggcttttactctaaagaactccatataacagtagaaacaaagcacaaaaatgggttcttgacttcttaaggaaaaattagagacttgaacggtccaattccgagttcaaatggacaagttatggccatttgaagtttatatgctctttaaatggatatttgggaaaagtttatatgcccttttagccatgccttgtttataagggggtgattatgatccaggaaggtgcgctgcagtggattgtgttgtataaggggtattgtcacaactcctttccgagataccgtggttgtattgaggcacatggtgacatgatgtggggttgtgtcttgtgggtacagtggtacacctctgatcagagtaaaactattcgaatagccgtgcccgcggttatgagcgggtctaacaatgtctttcgtgattagtttcacacttgtcaccatagtaaatgatgctataattggtaataatttgat

SEQ ID NO: 49570 - DNA, 1237 bp, Oryza sativa
ttgcgatcattactcggcattccggttattatagcagaaggtgtcaaccgtgatcatggacacattgaggacgaatggctatttatgcgtgtatggatcctactcctccaatagtatgtggtggtcgcgttggacactggatggtataatactcggggtgtccacaatacctgcctataaaagaaggagctcactctcatttccaacacacaactttgagctgaattacaagaggctctattgtatcttttgtatattagaataaggtagagagtgaggggaagctctggaggagtgcccggaagtttggcgctcatccgacttctatctcgacgagtgtagctttctaggaggaattcgggaggagtaccagagctgtcggtacactctgctccgggttcggagaactccttctataaaataagcattcatattcatttcttatgttatttaattatttagtctgagtaagatatatttccatctttgcgggttcattgtttagtattcatactaagtgctctagtactagaattccagatagagaaggaagttcctacgcaagtattagagtagtaattaataacttagacgtggtgtataggttagagattacctttgtttgttgtgtatcccacggatttgtcagaggtaggcggcaggtggtgacagccctgaattctgtcccagtaatcctccacgttcggatacatcatagagctatagctggaataacgctggcataccagcaggggtcggtgcccgaagcgacagataggaaattacctttgcttagcgtagataattaacactcatagaaagtcctctctagcctgcctaccatcagttgttgtccttggatagtcttagccttaggtagattacacacgttccctgagttcgatatcctttatgggtcacccgaaggtgaagtgctacagcggtattccgtgcgcttgcggatttatccgtggtcgtaagaaataccaacatagagtatatggtagttagagtcatattaggatatgattgatttgtgtggactccttctatatttgtaatccttccttatctcttcccatgtactactatatatatcggcctctgaagctcaatataacacgtgcaatattcgcattatttctctcatctactattcaacatcaggtagcttggaatgaatgccataggatcctatacatcaccactacaccatccatcagccccagatagtatc

SEQ ID NO: 49571 - DNA, 3630 bp, Oryza sativa
aaagttaacggctactccatccatctcctgaccaagttggagtcggagtgcactcggccaccgtccgatgtggcccatttccaagtcggagaccgccttccagccgtccgatcgaccgaagccctataaatcgagtcatccagcgaggcctcctcttccgccgccatccacgctccctttccgaatcttcccacccaaatcctcttctcccatctgctctcctctgcttctccccatcatgccggctccacccatggcgcccgcggtggcgagccgcaagcgcgttgcggccgacgatccggagccccgctcctgctgcggatcctcccaggcgagcgggccgaagcggcggcggtacaacttcgggagcgccgacgactacgagcgcctcgacgtggtcggccagggcgcgttcggcgtggtggtcagggcgcgggatcgccgcaccggcaaggtcgtcgcgctcaagcggctcatcggggcggacgagggcggccgcttcgcccccaacttcgacgcgctcagggtggaggccgcctgtcagcacgcctgccgcggccaccccaacatcgtccagatcaaggacgtcgtcgccgacgccaagacaggtgacctcttcctcgtcctcgagttcgtcggaggcagcctccgggatgagttccccagggcccgcccggaggacatcgtccgcgccatgatgcggccgctcgtcgacgccgccaagaagatgcatgcctcgcgcgtcatccatcgagacatcaagccggagaacatccttgtcagcttctccggggagctcaagatctgtgacttcggggccgccacgctgatgaagcccgccgggaagccgtacgacctgtgccgccccggcacgctgccgtacacctcgccagagcagctcgccggcaaccgatgctacggccccgcggtggacatgtgggcgttggggtgcatcatgggcgagctcctcaccggcgcgccactgttcggaggcgacatgacggagaaagagctgctcgccgacctgtccgccaacctgggtgaccagctcaacgagctcttctatgacgtcctgccagagctgtcgccggcggcgcgcgaggtcctgtccgggctgctggcgttcgacccagagaagaggatgacggcggtggaggcgctggagcaccggtggttcgccgatgagcccaagaaagcagagttccctggcttcgtgcctctcttcggttagtctgtcagtgcagagtgttagtttcagattgtcagtctgcatgtaacttagaactgttagtctgcagtcttgtctttaaattagaactgatgattaggactgatgattgcattagcaaattggcattgcaatcagtgtaatcttattattccgattattcatctgtaagcataattatgtaaatcctattcaatttgtagaaagcaattcttatgtaaatcctattcaatttgtacaaagcaattcaaggccctatttgttcaataaaattatcagacatttttcagcttgatgagtcctgcttcatgagtgcttgtttgttaatcatcaggaaaagggaatagttttgtagtatgtgttgtatcttcagtacataccaggaataacaaaaacagagtcatctgtacaccttattgtcagtctgtaacttagcaatactggtagtattgtcttaggactgataatttcattagggcaatagcgcattggcaccggaatcagtgtaatcttctttttattattattcattgtaactttgtaagcataattgtgtaatcatattcatgttcagaaaacaaattgcagatagcaattcaaggccatctttgtttcagaaatcatcagctaattgagccctgcaacatgattgcttgtttgttaatttgtggattctgtgcttgactgaaagcatataccaggaaaaagaaaaacagagtgatctcaaaaaagaaaaaggaaaagtaaaaatagaagagagaggcgattaaggagagaggagattaatgttttctgacatataagcatccagagagagagctttgcaaagcgcacacaccgtgtcatctatgccaaaggagtatttaggttgtttcataaatagattcatttgctggaatcatttatgccaaaggagtatttaggttatttcagacaatagattcatttgtcggaatctgaatttttgtctgaaaaaattgagtaaagaggctctgtacactttcattcatcatacctggagcttttgtttaacaaaaaagaggggaaaagttatagtttttggtttggactcactctcagtaagtgacaacttggatttcctcaactatcggttcttgctggggtgcagtagtatattcctaaatgattcatgccttattttgcaatacctagaatcatatcaggacaacttttttttgtaggactgaacaccatcaacttcttcagatgacatggactgatgcattatgaaaaggaataggaacttccatcttgaatataacaagtgtagttcaaccaattatatttttagtttttgcctacagatacaccttagtatattggtctggcagcttggtatgcatggccactgcccacaggatcctgcacaccacctggtctgtctgtcaatttttaatttatcaatattgcattaagccattagcacattggcactgcaaccactgtaatcttattcttcagattattcattgtaagcatatttatataatcttattcatgttcaggaaattttggtgaagcaattcaagtccatcttttttttctcttcatacttccttatataattcctacatatataactgcagaaagaacagagtaatgtctggtgctgattttaaataaaaaaaaagcttgtcgaagaaacatctctatacccagtttgatatttctgataaaccaatcagtcgcaatgatcactgaagtttttgaaatttgtgaccaacctgatcatcgcttatgtgaacattgcagtgcagtcatttcagtataagccaaacacatgcagtgactaataaaacaaatacatatagcctgtcgatttatcataatctcacgcaaccctgcagtgcttaataaaaatggggatctttctaaatatttttgtggtctggcaatatgttgcaaaataatatcccgaaaaacataatgctgtaaaaaacagaaaatctgaaggaaaaaaaaaatctagcgtccactcccacgccgattctgaaggtggtgaggtgtactgtggaagcagcaaccacttctttctgaagaataagaataacaatttggatttttttttgacgcaaatggtagagagactctaccttataaccattgtattaatagcagtcaaagactgacaaagccaagaaatggcaaagaagagtacattcaggaaaggagaatcaagataaaagaaggaaaaagaaggggcaagaattgccaaaggtgaaaagagcaggaattaaaacaagaaatttaaaacatgaaaatcttaaaaaaaaaacttagaacaaaagaggagctgaggagctgaatagtaaacggaagtgaaaacacttcagagtatcttagctaagcttgtctgcccaagcgttgatatgcacgcgaag

SEQ ID NO: 49572 - DNA, 17339 bp, Oryza sativa
gacgagatgcataggcaaccaccttcccatcttgcatcaaaacacaacctaacccaagtttggatgcatcgcaatacacctggaaacccttctttggatcaggcaaaatcaaaataggagctgatatcaagcgattcttcaactcttgaaaactctgctcacattcttctgaccacttgtacttcacatctttctgaaacagtcgtgtcatgggcttagcaatcttggaaaaattctctataaacttccgataatatcctgcgaggcctaggaaactgcggatctctgaaactgtctttggttgtttccagttggttacggattccacattactaggatcgacggcaactcctcctgctgagatgacgtgaccaaggaactttacttcagacaaccagaattcacacttgctgaacttggcatacaattgatgttctcgtagcttctccaatgcaaggcgaagatgttcttcatgctcttctttggtcttagagtagataagaatgtcatcaataaagaccaccacgaacttgtctagatattccataaacaccttattcatcaagttcatgaagaaagcgggggcattggtaagtccaaaagacataacagtacattcgaacaacccgtacctagtggtaaaagctgtcttaggtatatcttcctctttgattctcaactggtgataccctgatcgaagatctatcttggagaaaacggtggcacctttaagctgatcaaacaaatcatcaattctgggtagcgggtacttattcttgatagtcacatcatttaatgcacgatagtccacacacatcctctgggtatggtctttcttttccacaaaaataaccggagctccccatggtgatgaactcggtctgatgtatcctttctgaagcaaatcatctacttgcctcttaacttctgccaactcattggctgccattctataaggtctcttatggatcggagttgttccaggtaccaaatcttttctgaactctatatcccttttaggtggcataccaggtaaatcatctgggaacacatcaggatacccccggactataggaatctcttccaaagttatctggttcagtcttgaccttaaaaactcagaagacaatgcatgaacagtcacaactcgaccatcattgctggtgagagttacttttctgttagcacagtctatcacacctttatgtctggctaaccagtccatccctagaatgacgtcaaggtctttggattctaacaatataagattggccagaaatggtaccccttgaatttctattctgacagaggggctacgttgcaaagagagtgcttgattacttggggtactaaccatcaaaggacatctaagatcttctacttccatcccatgatttcccgcaaaactcatagataagaatgaatgtgtagcaccagaatcgaaaagcactgttgcaggaactgagttaacaaggaacgtacccaaaatcacatctggagcatcttgagcttctgcagctgcaacatgattgacacgggcctttgatgctggtacagcagagttgctctgggcagggacaaccttcacgtgtcggggctttggacacttgtcagcataatgtcctgggtctccacagttgaaacataccacaggcttgctgccttgctccctcttggcaggttgttgctgtgtcgaagctgcaacaggacgtggagcttgattacggatgttgttgccagcattgttgttgaagaactgatgctgcggacgaacaacagacgaagaacctccatgtggcatagactggggtcctaaagtaagacgcggcttctgattattcccctgttgtgccttgaagtgagcaatccggcgtttcttctgctccatgcgattgtacttgtcctcctgatgaatagccttatccactaatttctggaaatcagaataatcttcagtcatgagtgggtaagaaagctcatcattaagtccttccaagaacttctcctgacgctcttcatcattgcgtacatcttccggagcataacgggcaagacgattgaattcgtgcaaatactccgtaacagagcgagatccttgagtgagtgacctgaattccttcttcttgagagacaccactcccgatggtatatgcgtcttccggaaagcagcggtgaattcaagccaagtgataggttcagcagtagtcctattcaggcggaagtgatcccaccattcagaggcagggccatgcaactggtgtgatgcaaatgagaccttctcctgatcagtgcactgaagcaaatccaacttcttctctatggcatgcaaccaatcaccagcttcaacaggattagtggtactagagaaaacaggcggccttacacgaagaaattctgctaacttattctgagggggtgcatggttatttccttggttctgctggttctgaagttgctgcatcatcatgttcataagctgagtctgttgagcaagaacttgagcaagggttggattctctccattgttattgttattggggttgttgagattgggaccattcctgttgctgcgagtgttcaccatctggcatggatagggcacaagaagagaaaccgggggaaaactacttaggacagagaattactttaacttttattgatcttaactgagtttcattattacaaactgaagactctcacaccactaaactcaccaacttcctaacactcaaaaagcaaacaaacgcatgtacttatatcccaccactgatgtaaatcacatgcaagacccacacacacacaagcaagcttaaaagaagcaaactaacacaacgatctaagacaacgacttaacaagttactcttgttcttccgagcatcgaaggtcgattgaaggctcgttcggctcgtcttcatcatcttgagttgctacccactcaatcttggaatggttgcgcttggattcttcttcttcatcactacttatgatgatgatcggaggatctgctggggcaacttctttctccaccacacggacctttggcgccaattgatagcgagggacaaatagagctctcttccttgcggtaagacgaatcctggccttctgcggtggtgcttctcccttcaatgcggctaattccttctccaaacgatccaccttgtcttctaacttgcaaatcttaccacgattccgatcttcacgatcttgagctgctaacacagtctctgcacgactttcatccatggcccacagcatctcaaccaaatgccttgtggtagcatcattctcaattccttcagtctccacggtcacttccctggggttggcgaggatggtagcgatactcagtgtcggccaactgatcactgtagcgatcacggagctctcctatggcgatccttgccacctcctgacatgcatggatgtagtttcttcctccagcttcgaacatcactgagggaatatcttcactattactgttcaaggtgactttgactcggcacttctcttcatgacgatcatgacgaatctgggcataaaaagggacagtcccaaatccaatgacaaaggacatcgtacgcaactcctggacaaaaccctcaacaccaaaaagatactcaggcttgtagcgcggcatctaaagacaagtgaaaggagggagttaagacatttatccaattaatagcacaagcttttggattaatttgaataaagtttagaaaatcaaagtaaaaggtaagtaaaataaagtaaaccaagcttgcaagataagttgaaacagttgaaaacgaggtcacaagttttgtatttttgaataacaggtttcaaaagaaatgaaatcaagttataaaatcaacttgctaaatttattttattgcagcaagattaaataaaacaacattgtaaaacttttgctagtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccagtatttttagagggcttctatgggtaaccatttggcataacctagggtcaagggggctctgataccaacttgtcacgcccggaatttctatccaaaattccaaacgcttacatgtgtgtaaaccctcgtccaggaatcagccgaggcacacaataacaaattgataatagagtacaattattactctaattaataagcgaataaaatgttattacagaggtagatagttcctctcaatcaataaaaatctaagcagcggaaaataaaaacggcgcggacgactccactccacaggcagcttgaccaaggctacacctaatcctccactccatcagcctcatagtagaactcttcctctgatgaatgattgcaaggtgagtatatgacatactcagcaagccacgcagcaaatatgcaaatgcacaggataacaaaggatggcataatagggctccatttgcaaaagcagcatttagcaaacatttggaaatttaaaacagttaagtattaattaagcaatattaatccaacgctatacaacataccctgttgtataagcccaaccattctggacaaccatcccggctgtacagttctatctccaaaccaggaatataccattccaaaccaggagctaatcaaattattaccaattataacatcattactatggtgagaagtgtgtaactaatcacgaaagacattgttcgacccgcccataaccgcgggcacggctattcgaatagttttactctgatcagaggtgtaccactgtacccacaagacacaaccccacatcatgtcaccatgtgcctcaataccaccgcggtacctcggaaaggagttgtgacaatacccctcgcataacacaatccactacagcgcacctttcctggatcataatcacccccttataaacaaggcatggactccccagcgacccccgtgggcttatcttcgccacttctcagtctggtgccccgcaatgaaccatgctatacaaaagataaagccgttgcccatgctggcttatggttggcacgataaatgtttcacaaccgaaactcgtgaaccggtccttaattgtcatgagcacgaccatcaaaaccatgtgctcacaacccaccattaccaggttttagttggcacattaattaatcaactaatcacaattaaccatcgtgaattatcattaagccatcattaaataacagtgaatcataagttatcccaatagtgagctaatgtttctaagcagggctaagcaattatacctaatatctagttgaaccaatataaataaagttcaaccagtcaaattattataacccaaggtatcaaggaataaagtaatcaagaacaagagggccataacaaagaataggttaattccacccaatgacattcgaaaataaatgcaatagttgaaaggaaacaatagctttaaataggatcaacatgctcaaagggttgtttgggatctgtgtgacttgccttgctggccttggaactcttcaaactcttctccggcgaaaacggactctccggaaacgacggaatctaagcagaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcggattaaaacacttaaatcggtttaaattgaattatgacgcaataatgaattatttttgaaaaggaaaagatggtttattgcgtcagcggctagggtttcggtggaccgggcgcacgggcgacggttcacgcgaacggacggccgagatcaaaccaatccaagatggacggccgagatcgatcgggtccacggcggctcacggaggacgaacttgatggcgtcagcgatgacgtcaccccggcggcggcggctcgggcggctgggccggctcgggcggcgcacgctcgccggcgaacgacggcgcgaggacgcaaacggaaggcaccaggacgaagcgggcggcacggcgaactcaccggcgaccaaaacgacggcggaagatcaacggatggcgacggcgacgaggaggaagcggcgaagctcttcgggtcgacggcggcgatgacgctccggcggtcttcggcgacggcgaaggggcggacgaggacggcgacgcgacggcgaacacgacggcggccttcccgagcgatggcgacggctggaacgacggcggcgcacggctggagcggcggcgaagctagggcacacggcgctagggcgactccggcgacgagaggcgaaggcgagggtggcggcgggtagaggagaccacggggaaccttttaaaggggctcggaggcgaaggcgaaggcccacggcgaccggcgacgaggaaggaaggttcgggaaagacgaatccgagacgaactcgaatccctcgatttccaaaccgatttagccaaagattccaaaggagaaaaggtagaggagatcccgaggatcatttcctctctattgatttggccggagaaggaaaggggcggccagattggaaggaaacagcggcggtggctcggcggcggcgcgctagggtttcggcccgaggaagacgacgggcctgacaggtgggacccacctgtcagcgaccgaacgcgcgcgcgcgggcggctgcgaactgggccgacttgggccggggagagagagagaaggttttgggccaactttcggcccaaagcccaaaagagaactttttaaaactttttcaatttaaattatttcttaaatgcaattctatttattaaaaatacttccttagctcaaataaatcccagaaaaatctaggaattatagaattaagcaaagtatttaatgaaattttatctggccccattttatattggaatttattattaaacttagattttcttttcaagacttttaaaataaattctagaaattccatttaaacaacaatttatattttttttgaatttttagggtgtgacacccgtccaccggtgccaccgacggcgacagtcggactcggcagctcttcgccgaatccacggggaggatagctgggtcggcctcctcgactcgctcgattacgacctccgccgcaagatcctcgaccaccgcgactttgagcaggatgttgctgcggcggcggatggacggacggcgtggctgacacgaccggcgacaccggtggatggacgggaacgcggacggatggacgacgcgactgacacgaccggtggcggattgacggggacgcggtggtggcgccaacggatggacggggacacgagcggcggcgtcggcggatagacggggcggcagacggacagacgaggacgaggagtgacgtcagtggacggagtggtacataacgaagaaaattcgcatcccagtggcatattctgaaaatagtacgaattggatggcatatcctgaagtggcaaattctgaaaaatctcgatccaaacccccctaatccatccatcgaatctcgttgctcgccggtcgccgccccgtctcctcgcttgccggttacaaggacgacctcgtcggggcggcggaaccctccagcctccgggctcgccgccgccgccaagctcgcatcccgcgccggccgccgagctcgccgcccaaccccaaccccaaatcaatcagatcaattcaactatccaagcctaagttgttggatctagaatccatggcgatcgtttacgcggtggtggcgcgtggcaccgtggttctcgccgagttctctgccgtctccgggaacgccggcgccgtcgcccgccgcatcctcgagaagcttccgcccgacgccgagtcgcgcctctgcttcgcgcaggaccgctacatcttccacgtcctccgctcccctccccccgccgccgccgatggcctcaccttcctctgcatggccaacgacaccttcggaagtacaaactctcttatacttactagtattactctactaatctatatgatctatggataggataagatggattcgttcattcatcttcttagtatgttcttcattcattcaagatggtaaactgtattgcttcattagctaatttaggcatttttgcatgtacttattcatttatgttcctttcatacaactattttactgttactactctattagtagcgagccagcgaaatccagacatactagtatgatagagcatcacttgttgtataattaattacaggacgaattccctttctttacctcgaggacatccaaatgaggttcatcaagaactatggcagaatcgcccataatgcgctcgcctatgccatgaacgatgagttctctagggtcctccatcagcaaatggagtacttctccagcaaccccagcgccgacacactcaaccgtctccgtggggaagtcagtgaggcaagtatcctatttatttattgccttccacacaatttcctttcatttttgctctacaatcaaatgctcattcttccaacttgcattgtgcagatacatactgtcatggttgacaacattgagaagattctcgacagaggtgagcgcatctcgctactcgtcgacaagacctccaccatgcaagacagtgctttccacttccgcaagcaatccaggaggctcaggagagctctttggatgaaaaatgccaagcttctgtaagtcaccctttctttctttctttcttgcttactactgtactatctatctcttctcttctttaccactcactgacagtacccattaactagtggtcagtcctgcactcaagttcatttgttacaagttactccctaatgacaagtcctgattgatgttataaggcccttcgagattggtacttagccatggacatttgttattccctttttttcctgccagttatagtttaccaaatcctgaattcagcctgaatgaatgtataatcacaaaagtttagagccaacaaagctgcaatttccttttctgaggccaagtctaaagagctttattcatcagtggaaataccattttgcgcgatagtatctcctaagaattcaggagtgcatgtttaaatgagcacactctgcacaatgatgaagctgcaatttctttgctagtccaaaattatgtaatcatgtgccttcggttggtcattattgttgaatagacatgttggataagtgtataactatatatcactcagtgacccttgttgaatggaataagctggtgtatcattgagtttgagaacaatgggctattgctattctgtttttgctggggtttgaaagaattggtgattaatagcaggcataacgaaatactactagtttttttttaaggatctagaaaactgtgtgtttggttgctgattgccatacattatatgtataagatccaaccctttatttattatgatgactctaagatctacagtactaataacatttttgacagcatctgacatattttgtcctgcgttgttgcagtgctgtgttgacagctgtcatagtacttctactttacttgatcatcgctgctttctgtggaggcctttctcttccatcgtgtagatcatgatccgctctacagatttacctcaattaaagcatcacaccatgtaacaacaatgcaagcctatcaatgccatgtgtcgtatctgttcagcacccaaagttacaagtgatgttttgagaaaatgatttggtgctgagttttcgttatcgggagggttgtgctccttcaagttaatatggaacggtttgtacaaaatgggatctatatgtacagtagtatgtcgtttgttgtttgtgttggctaagacttttctgtaccgttgtgcttgcacatgaattggatgttttgcctgatgatatgagtgctgtggtatgccctttccttaactaaagcgaatggcatgtaatattctcaagagaatatatgaatatggtttatgagtaatgttatcctgataaataaattttggaagaagggaaattctgcccaaaattaagtgttgattactacatggagtgtgatgaaatgatttgtagctccccgggatcagctggcgtgatgaatgttcaggtagtgggttggaatggcgtctctgaatctctgaaactttcagaatgctgaagtaatacaatacagagctgaaatttgggaggacatttagggtaacgacggaggagtctataattagtgcagggagttggtaatacattacattgatcgatcaggtagaaagcaaaatgaaaatggtgcagcatggtggattgcagatggcagagcgagcgagcagttagaaagaacgtcttttcttcacacacatatatacaagtatggattggaactcatcatttagtccttacatatacacccagcaacggtctcaggtcaatgataagagttgattattaaacagttagtggtatgatttgatgacccaaacaactacaactcctctgcaaatagagtaatatgtatatatacctacatagatagagggatagattgccaacaagatagatatagatcgatcgatcaatagtagcagcagtaggtaaattaaggaagcagcagaagagattgttaattaattaattaattaattaagcagaggcagcatgagcgggatttgtctctcggatcaatcttaaatatctgaagaagctaatgatgttggccttgagcaatacttatacaaatttgtctgaacatgaataagatttcgtatatatgcttcttatgaataatcagaagaacagaattacattgattgcaatgccgatgttctaatgcaatcatcaatcttaagacaagagtaccaatattacaaagttacagacagatcatatactagtaaatctgctaatgccgcggtggatgactctgattctattgcgttcttataacatcatcctgaaactactgcttttctgtttgcagcatcctgatacgtaaaagtgcagcaacaattgagaaacaaatatatgagttagaagtaagggtggtttctttgtaattagttttagcttggacaaatagatcatgacaggcgataaagtcataaaagatcactccctaatccctactgctcatcttgcctttgtagaacatcttgttttcttggttgggtattagacagaagtatttcattatcgaaaaagacagaagtatttaggagtactactgtactcaaagcaagagctggcagttgaggaaaaccaacttgtcagttactaaaggggcgtccaaagtccaaacaaaaaaaactaatattctcgctcgcgctctctctctctctctctcttttgtaaacgaaaatctgcacataggataaatggaagtctagaagccttttactctatttttttagacgaaaacttagattccagaaaatgtgtctatttcttaagtaacctaaatattccattggcatagattctgttttttttcctattcctttttcttttttcacatcatcgctctgttttaccttttacaggtatatgcttagaattcacaaactactagccaagtctctttttctgaaaattaacaaacaagcaatcatgctgcagcactcaattagctgataatttctgaaacaaagatggacttgaatggctttctacaaaattttctgaacatgaattggattatataaatatgcttgcgatggataatctgaagtataagatattaagattacactgactgcagttccaatgtgctaatggcctaatgcaatcatcactcctaagaagagtttagttcacaccaaaattggaagtttggttgaaattggaacgatgtgacagaaaagttggaagtttgtatgtgtaggaaagttttgatgtgatggaaaagttggaagtttgaagaaaaactttggaactaaacacggcgtaagttacagactgacagacagaataggtggtgtgcaggatcctgtgggttgtgagcctgtgaccatgtattccaagctgccagatcatggtactaattggatgaactacagtttttacattcaagaatcaagatggaagttcctgttcctgaccaaaatgcatcgctccatgtcgtctgaagaagctgatgatgttcagtgttatagccacttgttttatgcttcagttcactaaaagaatactgacctccaaactaactatgatcttaaggggcataacactttccagttaactatccttacaaaagaagtcctgatatgattctgaatattgcaaaacaggacacgaagtatttaaggatactactgtactccagaagaactgagagttgatgaaaactaaattgccacttactgaggagtccaaacaaacaaacaaaaaagaactaacacttctctctttttcgttaaacaaaggctccatatatgataaatgaaagtgtataaagtctgttactctattttcagacaaaaactcagattctgacaaatgagtctattgtctgaaacaacctaaactcagattctcccttctgtttttcctttttgagatcactctgtatttcattttcttggtatatgcttagaatcaaggtaagaatcctcaaatcgcaaaactatacccttttcctgaagattaacaaacaagcactcatgaagcaggactcaccaagctgaaaaaagtctgataattttattgaataaatagggccttgaattgctttgtacaaattgaataggatttacataagaattgctttatacaaattgaataagattacataaatatgcatactatgaataaatcggaataaaaagattacactgattgcaatgccaatttgctaatgcaatcatcagtcctaaacaagactaccaatcatcagtgctaatttaaagacaagactgcagactaacagttctagtaagttacatgcagactgacaatctgaaaccaacactctacactgacagactaaccgaagagaggcacgaagccagggaactgtcacgccctaaaaatcgactaaaattaaaaatgcatattttaaatcatttttagaaattaaattaaaagcctacaagctaaaccctaattttctaggaaaattttcaacataaaaatgagctagataaaattttattaaatactatgcttgctcctctattttctagaattttctgggaattatttgagcaagggaagtatttttaataattgaaacaacatttcacaaattgttttttttgaaaaagttcaaaaaaccccttctttggtcattgggccgaattcggcccaatactccctctctctccgcgcggccgaaccggcccatgccggcccaagccaagccgcccgccccctcctcctccagccgctgacatgtggggcccacatgtcagggccatcttcaacctccggccgccgccgccaagctgagcccgagccgccgtcttccacctccgatcctcctcaatccgagcccgaatcctccgggtttttgaggggttttgttcctctcgttctcctctttcttttcccccaagaatcgaagcgaatcgttgaggatttgatccgaatcgagttcgttttgattttatccctaaaaaccgagtttgatttcttcccgagtcgattcctctcgtttggagttcgatctcttcaatccgatgctatatatagcatcctctcgtcgtcctcttccgtttgccccctctctcgtcctctcccgtgcatcgtagcgccgtcgccacgtgcgccaagtccgccgccgccgccggccgtcttcggtcgcgtcgcgccgccgtctccgccgtcgccgccgcttgccgtcgccaccgttaggtgcacacggaggtgaggaacctcggccgccccttctccatcgccgccgaccaccggagctcgttcgccgccgtcgacccgagccgccgcgccgcctcttctcgtcgccggccgccgtcgtgcaccgtttgttgtcgtggtgagtaccatcgggttcatctcgatgtcctctacgcgtagatgccctccgattccgcggccgaccgtcctagctccggcgagctctccaacccgagccggccgccattgccgacgtcagcatgacgtcatcagggctgacgtcagcatgacgtcatcgtctctttttctttttcttttttccgattttctaatagattaaaactttggaaaatcataactaaataaccgtagatccgttttaggtggttcaagtttctaaatttttctaaaatcaagatctacatgttaaaagtatccacatgtactgtttatgcttgtttttgtactgttttgttgattttgtttatttgctttagtttccgacgttccggaggagagcgtttccgttgaggaaggttccgaagcgtttgcggaagcccaaggcaagtcacacagatcccaaacaaccctttgagcatgttgaacccgtttaaagctattattttatttcaactgtgcattgttttcaaatgtcatcgggtggtgaacctttcccagttaattaatggccgaagctgacttgattttcctatgggttataatttgattagcatgaaccttatatattggattggttcagctaaatgctatatataggtttgcttagccatgcttagaaacattagctaactaaaaggggttaaatataaactatattacataattattattaattaaggttatattcaatggtagctcacgatggtaaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgtgaaacggcgagaagtccgtgggggtcgctggggagtccatgccttgtttataagggggtgattatgatccaggaaaggtgcgctgtaatgggttatgttgtgcaaggggtattgtcacgactcctttccgaggtaccgtggtggtattgaggcacatggtgacatgatgtggggttgtgtcttgtgggtacagtggtacacctctgatcagagtttaatctattcgaatagccgtacctgcggttatgggtgagttgagcaatgtttttcgtgattagtctcacactactcatcaatggtaatgatatgataattaatttaattcctggtttggaatggttaattcctgatttggaggtttcatttgttcaactggggttggttgttcaaatgtggttgggcctatgcaacacgggtgtgttgtatggtgtttatttaatattggttaattattcaactgttttactattctcttaaatatttgttaaatgctgttttctgcaaatgagctgttttatgccatcctttgttatcctgtgcacttgcatatttgctgtgtggcttgttgagtatgttatatgctcattcttgcaatattcattcatcagaagaggagtatttcagtgaaggtgaagatcaggaggattaggcttgttctcggttaagatgcctgtggagtggagtcgccatagctgttccgtagtttgttatagttttgttttccgctgcgtagaatgttatttgttttgagaggaactatctacctctgtaataattttaatttttcgaatattcgatagttaattatttgtactctattatcaatattgtcattgtgtgcctcggttgattcctggacgagggtttaacacacatgtaagcgtttggaattttggatagaaattccgggcgtgacaagttggtatcagagccaccttgaccttaggataagccaatggtaaaccttaagtagccttcaaaatattttgaaaaatatagaactgctcttctctattcttttataaattatttaagttggcagcacatgcaaggttatgcacaaaatttatttaattcaatttcttttcttttaaaaacaaaaagttgttcttttcaaaatgtttcttttctctttaccaaatcctattgattagtcggcactgtacatttattagggtatcgatttaatcatgttagcactagtactactcatctttcctatggtgatactgtaccgggcttataatagatcataattattatagttttattttaattatttgtcaaaaatatatttgtctctgtccaaaaagtaaaattctaaaaacatatttatataatagcttggtatgcgtcttatcttttattttcttcctttttggtcaaaatcagttaagtctagttggtgcagctaacttaaaatatgctttaattcctcttctatgtctctttagatgcctccccattcaccgagaaatttgatcgaggtgttaggattcgtcagggagctgaggttgatggcttttgaagtaggctatgaagttgctcctgagtatcgccagatttcccatgaccccgacgaagagaagtgtcgtgttcgtgtgacgttggctagtgatagcgaagaccttccgtcttttaagttcgaagctgggggaagatcgtactgccatgcttgtcaagaagcagctttggtggccattggagagttgcgtcaacgctttgaagaagagttggattcatcagctttccagtatcatcctcacaaacctcatggtcaagactatggaacctatatctgtcctgatggcgaagagagtgccactctgatgcatgcggtgcatatgcttagtgctatggatgcagtaagtgtggagcgagacaaagcagctcatgatagggaaaactggaatcaaggtaagatttgcaagttgaagagcaaggtgtaccgtctacagaaggaattagctgaacttaaaggagaaacgccgccgccaacacccaagcttcgcctcaccgcaagaaagagaacctgtccgccacctcgtctccagttagcttcgaagattcgcgtgatgggcgaagctgtgcccgatcatgctgaacctgtcatcgacatcataagtgatgaggaagaagaggaagaccctgaagaaagagagccagctactccagaggaagaagatccatcgcttcgttccgacgcaaggcggaagtagtcgctcagttagatcgttgccgtagttcgttgtgatagattgcttgtttaagtttgcttgtgagtgtgtgggttttagttgt

SEQ ID NO: 49573 - DNA, 4599 bp, Oryza sativa
cgtggcaggagttcacggctgcttttaagaagacgcatataccgtcaggtgttgtagctctaaagaagagagaatttagagcactcaaccagggatctcgttcggttactgagtatctccatgatttcaaccgtttagctcgctatgctccagaagatgttcgcactgatgaagaacgtcaggagaagtttttggagggactgaatgatgagttgtcttatgctttgatgtctacggatttccgggatttccagcagttggtggacaaagcgattcgtcaggaagacaagtataaccgcatggagcagaagaagcgcagggctgcccaatttaaggcacaacagggcagtaaccagaggccgcgtctcgttactggacctcaagctccatcgtaccctcaaggaggatcttcatcagttgtccgtccccaacgccagttctacaacaacaatactggtaatcgtggcaatgacaaccgcaacgtggttgctcgtcctgcagcaactccagctcagaaccagcccgtcaggaaggaacagggaagcaagccagtggtgtgctttaattgtggtgatccaggacattatgctgataagtgtcctaagcctcggcgcgtgaagaacgctccagccccgaacaactccaatgttccagcaccgaaggcacgtgtaaatcatgttgcagcagcagaagctcagaatgcgccagatgttgttttgggtacgtttcctgttaactctatacccgcaactgtgctttttgattccggtgctacacattcctttttgtctaaaagttttgcaagcaatcatgggatggaagttgttagtcttgggagacctttactagttaataccccaggcaatcaagtattttcgacacagtattgtccttctgttactatagaaatagaagaagttcctttcccatcctcgcttatcttgctagaatccaaagatctagatgttatcttagggatggactggttatctcgtcacagaggagttatagattgtgccaaccgtaaggtgaccttaaccagtagcaatggggaaaccgtttctttctttgtgtcctctcctaaatctcatggtgtgatcttaaaccaagttgctctacaagagatacccatagtacaagactacccagacgtgtttcccgaggatttgccaggtatgccacctaagagagacatagagtttcggatagacttggtacctggaaccaaccctatccataagagaccatacagaatggcagctaatgagttagctgaagtgaagaaacaggtggatgatttgcttcagaaaggatatattcgacccagtacttcgccatggggagcaccagtcatctttgtggagaagaaagatcatactcagagaatgtgcgtggattatcgagcgttgattgaggttactatcaagaataagtatccgctacccagaattgatgacctgtttgatcaactggaaggtgctacagttttctccaagatagatctccgttctggatatcatcaacttcgaatccgtgaggaagatataccaaagaccgccttcacaattcggtatggtttgtttgagtgtaccgttatgtcatttggactcactaatgccccagcctttttcatgaatctgatgaacaaggtgtttatggaatatctggataagtttgtcgtggtgtttattgatgacattcttatttactccaagacgaaggaagaacatgaagaacatcttcgtctagctttagagaaactacgtgagcatcagctttatgccaagttcagtaaatgtgaattttggttgtctgaagtgaagtttcttggtcatgtcatctcgtctggaggtgtggcagtagatccaagcaatgtggagttagtgttaagttggaagccacccaagacgggttcagaaattcgtagtttccttggacttgctgggtattaccgcaaggttattgagaactctttaaagatagccacaaccagagacttgtgtgttacagagagaagtgattccagtgaacggaggattgtgaacaaagtttccaagaactgaagaaaaggctagtgactgcacctgtattaattttgcctgattcgagaaaaggtttccaagtgtattgtgatgcatcccgactcggtttgggttgtgtgttgatgcaagaaggaaaggtggttgcttatgcatctaggcaattacgacctcatgagaataactacccaacgcatgacctagagttggcagctgtggtgcatgcattgaagatttggcgtcattatcttttcggtaatcgtacagagatatatacggatcataaaagtttgaagtacattttcactcaacctgatttgaacatgcgtcagcgaagatggttagagttgattaaagactacgatatggaaatccactatcacccgggaaaagcaaatgttgtagccgatgctcttagcaggaaaagctactgtaatatgtcagaaggtcgacgtttaccttgggagttatgccaagaatttgaaaagttgaacttgggaatagtcagcaaaggttttgtggccgcattagaagctaaacctactctgtttgatcaagtcagagaagctcaagtgaatgatcctgacatacaagaaattaaaaagaacatgcgaagaggtaaagccatcggttttgtagaagatgagcaaggtactgtgtggttaggagaaagaatttgcgtcccagaaaataaggagttgaaggatactatcatgaaagaagctcatgaaactttgtattccattcaccctggaagcactaagatgtatcaagacttaaagcaacaattctggtgggccagtatgcgacatgagatagcagaatatgtggctctatgtgatgtatgtcagcgggtcaaagcagaacatcagaagccagccggtctgttacaaccgttgaagattccagagtggaagtgggaagaaataggaatggattttataaccggtctacccagaacgtcggcaggacatgattctatttgggtagtggttgataggttgacaaaagtcgcccacttcataccggtcaaaacaacctacacggggaataagcttgcagagttatacatggccagagtggtatgtttgcatggtgttcctaagaagatagtgtcagatagaggtagccagtttacttcgaagttttggcagaaattacaattagaattgggtacccgtttgaatttcagtactgcttatcaccctcaaatagatggtcagacggaaagagtaaaccaaattttagaagatatgttgagagcctgtgttctagactttggtggaagttgggataataatttgccgtatgcggaattctcatataacaatagttatcaagctagtttgcaaatgtctccgaatgaagcattatatgatcgaaagtgccgtacgccgctcctttgggatcaaaccggtgaacgtcaagtttttgggacagacatattgcgagaggcagaagaaaaagtaaagattgtccaagaaaggttgcgcattgctcagtcgcgtcaaaagagctatgctgacaatcgttgcagagatttagcttttgaagaaggagattgtgtatatctacgggttacgccgttacgaggagttcatcgtttccaaaccaaagggaaattggcaccgcgttttgtgggaccttttaagatagtgagtcgaagaggtgaagtagcttatcagttagagttgcctccgtcaatggcgggaatacacgacgtgttccatgtgtctcaattgaagaaatgtttacgtgtacctacggaggagacagatcctgatcgtatagagcttcaggaagatttaacttatgttgagaagccagtcagaatcttggaagtaagcgagaggaaaaccaggaatcgcgttatacggttctgtaaggttcagtggagtaatcattcagaagaagaagccacttgggagcgagaagatgaattgaagtcagctcatcctcatctgttcgccagttcttctgaatctcgaggacgagattccgtttaaggggggtaggtttgtcacgccctaaaaatcgactaaaattaaaaatgcatattttaaatcatttttagaaattaaattaaaagcctacaagctaaaccctaattttctaggaaaattttcaacataaaaatgagctagataaaattttattaaatactatgcttgctcctctattttctagaattttctgggaattatttgagcaagggaagtatttttaataattgaaacaacatttcacaaattgttttttttgaaaaagttcaaaaaaccccttctttggtcattgggccgaattcggcccaatactccctctctctccgcgcggccgaaccggcccatgccggcccaagccaagccgcccgccccctcctcctccagccgctgacatgtggggcccacatgtcagggccatcttcaacctccggccgccgccgccaagctgagcccgagccgccgtcttccacctccgatcctcctcaatccgagcccgaatcctccgggtttttgaggggttttgttcctctcgttctcctctttcttttcccccaaga

SEQ ID NO: 49574 - DNA, 702 bp, Oryza sativa
ctgcggagcggcggccgagagaggggagggaaggggaaaggaggcgacggtccacggctcaccccggggcgacggcggcgacggaggaggcggccggagcggaggtaggcggtggcgcggctcgggtcgacggggacggcggcgctccggctatcggcgaccgaaacagagaggtgaacgaggtcggcgaggatgcggtgaagccgaaggaggcggcgccgaggtgggaggcggtccggggcgacgacggtggtggaccggagctcggcggcgacggcggagagagagcgacgtcgcgagctcgaatccggcgaggaggaagggcggcgagaggtggaaccggacggaggaggtgcggggagggtttaaatagggttggaagggggagagagcggccagggaggaaggaaaccggcgtgggaggtcggccgccgtcaatggcgccagcgagatttgcgggggcaaatccacccgtttgaacacgagagagagaggaaaaatggggggaaagggagaggggatcacggggagtatttccccccactttattgcacgcggggatggcgggattcggcggatttggcggcggcggcggcgcgcggggtgggaggccgaatgggccgcgggggagaggagagagagaggggggacagagatgggccgggccggcccaagtgagggaaggggtacttttggggtttt

SEQ ID NO: 49575 - DNA, 1542 bp, Oryza sativa
gtatgtgcacttggtatttcagctatgaattcatttgtactagactacttgatctagggaaatggtactgtttacacgattgattcctgttataaaaataggggtccacagagctggtatcagagccatacgactgtaggaaaagaccaaaaggcgccccaccccttttctaagttggccaaggaaaaattcccatttagtaatactttcaaaaataaaaacgctatgtttacaaaactctatacgattttcatcttactcttaactattttcttcacaaaacgagttttactcttagctgaccttgggtttttcttaaaattcgatggcagatcaggattcacccgctacctgggagatgggcgtaccccgctcagagggatacgtcattgagctacaccggttgatgaggtgtctgcgataccctagatttccgatctaccgagtgagatagagtggctttgtttgggaggctcaggtcgaggttcacacacgagttccttcagagtcagactacagcttcctgacatgccaccgtcgtgacttaccgaagaccgcgatgcaggatgcagcccgggaggccttcctccgacttagctctatccaccgagctgagttggcgagtactgagtttgctcaccacccgtttcgagaggagagcaactccgtctgcacggctcaggacacaccttgctgctacaacccgatagtgactcgactgtcacgatgggctgaggcagtagacgacttttacgaggaggctctgttagagatcaacgaccagcagaggcgtgtgggagagttagagaccgaggtgactgacctcacagtgcagcagcttcagctagaggaggagcaccaggcttggggtagtaagatagactcaatgaaggcatagctccaggtccacggcgaccggttccagcagttatctaaccagtacaatgatcgccgcgggatgatggatacacttgaggagcaggtgagagagagtcaggagcacgtcagccagctggaggagcagcttcgagcagccacggtcagcaccacaggagcttctacttccacagcagtagggtatgaccgctactccttcctcaccacaccgtacccaccagcgttccacactcttttgggagaggttggtatgctggctactgagtcagcaccttacttggtggacccgacagtgacacagccacctgccccggagattgtgcacactccactgatccctacaccttctccgcagctaggttcgagtttggagactccgatccaggtcgactccgagacagaggggaccgacaccgagcagagatcgagccagacatcactgatccttcagaggatgagacccctgttccccgcatcaccttcctcggacgccctcacaccctcagcactgcccgcaagagcacacgacccccgggcaagaagcccaagccagatccagaggccactacttctgagccgtggggactcaggtttgcctgtgccagcgaccaccctctacctgccccaggatcctgcggatggttg

SEQ ID NO: 49576 - DNA, 1252 bp, Oryza sativa
actatcaagaacaagtatccactaccatggattgatgatctttttgatcaactcaaaggagctaaggtgttctctaagattgaccttcgatcaggataccaccaattgaaaattaggaccggggatatacccaagaccgcgttttcaacacgctatggattgtatgagttcacagtaatgtcgtttgggttaaccaacgccccggcatactttatgaatcttatgaacaaagtgttcatggattacttggacaaatttgtggtagtattcattgatgatattctaatctactccaaagatgaggacgaacatgcggaacacttgcgattggtactcgagaaacttcggaagcataaattatatgcaaagtttagtaaatgtgagttctggttaaaagaagtcgcttttctaggccacgtaatctcagccggtggagtagcaatggatcctgctaaagttgaggccgttacggaatggaaagcacccaaatttgtgactgaaattcggagttttataggcttagccggatactaccgaaggtttattgaaggattctctaagatagcccgaccaatgacacaactactcaagaaggaaaagaagtttgtgtggttagaacagtgtcaggaaagctttgagcagctcaaagaaaagctgacctcgtcgcctattttagttcttccggacatctggaaagactttgttatatattgtgatgcatcaaggcagggactaggaggagtactgatgcaggacggaaaggttgtggcctatgcatcacgacaattgcgaccacatgaggaaaactaccctacccatgacctagaactcgcagctgtggttcatgcgctaaatatttggagacactatttgattggaaaccattgcgatatctacactgaccacaagagtctgaagtatattttcacccagtcagatctcaacttgaggcaaaggcgatggctggaattaatcaaggactatgatctagaggttcactatcaccccggcaaggccaacgttgtggccgacgctttgagtcggaagagccattgcaatcatctgaggacggaagggatggctcctgagcttaaggaggaaatagcccaactaaacctacatatggtacctcatggacagataaacaacctggacattcaacctcttttgagaacccaaatagaagaggcccagaaggacaacgaggaaatccgagaggtgaaggaacgtctagttgcaggatttgcaaagg

SEQ ID NO: 49577 - DNA, 1193 bp, Oryza sativa
cagggtacgattccatctgggtgattgtggatcgactcaccaagacggcaagattcatccccgtcaagacaaactataacagtgctaaactcaccgagttgtacatgaccaggatagtgtgtcttcatggtgtacctaagaggattatatctgatcgaggcacacagtttacctcgtatttctgggagaaagtacatgaagccctaggaagttaccttgcgtttagcacagcttatcatccacagacagatggccagacggagagaaccaaccaggttttggaggacatgctgagagtttgtgcaatggattttagcaaagactgggagagatgtttgccctacgccgaattctcctacaacaacagtttccaagcgagcctaaagatgtcgccaaatgaggcattatttggtcgacgatgtcgtaccccactaatgtggaccgagacaggtgaacgggcgatatttggacttgacattatcaaagaagccgaagaaaaggttcgcctgattcgagaccatctaaaagtggcacaatcacgacagaagagttacgccgacacccgaagaagaaacctggaattgaaggaaggagactacgtttatctaaaggtttctccgatgaggggaacgaaaaggtttaaggtcaaaggaaaactagcgccaagatatgtgagaccttttcaaatcacggctagacgaggagaagttgcataccagttacagctaccagaaaatatcgccgatgtgcacccagtctttcatgtgtctcagttaaagaagtgcttgcgagtgccggaagaacaagctacgttggaagaaattcatatcagcaatgatctcacgtatccagaacacctagtccggatattggatgaagctaaaaagaagactagaaccaaagtgtggcgtatgtacaaagtacaatggagtaatcacactgaggatgaagccacttgggaaagcgaagaattcttgaagacagaatacccccacctattcgaaaacctgtaagaaatctcgggacgagatttatttaagggggtaggtttgtaacaccctgaaaatttgaccaataaaaacaaaactctaaaaatacgggccttcgaaaacttttaaattaattgcatcatgccgatcttattcgcctattttatttggatttgatttcgaagttcattaatcgtgagtaaa

SEQ ID NO: 49578 - DNA, 3084 bp, Oryza sativa
tacgcttccgtttgttaaactctgaattgtatcaacttttggtgtaccttgcctcctgggacaaggaacaatacacgcacgtcaggaacgcctgttgggtgatttccggtcgtgacaagttggtatcagagcctcccttgaccctaggacgagccgtagatcccaagccttagcaatatttttgaaaattaaaaatcttttgttatttgtgaaaacccgctattctctctctgtcttgctgcttcatttatcgccaaaatctgatctctaaaatgctgtttttcttttgtttttgtttgtagatggccggcagcgtcacccgtcgtggtttggacatgactggcttcgtcctggagctgcggggcatgtgcgtggtcttggggtatccacatggagtggattaccaggccaggccgctcccggagcaggagggtgaggatgcagagcctcacgctgggtgggaggtcactgcagtgatcctctctggctctcccgagcggacttcgctggcagtcaccgcgggtggggattcttctcccgccgcttgccagaacgccgctctcctcgccatcggcaccctccaccagcgctacccggacgagttgcagcactcgccctatcgctaccaccctcgtcgcggaggagcccgcgacttcgccaccttccgagatgctagcttggaggatgacgctaccgtcgtgcatctggcacgcatggtggaggcatacgacgcggctcgtatcgacttccatcagatggtgcgtcgcgggatggttgagaacaacctgaagatcctggagctgcgtcaggagaacctgcagctcaagaaggacctcgacgcattggaggcgcagctgcaccagctcaagatcgcccagggagaggacagccgccccaagcgtcgccgcgtctgccgcagccagaagatcaccgcccggaagagcacctccaggcccgagcttgttcgtcagtccctggcgtggacttgcttcgtcgagacccctcgtgccgagcctgcgcccgtggttccccaggagggggaagcctccggcgttggtagcacggaggatgcgctgttgctcaccttccgccctggcccgtcgcagcggtagacgagcagttagtaggcttgcgcgtgtgtttttcctcgtttgtcttcttgggttgtgtggggcatggttatgccagtgtgtggcataactatgtcggagcctgtcttgttttatttgtttaagcaacttgaactctaatgaaccaattcaatatcagtaataaattcaagatttatagtagtcgtgggtggttagttttaatcgttagctctctctgtttgctggtgctgtgtggggttttcagatggtgacgaccaggagaaatgttagcaccggtgaaggcaaccaacccgaaggcagcaaccccaacccccaaggcaatccacctccaccaccaccaccagacaccaacgccattctcacccaaatcctcgcccagcaagccaacatgatgaccgctttcctccaccacctccaaaatccgccacaacagaatgctccaccaccacctccacaacactctaagctcgccgagttcctccgcatccgcccacccaccttctctagctccaacaatcccgtggatgcgttggattggttgcatgccgtggggaagaagctggacactgtgcagtgcagtgatgaagagaaagtcatcttcgccgcccatcagctgcaggggcccgcatctctatggtgggaccatttccaggctacgcagccagaggggcaaccgattacttgggcccgcttcaccgccgctttccggagaacccatgtgcccgccggagtcgtggctcttaagaagagggagttccgggagttgaagcaaggcaaccgctccgtgatggagtatttgcacgagttcaacagtctggcccggtacgctccggaggatgtgcgggaagatgaggagaagcaagagaagttcttggcgggaatggaccctgagctgtccgttcgcctagtctctggggactatccggacttccaacgtctggtggacaagagcatccgcttggaggccaagcacaaggagctggagacgcacaagcgccgcttggcgaacttccgcaatcagcagggcgctaaccagagggtccgctacaccaatccctatccagggggatcctcctcgcagcagcaacaacagcagcagcaacctcgctccgcgcctcgacctcaattcgtggtgcgcgtcccacagccgcagcagcagcagagtcagcaagggactcgtgtagcccgtcctcctacgccagttgtgcagcccgttcaaggccgcagggacgctcaaggtcagcagcgtttgtgcttcaactgcttcgagcccgggcactttgcggataaatgcccaaagccaaggcgtcagcaaggccaagcgcctccccgctccaacaacggtggcaaggacgtcattcggggtcgtgtgaaccacgtgacggccgaggacgtgctgacaactccagacgtcatcgttggtacgttcctcgttcattccatcccagctactattttgttcgactctggagcttcccactcgtttatatctgtgccattcgtggggaaaaatcagttgggggtagaaaggcttaggaaccctctactcatcaccacccctggaggggttatgacagcaaagtactatagccctgccgttcctatagaaattcaagggattccttttccctcggatctgattctgctagacaccaagaatttggatgtgattcttgggatgaattggttggctcaattccagggagtagtggattgcgcgagacgcactgtcactctgtaccgaggaccggaacaaccggttgttttctttgcacccccaacctctgtcagaagttcaaaactgcatcaaatagaactatcagaaatccccattgtcagagagttcggagatgtgtttccggaagaactacctggtatgccgcctaagcgagagattgagttccggatagatcttgctcctggaaccactcctctgcacaagcgaccctaccgtatggcagcaaatgaactg

SEQ ID NO: 49579 - DNA, 2279 bp, Oryza sativa
tggttgtccgaagtaaaattcttggggcacgtgatatctgctaaaggagttgccgtggaccccgaaacagtgaccgccgtcactgaatggaagcaacccaagacagtcactcaaattcgcagtttcctgggtttggcaggatattaccggagattcatcgagaacttctccaaaatcgctcgacccatgacacagttgttgaagaaagaagagaaatttgtgtggagcccgcaatgcgagaaggcattccaaactctcaaagaaaagctggtctcctcgccagtgttaatcctgccagatactcgcaaggatttcatggtgtactgtgatgcttcgcgccaaggattggggtgcgtactcatgcaggacggtcatgtggtagcctatgcctcacgccagctacgacctcatgaaggcaactaccctacacatgacttggaattagcagcggtggttcatgctctaaaaatctggcggcactatctcattgggaatcgctgtgaaatatatacagatcataagagtctgaaatacatcttcacccagtcggatctgaaccttcggcaaaggagatggttagaactcatcaaggattacgatgtgggaattcactatcatcctggtaaggccaacgtggtcgccgacgctctaagtcgaaaaagccattgcaacactctcaacgtccgtggcattccacccgagcttaaccaacagatggaagccctgaacctaagcatagttggtcgtgggttcttggccgcgttggaagccaagcctaccttgctcgaccaaatccgcgaggctcagaagaatgatccggacatgcatggactcctcaagaatatgagacagggtaaagccgctggtttcacggaggatgaacacggaaccctatggaacggaaagcgggtatgcgttccagatagcagagaacttaaacagttgatacttcaggaagctcacgaaagtccttattccattcacccgggcagtacgaagatgtacctagacttgaaggagaaatactggtgggttagcatgaagcgggaaattgcagagttcgtggctctatgtgatgtgtgccagcgtgtcaaggcagaacaccaacgaccggccggacttctccaacctctccaagtaccagaatggaaatgggatgaaattgggatggatttcatcaccggacttccaaaaacccaaggtggatatgattctatatgggtaattgtggatcgactaacaaaggtagctcgatttattcctgtgaagaccacctatggagggaacaaactagcggaactctacttcgctaggatcgtgagtctccatggtatccccaagaaaatcgtatctgataggggaagccaattcacctctcacttttggaagaagctccaagaagagctgggtacccgtttaaatttcagcaccgcctatcacccgcagacagatggacagaccgagcgtctaaatcagatcctagaagatatgcttcgcgcgtgtgtcctagattttgggaagacttgggataagagtctcccctatgccgagttctcctacaacaacagctatcaagccagcatacaaatggcaccttatgaagcgttgtacgggcgcaaatgccggacaccgctattgtgggaccaagtcggagaaagccaagtgttcggaactgatatcctgagggaagctgaagctaaagtcagaatcattcgggataatctaaaggtggcacagtcccggcagaaaagttatgcagataaccgacgccgtgacctggaattcgcagtggacgattttgtgtaccttcgggtcacgccattgcgaggggtacacaggtttcagacaaaagggaagctcgcacctcggtatgtgggtcccttccgtatcatcgctcgacgcggagaagtcgcttatcagctagagttgcccgcctccttgggtaacgtgcacgatgtgttccatgtgtcgcaactcaagagatgtcttcgagtgccatccgagcaggccgactcagagcaaattgaagttcgcgaagatttgacctacgtggagaggccagtgaaaatcctggacaccagggagcgcaggaccaggaaccgggtaatccgtttttgcaaggtccagtggagcaaccatgccgaagaagaagctacttgggagcgtgaagacgagctgaaggcagcccatcccgacctcttcgccagttcttccgaatctcggggtcgagattccgtttaaggggggtagggttgtcgcgtcccaaaacgaccctaaaa

SEQ ID NO: 49580 - DNA, 12346 bp, Oryza sativa
tgatggattccatccaacgcagctcgtaataaaaatggaagaggtcaaggaaaggcactaccccaatttaggcctcgcaaagatgagagaagatgctcaaaaaggcgatggagttggggttaaactgaagcaaagaaaggccgtagaaattcaagacaagaagaagaaactcggaaggcggaggaagaaaaccacaagaaacataatgttcaattacaaccatgcggtgaaagatgggtttaggttctgtacctctagcctccctctgcatggtcccgcgaccggggagggcaccgtcgtcctgtagcttcttcatggatgcggtgttcgaggaagatttctcaaggtccattgctgccggaggatcgccggagaataggatgaaggaagtgagctagggtttttttttgtggggagcggagaagacgaagagtgctagaaggcaggagagttttcttgcaaacggacttcaaatggatccccaaaatccctttaagtaaacgtgcttccgatggtgcgtattccaaggaaaggagagagattgctgccggaaaattctgggtccgttgcgtggggtagtttttcagacttcaatttaaattcactcatggccgttgaacttcatgcggtgttgtcgatggctctttgtctctacagttttcacaccgagatcgaccagatgagagcgacaacaattccgacatcagaagttgcgatcgataacatgagctcatttaagcagaagtcgggggctactgtcaaggttacggataaggtataccctctatccttggctgtacgttatatactaatacggtatacccacgcgtatatggatagtttccgtattgtcgcgtcccaaaacgaccctaaatttcatcctcaaaattgtgctgagaataattaaaatcaatgtgaaagccttcaacaattaaaatgtgcacagataaaagtcaaatgaggcttggaggatttttgtatatttcctaaaagcctaaaacgtgtaaataaattttagtggaattttcagagcacaaataataattgaaaagaaataaacatagttaaaaaggtttataaaaagaaaatcttaaaagaagttcttttccccccccccttttctcttcttgggccggctcggcccaatccctccctctctctctctcttcccccacggcccatcggctcctccccgcgcgcgccgctgacgggcgggcccgcccgcctgccctcgctgacgggtggggcccacccgtcgtcttcctcctcccgccgcgcccgccgccgcgcccgtgccctagcgccgccgccgccgccaaatccgctcgctcccgccgtccccgcgcgcattaaagagaggggaatcactccccgtgattccctctcccgtttcccccgcttttccctctctctctccctcggattcgtccgatttccttcccgaaaccctcgccggcgcaatcaatggcggccggatcctccgcgaccgattcctccctctccggccgctctttcccttccccggcgctatttaaaccctccccgtgctccgctcttccgtttccgccgctcaccgctcgctctcgccgtcggattcgtgctcgcgccgtgctccgccctctccgccatcgccgccgagttccgttccgccgccgtcgccactccgggcttcctcccggctcggcgccacctccctcggcatcgccgcatccccgtcgaccccgtccgccgatccgcttcgcccgccgaccgtcggagcgtcgtcgtcatcgtcatcccgacccgctccgccgctttcctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgccgctcccgtcggccgtgccggcgaggccgccttcgggcgcgccctcgcggctgccaggtgggcccggccgtccgccgcccgcgcccgcgggtgcggctgacgcgcgggacccacggcgccgaccgccgccagccgcgtgcgcccggtccaccgtggaccgtggggctgacgcgtgggccccacttcccgtggacccggcccgcgcgcccgctccctcggctgacgcaataaataggattttttttaattaaaaattaaatgaagaaattcgcaaatatccatttaaagagcatataaacttcaaatggccatatcttggccatttgaactcggaattggaccgttcaagtctctaatttttcctcaagatgtaaagaacccatttttgtgctttgtttctgctgttatatggagttatttagtgtttaagccttttcttttccgttggtcgtgtagacgttgcagcttcggaagatccgctcttcgtggaagtcgaagccgacgtttgggaaggcgagcaaggcaagacacatcatcttgatcatattgaatcccagtttataaaattatgttgatttaaattattgcattatcgctttatttaaattcccgcgttatcactgttttatttagccatgcctacttacctttgttatgaccttattattattgtttttgttattaataccttgttcacctagattaaacaaaactccaactagtggaccctctactcatagtaccactagtataattttaggtagatgcttcgcaatttaattaggtaacattaggtggttttataactttagactttgggaaatattcatatcacctggacactttggaatggttggtttattgtggaattggattcacaccatccccctttattcaaaatccccaaaatggttttaggctgggctcgaggtgcatggttttgatagtagcacctcggccatataaggaccggtcttcgggcctctgttgcaaagcactaccgtacttccacatgtctagtgggtaaggcttagtttgtggctcagtctagtcgtaaacagaagtacacggattggagatggatgaagtcgggggtcgatggacattctccagggcaaatgaaggctacacgagctgcggcccggtagtcgagatgtcgaatggcagagggttggtgccctgctgctaggggctcagtcctgcctgcctgtcccgggggttccggccgtaggcgggattgggtcggtactcttgtctatggctaggatgggttggaaactatgtcacgtctttcgtctgtataccgtggtggtatgtggcacgtggttgcacgtgagacagatgtgtcttgtgggtaaagatgtacacctctgatcagagtataatctattcgaatagccgagccctcggatatgggcaagccgagcaatgtacccaagttagtgttttaattcttaaaacctgcttaacaactaaaatatggaatggttggcctgggttggcttgggacgagctgggacccagggtcgggttgccagttcggtctgaatcataataggccttgggttaaggcaggttcgtgtgggttcacggccttgattaataacattgtatagttctagaatcgtgcttatcaaatagctttgagcaactaaacgtctttaaatgctgtttaccgcaaccctaaccctttatattataattcccttgtactcccttgcatttattttgcatctgcgggtgtgtcttgttgagtacggtggttgtactcagtcttgctcaatttttcccaagcccagatgaggagttcctggaagatgaaggctttggtgtctagctcgtgcctgccatcaagtgcctgtggtcgtcgccctagtcttccgctgtttctcgtttgtctttgtgtgttgggccttcgctgcccgtgtaataattatatttacgcttccgtttgttaaactctgaattgtatcaacttttggtgtaccttgcctcctgggacaaggaacaatacacgcacgtcaggaacgcctgttgggtgatttccggtcgtgacaagtatacattaaggaaatctatcacgtgataaggatggtatctacggatggaaggagttctactcggacaagactgggtctttaccatattgtgaggggtccgatatctccaagtcctactaagagatcaactgacccgcggtatatcagggaccccctgggcaggacctaaggtcatcgaatatcaccaccaacacacccaccacagcctacggagccggagcgtgcaggagccaagtcgtcgggtgtcgaggagatgatcctctctagcgggagatcgtgagatcccccttttgtgagttcggccgggggaaagggctcgcctctcgagattgcgtatccgccttgaatgctcctaaatcgcatgcgaacgccaagattacacaggttcgggccgctatcgagcgtaataccctactcctgtgtgtgggactagtggttgaatgttacaagggatcctaactccggagagcgttcttgctcttcgctttcctagagttcaggtctactgagtgtcgtcccctttctcggtaggcaaggtcctccttttatagttcaaggggataccacatgcaccgcctctactctactcttccatgggagggcgacccactttaccttgaccgggtcatgacccgtgccttcgcctggaggctaagcagcagtccgtccttgagcaggacacagcgccaccccccacctgacacggggaacagccctgtcattccctcataaatgggtgaagacttgtggtggtcgtcctctcacggagggaactccgaatgacactccgatgggacgggacatacctacctccactccgccggatacagaggcgacgtgggggcacggccacccgtccaatcggacgtgaccggcaataggccggtcacagactggtcccgcctgattgacgtgggttagtcaggcggcaccgcacgtctgcccctaccgcattaaacgcggtgagggacagttggggcgtcacgcattgatggctgttcagcctgggtcgcctccccgctcgctccccccaccaaatggcggttgggcgagggcctcggggcgaggcagcgcgagggcccgaggggcatgacgtggcaccccgaggccccccggccgcttctgccactcgcgaggtgcgggagtaaggccaagctgtagagccacgcggctagatgggaaggtaacttcccctcactttgtatacccccgggaccatatctccgacagtagcccccggtaccgcgtcgaacattggcccccaaaggacagtctgacgtggcgcctcacgacttcccgtgctgtggttgtgggcccggcggggaattcagagggttgtcggcgagcggccaggctggcgctttagccagaatggtgatttgaccaccattaaccacgctgatgctgggggtgcctagggcgcgaaaatcggggggtcggctagaccacgtccagaatcgtcacccacgccgcctcgactccctcacctgctaggcacgtgatgggaccgatggtgggcccgcctaaccgcgcccgtgaacatcgcacgccccgcgccgagtgtgccgatgacaggcgcactaaatgcggggcgcgggttcagtggggtggtgtgatgggtggacgcgagagtcgagaaggcaaccgcagacgcgggaatcgagggggcagccgcaagggcgtgaaacgaggaggcgagcgcgggcgaggcggggagctggggataaaagggcagggagggagagagttcgtctccttcctctcgccgactgctcacccgcatactcgctcctcaagccctaacgcttctctcgctccacgctgttccatacaccatactcctcgccgttttcccgccggctaccacgggccaagacgctggtgacgctgtgctcccggctttacgcatcacggcagagaggtaccttagcctcacccgcaagatcatgccggaggacgccgccgtgagggtgggggagtcgcaaccgcggccgcggtacccagagcgatccgtgcacctcctgtccttcgccatggtggggttgataccgccattttccatccacggatcgaggtccttgaccgcaaccagcgcgaacaggatgggcaccgccgggaacaggcgtagcaggcccgggagctagaggagcatgctcgggtgctagaggagcgtacccaggcactggagaagcgggcgtgcatgctagaccagcgtgagaccactttggccgcccacgagagaacggcggctgaggcggagtcctccctccgcctccatgaggaggccgcagccgatcgcaaccggaccaccctcaccgctgttaacgaccaactttggtaatatcagcatcggagatgaagatggatcgaagcggaatcgaagataagggttgttgcggaaacagagtaagaatcggctggagtccggatcggctacgattgggatcggctaagtctgagtcagactaggttaagtgatgtagccgattccaataatacgacttgcgtacgacaacgggttcgaattgatgtgcttcaagatgattgccacgcatggatagagtcctgggaaggcaattgtatctattaattaggatattttatgtaaattccttagagataaatgtgggcaaaagtctgccacaaagacttatggtatcttagagtttgttagggataagagtcgtgtccaatatggacatatcttataattcttgggtataaataggccccgagccctatgtaatggataacacacacgttcaatacaattttggcgcatcaccaccctttttgctttagttttatttcgacaagttcttgctttcgggttgagctgcatgggtttcgatcttcaacaaaaggtaaaacttgttatggcggtttgtgttctcgagattagtgcttccatccttatgatactctagtcttgtttacgtaattcgtcgagttatcatatatcttgcataatccttgacgatatcatcatctaacctacaatcggctaacatctgttaccagaaggcagccgattaggttaaataacgacgttggcttagattatatgagatatccaccactctatgaaacatccagcggcttgattgtctagatattgttcttcttttcatacttaatgctgtatcagttgagtttgatctattaagtcgtgcttagaatttcaatacatgctagatctatttgatcggctatgctatgaatatatatatataatctcattaataatatatatttcgatttaagtgatttatactgtctcggcaaggtgaccgatctatcccaatcacttgattcaagtatatatcgatataaggattatatattattgatgtctacagccgattgagtagatttagttctgatttgtttacttaacacttgccgatcgatttacatatgacatcggctcaaagataaatgatatgttattggcatttagccgatcggctatcatttatggatttaattacggtttctttgtctttgtttcttgttgattgcaggatcaaatcaactggcatgctcacacatctgaaggcgagttttggacctgcactggagttaagtagatctcccaggcctcgtgttttctgtcaacacgcttttggcacgcccagtgggaccgattagaagtcagaaggcagcttccctcatggctgagaaaccttgtcgcgactgagaaaatttcattttcccgaatgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacgggtccatcttcacaggcgctcaactggggtataagccaagactccacctaagacttcttctccaaagcttctcttactgaaggggggagaaagatagagcaagaatgagtacaaccacagtactcagcaagccacaccggagatgcataattaatgcaaggggtacaaggggataataatatagaggttaagttttgcagtaaacaacatttaaaagtcacttagttgcccaaagctattttgtaaacacgatcctaaagctacacagtattattaatcaaggtcgtgaacccacatgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggctagcccataaccgagggcgcggctattcgaatagattatactctgatcagaggtgtacaactttacccacaagacacatcttcctcacgtgcaaccacgtgccacataccaccacggtatacagacggaagacgtgacatagtttccaacccatcctagccatagacaagagtaccgacccaatcccacctatggccggaacctccgggacaggtaggcaggattgagcccctagcagcaggacaccagccctgtgccgtgacatctcgactaccgggccgcagctcgtgtagccttcatttatccttgagatgtccatcgacccccgacttcgtccatctccatccgtgtacttttgtttattaccaggctgagccacaaactaagccttacccactagacatgtggaagtacggtagtgctttgcaacagaggcccgaagaccggtccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctagggtgaacaaggaaataataacaataacaatattaaggtcataacaaaggtaaataggcatggctaaataaagcagtgataacgcgggaatttaaataaagtgataatgcaataatttaaatcaacataattttacaaaataggattcaatatgttcaaagatgatgtgacttgccttgctcgctttcccaaacgccggcttcaacttccacgaagagcggatcttccgaagctgcagcgtctacacgaccaacagaaaagaaaaggcttttactctaataaactccaaatgacaagcaggaacaaagcacaaaaatgggttcttgacttcttaaggaaaaattagagatttgaacggtccaattccgagttcaaatggccaagttatggccatttgaagtttatatgctctttaaatgaatatttgcgaatttcttcatttaaattttaatttaaaattggatttattgcgtcagccgaggggaggagcgcgcggaccgggtccacgggagtggggcccatgcggcagcctcacggtccacggtggaccgggtgcacgcggcgtacgccggccggcgccgtggttcccacgcgtcagccgcacccgagggcgcgggcggctgacggccgggccccacatggcagccgcgggacgcgcccgaaggcggccacgccggcacaaccgacaggaggcggcgcacccgcgccccgatggtcgccgccggcgaccaccggcgcggcggagcggcgcccgagagaggggagggaagggggaagcgaaacagcggtccacggctcaccccgggtcgacggcgacgacgggaacagcgatcggagcggaggaaggcggcggcgtggctcgggtcgacggggacggcggcgttccggcggtcggcgggcgaaacggaggggtggacggggtcggcgaggttgcggcgaacccgaagaaggcgacgccgaagcgggagaaggtccggggcgacgacggcggcggaccggaactcggcggtgacggcgaacagagagagcgacggcgcgagctggattccggcggagagagagagcggcgagtggtggaaacggcagagggaggcacggggagtgtttatatagggttgggagggggagagagcggccggatgagggggaatcggccgcggaagatccggccgccattgatgcgccggcgaggtttagggggaaacgttttcgaacgaatccgagggagagagagagggaaaagtggggggaaagagggagggaatcacggggaatatttcccccctcttgattgcacacggggcggacgggagcggcgggattcgcagcggcggcggcgctagggcacaggcgaggcggcgggagcggcgggaggaaggggatgacgggtgggccccacccgtcagcgagggtggcgggcgggcccgtccgtcagcggcacgcgcgcgcggggaggaggccggatgggccgcgggggagaggagagagagggagggaggtgggccgagccagcccaagaggggaaagactttttagggtttttctttttataaaatcattttaactttttttatttcttcttaattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagaaaatgatttttatttcgggatgaatttatcaggacgtgacaaaccaccactgtcaccgtcgtcggccagcctgagtaatgttaaggaaaagatccagaagctcggtttgactgacgtccatgaaggaaacgttgtgcccattgatccagagaagttcactcccgaacagaaggaagacttcaatgcaatgatgcaacaagcacaagatcaatttttaagttcattcatgcagactcgcaagggcacatttgttcagaagtacaaggtgaaggtggttcttgaggatcctgggatcggttcttctaaagagggagaaaagaaacaagttccagacggatcagcccagccgagtgacaaaggcgttacagatgggtcgacccaggagaaccagggtgactacttccatggagtacatggagttcaaggtgacggcactcagggaccacaagggggaaatcttaatcagaatgacaatgcattccaagattttttcaataactttcaagatcgagttgactatgttgtgtatagtgctttgattaatcaatctggagtgttgactaataccttgtcaaatataatgaaatcggtagccgatggttcaatagctgaacatcaggctgcaggcccagtttatttgcaagggggtacttttccaaattattgaactttgatcaccgatgttcatccacttactcagggaattcctcctgttgcatcatcagctcagccgatggcaccagcatcagctccagcacctgcagcgccgtcgtcggctccaggccaattaatcaatcgtcaattattggtaagagagcaatctcagcatcctagaccgaatgtgactcagctaacacaagaccagattgcatctaggtgtttctacctcctcagaatgctgttaattcagctcagcagcagccgattcagcaaacaccgcccaggcaacaggttgtgcagcctattcaacaaacatctccaatccagcaggtcgtgcaaccagttcagcagacgccagcaaggcgactggctttacagccgattcagcagacgccgttgagacagtaggtcgttcagccgattcagcagcaaggctcaatgaatgtgttgcctggatttgcaacacctggtggtcagcctgtgcagtacactacaaatcaggttgtcccggaacacctggttcatcatgtgcaaccagatggttcagtggtacctcaagttattcctgagcatttggcgcgtggtactcagccaaaccttcacaattaccaggggggcaatttgagttatgaatatcagcctccatcacctcaagttcagtaccaacaggcaggatcggttcaacctcaatttgttcatcaatacaatcagtttgagctgtcgcgtcccaaaacgactctaaaatacatcctcaaaattatgcatagaataagtaaaatccatgtgaaagcctccaacaattaaaatgtgcaaagttaaaagtcgaataaggcttggaggatttttgtatatttcctaaaagcctaaaatgcgtaaataaat

SEQ ID NO: 49581 - DNA, 2042 bp, Oryza sativa
tcctgaggaaccacgggcgcgggctcggtacgaggggtctcgacgaagcaagtccatgccagggactgacgaacaagctcgggcctggaggtactcttgcgggcggtgatcttcaggctgcggcagacgcggcagcgcttgggcgacagacctctccctaggcgatcttgagctgacacagctgcgcctcccctgcgtctaggtccttcttcagctgcagattctcctgacgtagctccaggatcttcatgttgttctcgaccaacccacggcgcaccatctgatggaagtcgatacgagccacatcgtacgcctccacgatgcgcgctaggtgcatgatggtagcgtcatcctccgagctagcatccctgaaggtggcgtagtcgcgggctcctccgcgacgagggtggtagcggtagggcgagtgctgcaactgatccgggtagcgctggtgaagagtgccgatggtgaggagagcggcgttctggcaagcggcggggaaagaatctccacccggggtgactgccagcgaagtccgctcgggagagccagagaggatcactgcggtgacctcccaaccagcgtggggctctgcatggtcaccctcctgctccggaagcggcctggcctggtagtccactccatgtggataccccaggacaacgcacatgccccgcagctccaagacaaagccagtcatgtccaaaccacgacgggtgattgtggggtcccaaaaggactctaaaatacatcctcaaaattgtgcatagaataattaaaatccatgtgaaagcctccaacaattaaaatgtgcaaatttaaaagtcgaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaaagtcctttttccccctccccctcttgggccggctcggcccacctccctccctctctctcctctcccccgcggcccaatcggcctcctccccgcgcgcgtgccgctgacgggcaggcccgcccgccaccctcgctgacgggtggggcccacccgtcatcccctaccttccgccgcccccgccgcctcgcccgtgccctagcgccgccgccgccgcgaatcccgccgctcccgtccgtcccgcgcgcaatcaagaggggggaaatattccccgtgattccctccctctttcccccccgtttttccctctctctctccctcggattcgttcgaaatctttccccctaaacctcgccggcgcatcattggcggccggatcttccgcggccgattcccccacatccggccgctctctccccctcccaaccctatataaacactccccgtgcctccctccgccgtttccgccactcgccgctctctctccccgtcggaatcgagttcgcaccgtcattctctctctccgccatcgccgccgagctccggtccaccgctgtcgtcgccccgggaccttctcccgcttcgacgttgccttcttcgggttcgccgcaacctcgccgacctcgtccacccctccgtttcgcccgccgaccgtcggaacgccgccgtccccgtcaacccgtgccgcgccgctgccttcctccgttccggtcgccgttcccgtcgtcgccgtcgacccggggtgagccgtggaccgcccatttcgtttcccccttccctcccctctctcggccgccgctccgccgtgcctatggccgccgccagcgaccataggggcgcgggcgcgccacctcccgtcgactgtgccggcgaggccgctttcgggcgcgccccgcggctgccatgtggggcccggccgtcagccgcccgcgtgtcacaccctaaaaattgaaaaaaatataaattgttgtttaaatggaatttctagaatttattttaaaagtcttgaaaagaaaatctaattttaattaataaattccaatataaaatggggccagataaaatttcattaaat

SEQ ID NO: 49582 - DNA, 761 bp, Oryza sativa
gaatgatgctaccacaaggcatttggttgagatgctgtgggccatggatgaaagtcgtgcagagactgtgttagcagctcaagatcgtgaagatcggaatcgtggtaagatttgcaagttagaagacaaggtggatcgtttggagaaggaattagccgcattgaagggagaagcaccacctcagaaggccaggattcgtcttaccgcaaggaagagagctttatttgtccctcgctatcaattggcgccaaaggttcgtgtggtggagaaagaagttgccccagcagatcctccggtcatcatcataagtagtgatgaagaagaagaatccaagcgcaactgttccaagattgagtgggtagcaacccaagatgatgaagacgagccgaacgagccttcaatcgacctccgatgctcggaagaactagagtgacttgttaagccgttgtcttagatcgttgtgttagtttgcttgttttaagtttggttgtgtgtgtgtgggtcttgcatgtgatttacatcagtggtgggatgtaagtacatgtgtttgtttgctttttgagtgttaggaagttggtgagtttagtggtgtgtgagttttcagtttgtaataatgaaacttagttaagatcaataaaagttaaagtaattctctgccctaagtagttttcccccggtttctcttcttgtgccctgtgctatgccagatggtgaacactcgcagcaacgggaatggtcccaacctcaacaaccccaataac

SEQ ID NO: 49583 - DNA, 929 bp, Oryza sativa
atctggatgcgtcggattccgacttcgggatggcctgaagtcgcgttacatccccttcagtgccccacttctcgcagcaagtggcaaacgagatggttctacctccagatagagaacttggaccccgtccttgttattcctgaggaccagccagaaaagatcccagagtggactgctaaacccgccttgactccctccctccaatcctttatcgacatcattgatgatctccgaaaacgggggttgtcgggatatgaagtcgctgccgacttcgtaggtcggcggattcaaccgctacaggcccgtgcccatccggccttcgattactctgggccagatgacgtgacccgggtctctcctcggggtatttatcctcgtatttctaaatttgtttcaagtgcatctgtttcctctaacttatcgagttctcgttctcgatttacaggtctggacagtgacactgtggggcgccgcatcggccagataatgatcagctgtcacgcccagaaattcccgaatagaattccaagcagaatgtgcaataaaatccccgtccaggaccagccagggtacacaaacgacaatgttgacatacagatccacgtcttacaaacatcataaagttttacataaatgcagcggaaggaaagaaagacaacaggagctaagccttgactaaactgcagcgggaacaccactccacaggcatcctcgacggcaaggacgaagcctactcctcggagaacccttcatctggtccgaactcaaactctggggttgggaaaagtagagcaagactgagtactacccactgtactcagcaagtcataccggaatagaggtatgatgcagggaatcatcaaagaaaagctaaagtggttcctttgcataaagcgagcatttataaacagagatttcaagatttaaac

SEQ ID NO: 49584 - DNA, 6535 bp, Oryza sativa
ttataccccagttgagctgcctgtgggagtggagccggagcttcgctagattttattttccgctgcagttttcttcttggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacaccagggctacacctaatcctccacaccatcagcatcattgtagaactcttcctctgatgaatgactgcaaggtgagtatatgacatactcagcaagccacgcagcaaatatgcaagtgcataaggataccaaaggatggcatagtagggtttcatttgcataaacaacatttaataaacatttcagaatttaataaaacagttaagtaataattaaacaatattaatccaacgctatacaacataccctgttatataggcccaaccattctgaacaaccatcccggctgcacagttctatctccaaaccaggaatataccattccaaaccaggagctaatcaaattattaccagttatagcatcttttattgtgatgagaggtgtgagactaatcacgaaagacattgttagacccgcccataaccgcgggcacggctattcgaatagttttactctgaccagaggtgtaccactgtacccacaagacacagccccacatcatgtcaccatgtgcctcaataccaccacggtacctcggaaaggagctgtgacaataccccttgcataacacaatccaccgcagcgcaccattcctggatcataatcacccccttataaacaaggcatggactccccagcgacccccgtgggattatctccgccacttctcagtctggtgctccgcaatgaaccatgctatacaaaaggtaaagccgttgcccacgatggcttgtggttggcacggttaatgtttcacaaccgaaactcgtgaaccggtccttaattgccatgctagctcacaacccaccattatcaagttttagttggcaagtaattaattaaccaatcacgattgaccatcgtgaactagcattaagccatcattaaataatgaatcataagttatcctaatagtgtgctaatgtttctaagcatggctaagcaatcacatctaatatctagtcgaaccaatatatatagcccaactagtcaagttaaaataacccaaggtatcaaggaataaaggaaccaataacaaaaagggctataacaaacaatagtttaattccacccaatgacattcgaaaataaatgcaatagttgaatgaaaacaatagctttaaacgggatcaacatgctcaaagggttgtttgggatctgtgtgacttgccttgctggccttggaactcttcaaattcttctcctgcgaaaacggactctccggaaacgtcagaatctaaacagaaaagagcaaaaacaccaaaacagcacataaacaagcatgaaaagtacatgtggatatttttaacatgtagatctcaattttagaaaaatttagagacttgaaccaactaaatcccgagctaagatgaattagttatgaatttttaaagattaaatcggattaaaacacttatatggattttaattgaattatgacgcaataacgaattatttttgaaaaggaaaaagggtttattgcgtcagcaactagggtttgcggtggaccgggcgcacagcagcggttcacgggaacggacggccgagatcgatcctatccaaaacgaacggccgagatcaagatccacggccgggccatggcagacggccacgatgacgtcagcggcgacgtcatctcctgcggcggctcgggagcacttgctcgccggcgaacgacggcgcgaggacgcgaacggagggcaccagcacatagagaacgtcgcggcgaactcaccgatgaccaaaacgacggcggaagatcaacggacggcggcggcgcgagtaaaaaggcggcggcactcttcggcttgacgacggcgacggtgctccggcggtcttcagcgacggcgaaggggcggacgaggacggcggtgacttggcgaccacgatggcgacctccccgagcgacgacgacgaccggaatggcggcggcgcacggctggagcgtcggcgacgacggcggctcgaggttacacggcgctagggcgcttccgacggcgagagacgaaggcgagggtggcggcgggtagaggagacaccggggatccttttatagcggcaaggaggcggcggcgaaggcccacggcgaccggcgacgcgaaggaaacaacggggtttggaggaaagagaccgatccgattcgaccccgaatccacgaatttccaaatgattttagccggtgattccaaaagagaaaaggtagaggagatctcgggaaacatttcccctcaatcgatttcaccggagaaggaaaggcgcggccgaatttggaaggagacggcggcggcgcggcgctagggtttcgggcggcggccgacgtgaggaagacgacgactccgacaagtgggccccacctgtcagtgaccggacgcgcgcgcgcggcggctgcggactggactgggccgactgggccgagggagagagagagaggtttttgggccgactttcggcccaaagccaatagagacttttaaaaacctttttcaatttaaattattcatgaaatgcaattccatttattaaaaatacttccttagctcaaataaatcccagaaaaatctaggaattatagaataaagcaaagtatttaatgaaattttatctggccccattttatataggaatttattaattaaaattagatcttctcttctaggcttttaaaataaactctaataattccatttttagggtgtgacatcccccgacggcccggtgcccgtagccccaaaccctcgggagggtcccgaggcccccgtgggaggaagagaggctctggcgggtggccccgaggcctataatcccgatatggcccgagatcctgtcacaccctaaaaatcctaaatatataaattgtagtttaattggaattattagaatttattttaaatagcctagaagagaagatctagttttaattaataaattccaatataaaatggggccagataaaatttcattaaatactttgcttaattctataattcctagatttttctgggatttatttgagctaaggaagtatttttaataaatggagttgcatttcatgaataatttaaattgaaaaaggtttttaaaagtcttcttttggctttgggccgaaagtcggcccaaaacccctctctctctctccctcggcccagtcggcccagtccggcagcagccgcccgcccgcgcgtccttttgctgacaggtggggcccacctgtcagtcttcgtcttcctcgcgccgctgccgccgcccgagccctagcgccgcgccgccatcatctccttccaaattcggccgcgcctttccgtttccggtgaaatcaacagaggggaaatgatcttcgggatctcctctaccttttctcttttggaatcgtcggctaaaatcgttcggaaatccgtggattcgatctcgaatcggcttcgtctctctccccgaaccctagaccttccttcgccgttgccggtcgccgtggcctccgacgctacctcctagcccctataaaaggacccccaagcccgccgctacccgccgccaccctcgccttcacctctcgtcgccggtagagccctagcatcgtgtagcctagcgccgccgtcgccgccgcagctccatccgtgcgccgccgtcgctccagtcgtcgtcgctgctcggggaggtcgccttcgtggtcaccaagccgtcaccgatctcgtccacccctccgccgtcgccgtaggtcgccggagcaccgccgtcgtcgttaagccgaaggttgccgccgcttcttcctcgacgccgttgatcttccgccgttgttttggtcaccggtaagttcgccgcattgccatctacgagttggtgtcctccgttcgcgtcgtcgcaccgtcgttcgccggcgagcttgccgcccgagccgccgccggtgatgacgtcatcgccgacgtcatcgttgtcgtccgtcgtagaccggtcgtagaccgttagatcttggccgttcgttgtggataggatcgatctcggccgttcgtttccgtgagctgccgccgtgcaccaggtccaccgtgaaccctagccgctgacgcaataattcccttttccttttcaaaaataattcattattgcatcataattcaattaaaatccatataagtgttttaatccgatttaatctttaaaaattcataactaattcatcttagctcggatttagttggttcaagtctctaaatttttctaaaattgagatctacatgttaaaaatatccacatatactgttcatgcttgtttatgttctgttttggggtttttgctcttttctgtttaggttccgacgttttcggagagtctgagtttgtaggagaagattttgaagagttccaaggccaccacggcacggcacacagatcccaaacaaccctttgagcatgttgatcccgtttaaagctattgtttctattcaactactgcatttattttcaaatgtcattgggtggaattaacctattgtttgttatagcccttttgttcttgattactttattccttgataccttgggttattataacttgactagttgggctatatatagtggttcagctagatattagatatgattgcttagccatgcttagaaacattagcacactattgggataacttgtgactcactattacttaatgatggcttaatgatagttcacaatggtcaatcgtgattggttaattaattacttgccaactaaaacttgataatggtgggttgtgagcacatggttttgagagttgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaacggtgcactgtggtggattgtgttgtgcaaggggtactgtcacagctcctttccgaggtaccgtggtggtattgaggcacatggtgacatgttgtggggctatgtcttgtgggtacagtggtacacctctggccagagtaaaactattcgaatagccgtgcccgcggttatgggcgggtctaacaatgtctttcgtgattagtttcacacttctcatcataataaaagatactataactggtaataatttgattagctcctggtttggaatggtatattcctggtgtggagatagaactgtgcagccaggatggttgttcagaatggttgggcctatgcaacagggtatgttgtatagcgttggattaatgttgtttaattattacctaactgttttattaaattctgaaatgtttcataaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttttccactgcttggatctttattgattgagaggaactatctacctctgtaatgacattttattcgcttattaattagagtgataattgtactctattatcaatttgttattgtgtgcctcggctgattcctggacgagggttcacacacacgtaagcgtttggaattttggatagaaattccgggcgtgacagatcccccccgaggcccctgagtacgggcgccctaggccagctgcctctgacaacaaggaccggccccaccgaaaagtgcagcgacccgtctactttgtcagcgaggtactccgagacgcgaaaacccgatacccacaggcccagaagatgctttacgcagtcttaatggcctcgaggaaattgcgccactacttccaagcgcatcgggtttttgtcatgacgtcttaccctctcggccaaatcttgcacaatcaagagggtaccggtcgggtcgtaaagtgggccatcgagctcgctgagttcgacctacacttcgaaccacgacacgcgatcaaaagccaggttctggctgacttcatcgcggagtggaccccggtggacgaccatgttccgtccaatgttcccttcctccccggagacggaggaaacccaaacgccgacattcgcgccgggcactgggttatgcacttcgatggctccctcaaccttcaaggtgca

SEQ ID NO: 49585 - DNA, 4429 bp, Oryza sativa
gaagcagcaagacagagagagactagacagttttcacaaataacaaaggatttttatttttgagaatagtgctaaggcttgggatctatggctcgtcctagggtcaaaggtggctctgataccaacttgtcacgaccggaaataacccaacgggcgttcctgacgtgcgtgcattaatccttgtcccaggaggcaaggtacaccaaaagttgatacaatttagagtttaacaagtggaagcgtaaatagttaacttattacatgggcagcgaaggcccagcacacacaaagacaaacgggaaacagcggaagactagggtgacgaccacaggcgcttgacggcaggcacgagctagacaccaaagccttcatcttccaggggctcctcttctggggttgggaaaaattgagcaagactgagtacaaccaccgtactcaacaagacacacccacaagtgcggaataaatgcaagggagtaaaaaggggtcatactataaagggttagggttgcagtaaacagcatttcaagagatttagtgtctcaaagctattttgtaaacacgattctagaactatacaatattattcatcaaggccgtgaacccacacgaacctgccttaacccaaggcctaagatgattcagaccgaactggcaacccgaccctgggtcccagctcgtcccaagccaacccaggccaacccttccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaataaccagaccattccaaagtatccaggtgatatgaatatttcccaaagtctatagttgaaaaaccacctaatgttacctaattaaattgcgaagcatctacctaaaattaaactagtggtgccatgagtagagtgtccactagttgaggttttgtttattctagggtgaacaaggtaataataacaataacaataataataaggtcataacaaaggtaaataggcatggctagataaaacagtgataacgcgtgaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcacaaaaatgggtttttggcttcataaggaaaaattagagacttgaacggtccaattccgagttcaaatggccaagttatggctatttgaagtttatatgctctttaaatggatatttgcgaatttcttcatttaaattttaattaaaaatcggatttattgcgtcagccgggagagagggcgcgcggaccgggtccacgggagtggggcccacgcggcagcctcacggtccacggtggaccgggtgcacgcggcttgcgccggccggcgccgtgggtcccatgcgtcagccgcacccgagggagcgggcggctgacggccgggccccacctagcagccgcggccgaccggagctcggcggcgacggcggagagagaggacgacggcgcgggctcgattccgacggggagagaaagcggcgagtggcggaaacggaggagggaggcacggggagcgtttaaatagcgttgggagtgagagagggcggccggaggggaaggaaaccggcgcggcgatctcgggctccattgatgcgccggcgaagttcgcgggagtaaatccgaacgaatccgagggtgtgagagagagggaaaagtgggggaaagagggagggaatcacggggagtgatttccccctctttatggcgcgcggggacggcgggatgcggcggattcggcggcggcggcggcgctagggcacgggcgggcagcgggtgtggcgcgaggtaggggatgacgggtgggccccacccgtcagcgagggtggcgggcgggcccgcccctcagcggcgcgcgcgcgggggaagagccgatgggccgcgggggagaggagagagagggtgagaactgggccgagccggcccaagaagggaagggggaaaaagaagactttttagggtttttctttttataaaacctttttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatggattttaattattctcggcataatttcgaggatgtattttagagtcgttttgggacgcgacaaacctaccccccttaaacggaatctcgaccccgagattcggaagaactggcgaagagatcggggtgggctgccttcagctcgtcttcacgcttccaggtagcttcttcttcggcgtggttgttccactggaccttgcaaaaacggattacccggttcctggtcctgcgctccatggtgtccaggattttcactggcctctccacataggtcaaatcttcgcgaacttcaatttgctctgagtcggcctgctcggatggcactcgaagacatttcttgagttgcgacacatggaacacatcatgcacgttgcccaaggaggcgggcagctccagctggtaagcgactcctccgcgccgagcaatgatacggaaaggacccacataccgaggtgcgagcttcccctttgtctgaaacctgtgtacacctcgcaatggcgtgacccgaagatacacaaagtcatccactgcgaattccagatcacggcgtcggttatccgcataacttttctgccgagactgggccacctttagattatcccgaatggttctgactttagcttcagcttctctcaggatatcagtcccgaacacttggctttctccaacttggtcccacaatagtggtgtccggcatttgcgcccgtacaacgcttcataaggtgccatttgtatgctggcttgataactgttattgtaggagaactcggcataggggagactcttatcccaggtcttcccgaaatctaagacacatgcgcgaagcatatcttttaggatctgatttagacgctcggtctgtccatctgtctgcgggtgatacgcggtgctgaaatttaatcgggttcccaactcttcttggagcttcttccaaaagtgagaggtgaattggcttcccctatcagatacgattttcttgggaacgccatggagactcacgatcctagcgaagtagagctcggctagtttgttccctccataggtggtctttacaggaataaatcgagctaccttggttaatcgatccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccattatttctccttcaagtctaagtacatctttgtactgcccgggtgaatggaataagggctctcgtgagcttcctgaagtatcagctgtttaagttctctgttatctggaacgcatacccgatttccgttccatagggttccgtgttcatcctctgtgaaaccagcggctttaccctgtttcatattcttgaggagtccatgcatgtccgggtcgttcttctgagcctcgcggatttgatcgagcaaggtgggcttggcttccagcg

SEQ ID NO: 49586 - DNA, 1610 bp, Oryza sativa
gcctcacgccccgagccgccgcgccgccatcccgccgccccgcgcgcccacgcgccccgtcaccgctcgtcccgtcgccgtgcgcgttccatcgccgcctcgagcccgtgccacagtcgccgtcaccatcccatcaccgcgcgccgagcctcgcgccgccatcacgtcggcgcccgtcgcgtcaccgtcgtcgcatcaccgccctgagcccccgcgccgccgtcgtgtcaggccggccaccccttcccctctctttcttccccctctcccctataaatactccacaccccctctccatttcccccactccatctccctctttctcccctcttccctctccaccgagccaccgccttggtgccgccgcgccgccaccctcgcgccgctgcaccgccgccttcgtgccaccgcgccgtgcgccgtcatcgcaccgcccacgcaccgccgcaccgccgccttcgtgccgccgcgccgtgcgctgtcgtagcgccgtcgtcaccgccgccgccgtcgtcggtaagccgccgcctcctccccttgctcggtcgccgtcgccaaagagccgagagagagaggagggagaagaagccgggagggagagaaagagagaaaagaagaaagaaaggaaaaaggagagaaagaaagaaaagaaaaacggagagaaaagaaaggagggaaatgaaaagaaagaaaagaggagagaaaaagaaaagaaaaaataaataaataaatagaaattagagggagattagggaagtgagaaaatttaaaataattagaatttaattatagatcaattatagtcgtagaattgcaaaaatttaatataattatagattattttggtaatctctataggtgatcaattcattcacggtaggtactcggatttaattaataggaattttagacgtatattatatttaatcgtttagtcatagactaaattaaatcgtataatattataagataatttttggattccggccgatatttagctcgcgatagaaatttctaacaaattatatgaatataatactcgggtagattaaattaaaaactcatgataacaaaatatttatacccgcaaaaatagtttaggatgtataaatcgaaattgggtttgccctagttcgcgaatagtaaagttaatataaaagaatcgactttcgcattcgacttccatttggatttatttggatttttatttgaattctaaccgaattcaaatcaattttcacacgtaactatagagcccgagggagttgcggatccaagtgaaggccaagacacgcaagactttgagcaaggcaagtcatcactattcctttaacttgttgatcccaattgcgaaattattttgtttgcaaataaaattgcatgcaatgataaacatcctacttgtgattatgctatgccttgattattgtttacccttaaaatccttgtaaccatgtttacgtatgagtccctagtcaattatgacaattgcttagaaatgctattctagaatcatgcatattcatatttatcaaatgctaaatgtttgggcaattacctttgggaaggtaattgagatgcggcatgtggagacatgagcgccacattgc

SEQ ID NO: 49587 - DNA, 1005 bp, Oryza sativa
taccctaggaaaacttctatgcagtgggaaattatatttttagtttatcagtcgttaggtggacagtggttaatgttctacgtgagcaactcttttactatgtgggatctatactattatccttagttcattttgtattctcaccgataaaatatgagtattcagttattcactgaaattctggaaatacctttaaaggtttcctcctgtgtttggaaaagaaagcagcagacgttcatgtcatcagtgttgaaaaaaatataaattatttaaaaatgattacattgcttgaagaagattaagggtaaggcctgttgtgtactgaaattacagacttaaagagtgaaatgcggctctgctgactgtatttgtttaatttacatggctgcagaatgtgctgtgagcactccaactgagctgtgaccatgtatctgaggcagctgtgattcaactttgctatattaatatgtatatagttatatagttttgtgtttggccaatgtgtcctatttcacttctggactggatgcgttctgcatcacccatgtatatatagtattgtttaggcccatattatctgtcagtgacacaaccaagaagtacgtatagaaactgactagtcaattgtccatgtcctgattttcagtcttagtttctacatacccaatgcaacacagaattagatgaactgtttgtactatgctactatagtactatgccatgcctattaaacaacgataatgtgattactgaaaaacgaatagtctatctaggatatgttactgcactatttattcgctccacatttatttcatgatttttacactagattcattttttttaacttagagagctttctttaagtgcatgacaaagcttgctttcagggtcctgtttctggttttcggggtatattgagaacattcatttcagcatttgtggcttcatatgagatctcttatcaggtaaattgtggttcttcatagtgtgcatttaaattgaatt

SEQ ID NO: 49588 - DNA, 4774 bp, Oryza sativa
tgagttgcgacacatggaacacatcatgcacgttgcccaaagaggcgggcagctccagctggtaagcgacttctccgcgccgagcaatgatacggaaaggacccacgaaccgaggtgcgagcttcccttttgtctgaaacctgtgtacacctcgcaatggcgtgacccgaagatacacaaagtcatccattgcgaattccaggtcacggcgacggttatatgcataacttttctgccgggactgtgccaccttaagattatcccgaatggttctgaccttcgcttcagcttctctcaagatatcagtcccgaacacttggctttccccaacttggtcccacaagagcggtgtccggcatttgcgcccatacaacgcttcataaggtgccatttgtatactggcttggtagctgttattgtaggagaactcggcgtaggggagactcttatcccaggtcttcccgaaatctaggacacatgcgcgaagcatatcttctaggatctgatttagacactcggtctgtccatccgtctgcgggtgatatgcggtgctgaaatttaatcgggtacccagctcttcttggagcttcttccaaaagtgagaggtgaattggcttccccaatcagatacgattttcttgggaacgccatggagactcacgatcctagcgaagtagagctcggctaatttgttccctccataggtggtcttcacaggaataaatcgagctaccttggttaaccgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactgacccaccagtatttctccttcaagtctaagtacatcttcgtactgccagggtggatggaataaggactttcgtgggcttcctgaagtatcagctgtttaagttctctgttatctggaacgcatacccgatttccgttccatagggttccatgttcatcctctgtgaaaccagcggctttaccctgtttcatattcttgaggagtccatgcatgtccggatcattcttctgagcctcgcggatttgatcgagcaaggtgggcttggcttccaacgcagccaagaatccacggccaactatgcttaggttcagggcttccatctgttgattaagttcgggtgggatgccacggacgttaagagtgttgcaatggctttttcggcttagagcgtcggcgaccacgttggccttaccaggatgatagtgaattcccacatcataatccttgatgagttctagccatctcctttgccgaagattcagatccgactgggtgaagatgtatttcaaactcttatgatcagtatatatttcacagcgattcccaatgagatagtgccgccagatttttagagcatgcaccaccgcggctaattccaagtcatgggtagggtagttgccttcatgaggccgtagctggcgtgaggcataggccaccacatgaccgtcctgcatgagcacgcaccccaatccttggcgcgaagcgtcacaatacaccataaaatccttgcgagtatctggcaagattaacactggcgaggaacccagcttttctttgagagttttgaacgccttctcgcattgcgggttccacacaaatttctcttctttcttcaacaactgtgtcatggggagagcgattttggataagttctcgataaacctccggtagtatcctgccaaacctaagaaactgcggacttgagtgactgtcttgggttgcttccaatcggtgacggcggtcactgtttcggggtccacagcaactcctttagcagatatcacgtgccctaagaatttgacttcggacaaccagaactcacacttgctaagtttggcatacaattgatggtcccgcaactttcccaacaccagacggagatggtgccgatggtcttcctcggattgtgagtatatcaaaatgtcatcaatgaaaaccacaacaaacttatccaagtattccatgaacactttgttcattaagttcatgaagaaggcaggtgcattggttaaaccaaacgacatcaccgtgaattcatacagtccgtatcgtgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctccacaaaaatcacaggagcaccccagggggaagtactcggacgtatatacccctttcctttcaactcttccaattgtttctttacttcagccagttcatttgctgccatacggtagggtcgcttgtacagaggagtggttcctggagcaagatctatccggaactcaatctctcgcttgggcggcataccaggtagttcttccggaaatacgtctccgaactctctgactatggggatttctgacagccctatctgatgcagttctgaacttctgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaatccctgaatttctatagggacggcaggactaaaatactttgctgtcataacccctccaggggtggtgatgagcagagggttcctaagcctttctacccccaactgatttctccccacgaatggcacagatataaacgagtgggaggctccagagtcgaacaaaatggtagcagggatggaatgaatgaggaacgtaccaacgatgacgtctggagttgtcagcacgttctcggccgtcacgtggttcacacgaccccgaatgacatcgttaccaccattgttggagcggggaggcgctttgccttgctggcgcctcggctttgggcatttatccgcaaagtgcccgggctcgtagcagttgaagcacagacgctgcggaccttgagcgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccaccagacgttggaaatccggatagtccccggagactagacggacggacagttcagggtccattcctgccaagaacttctcttgcttctcctcatcttcccgcacatcctccggggcataacgggccaggttgttgaactcatgcaaatactccatcacagagcggttgccttgcttcaactctcggaattcccttttcttaagggccacgactccggcgggtacatggattctccggaaagcggcggtgaagcgagcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaaccaatccaacgcatccacggggttgttggaactagagaaggtgggtggacggatgcggaggaactcggcgagtttagagtgttggggaggtggtggtggagcattatgttgtggcggattttggaggtggtggaggaaagcagtcatcatgttggcctgctgggcgaggatttgggtgagaatagcgttggtatctggtggtggtggtggaggcggaggaggaggtgggggtgggctgccatggttgttgtggttgctgccctcaggttggttgccatcaccggtattagcacttctcctggtcatcaccatctgaaaaccccacacagaaccagcaaacagagagagagctgacaattaaagctaaccacccacgactaccttaattcttaaatttattactgctattaaattggttcattaaagttcaaattgcttagacaaataaaataaagacaggctccgacacagttatgccatacaccggcataaccatgccccacacaactccaacaagaagacaaacgagaaagaacacacgcgcaagcctactaactgctcgtctatcgctgcgacgggccaggacggaaggtgagcaacagcgcatcctccgtgctaccaacgccggaggcttccccctcctggggaaccacgggcgcgggctcggcacgaggggtctccacgaagcaggtccacgccagggactgacgaacaagctcgggcctggaggtgctcttgcgggcggtgatcttctggctgcggcagaccccgcggcgcttgggaccaccgacctcaccctgggcgaccttaagctgacacagctgcgcct

SEQ ID NO: 49589 - DNA, 23168 bp, Oryza sativa
gaccattcctgttgctgcgagtgttcaccatctggcatggatagggcacaagaagagaaaccgggggaaaactacttaggacagagaattactttaacttttattgatcttaactgagtttcattattacaaactgaagactctcacaccactaaactcaccaacttcctaacactcaaaaagcaaacaaacgcatgtacttatatcccaccactgatgtaaatcacatgcaagacccacacacacacaagcaagcttaaaagaagcaaactaacacaacgatctaagacaacgacttaacaagctactcttgttcttccgagcatcgaaggtcgattgaaggctcgttcggctcgtcttcatcatcttgagttgctacccactcaatcttggaatggttgcgcttggattcttcttcttcatcactacttatgatgatgatcggaggatctgctggggcaacttctttctccaccacacggacctttggcgccaattgatagcgagggacaaatagagctctcttccttgcggtaagacgaatcctggccttctgcggcggtgcttctcccttcaatgcggctagttccttctccaaacgatccaccttgtcttctagctcgcaaatcttaccacgattccgatcttcacgatcttgagctgctaacacagtctccgcacgactttcatccatagcccatagcatctcaaccaaatgtcttgtggtagcatcattctcaattccttcagtctcaaggtaactgccacggtcacttccctgcggttgacgaggatggtaacgatactcagtgtcggccaactgatcactgtagcgatcacggagctctcctatggcgatccttgccacttcctgacatgcatggatgtagttccttcctccagcttcgaacatcactgatgggatatcttcactgttactgttcaaggtaactttgactcggcacttctcttcatgacgatcatgacgaatctaggcataaaaaggggcagtcccaaatccaatgacaaaggacatagtacgcaactcctggacaaaaccctcaacaccaaacaagtactcaggcttgtagcgcggcatctaaagacaagtgaaaggagggagttaaaacatttatccaattaatagcacaagtttttggattaattttgaataaagtttgaaaatcaaagcaaaaggtaagtaaataaagtaaaccaaacttgcaagatgagttgaaatagttgaaaatgaggtcacaagttttgtacttttgaataacaagtttcaaaagaaataaaagaaagttataaaatcaacttgctaaatttattttattgcagtaagattaaatgaaacatcattgtaaaacttttgctggaaaatgagccattagtacagtaatagatgtacagtactaataacactggaataaattttgaatgagaaccattaaaagagattatgaagtgcatgtgccattagtttggtttaattaaaagagaaagagaggagaacagttctacttttccaatatttttagaaggcttctatgggtaaccatttggcataacctagggtcaaaggggctctgataccaacttgtcacgcctggaatttctatccaaaattccaaacgcttacatgtgtgtgaaccctcgtccaggaatcagccgaggcacacaataacaaattgataatagagtacagttattactctaattattaagcgtataaaatgtcattacggaggtagatagttcctctcaatcaataaagatctaagcagcagaaaataaaataaacggcgcagacggctccactccacaggcagcttgaccaaggctacacctaatcctccactccatcagcctcaatgaagaactcttcttctgatgaatgattgcaaggagagtatatgacatactcagcaagccacgcagcaaatatgcaagtgcacaggataacaaaggagggcataatagggtttcatttgcaaaggcagcatttagcaaacatttgagaatttaataaaacagttaagtaattaaacaatattaatccaacgctatacaacataccctgttgcataggcccaaccattctgaacaaccatcccggctgcacagttctatctccaaaccaggaatataccattccaaaccaggagctaatcaaattattaccaatttaagcatctcttactaaggtgagaagtgtgaaactaatcacgaaagacattgttcgacccgcccataaccgcgggcacggctattcgaatagttttactctgatcagagctgtaccactgtacccacaagacacaaccccacatcatgtcaccatgtgcctcaataccaccacggtacctcggaaaggagttatgacaatacccctcatacaacacaatccactgcagcgcaccttcctggatcataatcacccccttataaacaaggcatggactccccagcgacccccgtgggcttatctccgccacttctcagtctagtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcattaagccatcatgaaataatagtgaatcataagttatcccaatagtgagctaatgtttctaagcagggctaagcaattatatctaatatctagttgaaccaataaataaagctcaactagtcaagttataataacccaaggtatcaaggaataaagtaatcaagaacaaaagggctataacaaacaataggttaaatccacccaatgacattcgaaaataaatgcaatatttgaatagaaacaatagctttaaataggatcaatatgctcaaagggttgtttgggatctgtgtgacttgccttgctggccttggaactcttcaaactcttctccggcgaaaacggactctccggaaacgacggaatctaagcaaaaagaagcaaaatcaccaaaacagcacataaacaagcatgaacagtacatgtggatatttttaatgtgtagatctcaattttagaaaaatttagagacttgaaccaactaaattggagctaagatgaattagttatgaatttttaaagattaaatcagattaaaacacttaaatcggtttaaattgaattatgacgcaataatgaattatttttgaaaagaaaaaggggatttattgcgtcagcgggctagggtttcggtggaccgggcgcacgggcggcggttcacgcgaacggacggccgagattcgatccaatccaaacggacggccgagatcgatcgggtccacggcggttcacggcggacgaccttgatgacgtcagcaatgacgtcaccgacggcggcggcggcttggcggagcggacggctcgggcggcgcacgctcgccggcgaacggcggcgctaggacacaaacgaagggcaccaacgggtagcggacggcacggcgaactcaccgacgaccaaaacgacggcggagaagcaacggacggcgccggcgacgaagaggaaacggcggagttcttcggcttgacgacggcgacgatgctccggcggtctccgacgatggcgaagcggcggacgaggacggcgacgacttggcgaccacgatgacgtccttcccgagcgacggcgacggctgaatcgacggcggcacacggctggagcggcggcggcggcggcggcgcaaggttgcacggcgctagagcgactccgacgacgagaggcgaaggcgagggtggcggcgggtagaggagacaccggggaggcttttaaaggggctcggaggcgaaggcgaaggcccacggctgccggcgacgaggaaggaaagctcgggcttgaaggaaagaggccgatccgaattgaactcgattccacgaacttccaaaacgaattagctgatgattccaaaggagaaaaggtagaggagatcccggagagtgtttcccctctattgatttggccggaaacggaaaggggcggccggattggaaggaaacagcggcggcggctcggtggcggcgcgctagggtttcggcccgaggaagacgatgggcctgacaggtgggacccacctgtcagcgtccaaacgcgcgcgcgcgcgggcggctgcggactgggccgacttgggccggggagagagagagaaggttttgggccgactttcagcccaaagccaaaagaagactttttaaaacctttttcaatttaaattatttcttaaatgcaattccatttattaaaaatactttcttagctcaattaaaccccggaaaaatctaggaattataaaattaagcaaagtatttaatgaaattttatctggccccattttatattggaatttattaattaaaattatattttcttttcaagacttttaaaataaattctagaaattccatttaaacaacaatttatatttttttgaatttttagggtgtgacaaacctaccccccttaaacagaatctcgtcctcgagattcggaagaactggcgaacagatacggatgagctgacttcaattcatcttctcgttcccaagttgactcttcttccgagtgattactccactggactttgcaaaaacggataactcgattcctggtttttctctcatttgtttccaagatacggattggtttctccacataggtcagatcctcttggacttctatctgttcaagattagcttcttcggtaggtacccttaaacactttttcaattgcgacacatggaacacattatggactcctgccaaagattgaggtaactctaactgataagcaacctctcctcttctactgacaatcttataaggtcccacaaaacgcagtgccaattttcctttggtatgaaaacgatgaactccccgtagaggcgtgacacgaagatacacataatctccttcttcaaaactcaaatctctgcggcgattgtcggcataactcttatgacgagactgagccacacgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgaagactagcttgataactgttgttgtatgaaaattctgcataaggtagattcttatcccaacttccaccgaagtctaaagcacaagctctcaacatgtcttccaaaatctgattcaccctttcggtttgtccgtctgtctgcggatgataagcagtactaaagttcagcttagaacccatctcttcctgaagtttcttccaaaaatttgaagtaaactgactgcctcgatcggacactattttcttagggacgccatgcaaacacacaatccttgccatatacaattccgccaaccgactcccggaatatgttgtctttactgggatgaaatgagccactttggtaagtctgtcgactatcacccaaatagagtcatggcccgatgatgttctgggtaaaccagtgataaaatccataccgatttcttcccatttccattcaggaatcttcaaaggctgcaacaaaccggcgggtttctgatgttctgccttgactcgctgacaaacatcacatactgctacatattctgcgatttcacgcttcatacatgcccaccaaaatctttccttgagatcctggtacatcttggtactaccagggtgaatggagtataaagtatcatgagcttctttcagaattgcatcttttaaatctttgttgttggggacgcagattctctcacccaaccatacagttccttgctcatcttccaagaaaccaatagcttttcctcttctcatattcttcttgatttcttgaatatcatgatcattaatttgggcttctctaacttgatcaattagagtgggcttcgcttctaaggctgcaacgaaacctctactgacaattcccaaatttaatctttcaaattccttgcataattccaatggcaactgtcgtccttccgtagcattgcaatagcctttcctgctaagagcgtctgctacaacattagcctttcctgagtgataatgaattcccatgtcataattcctaattaattccaaccatctcctttgtctcatgttcacatccggctgagtaaagatatactttaaactcttgtgatcggtgtacacctctgtacgagtaccgaaaagataatgaccccaaatcttcaacgcatgaactactgcagctaactcaagttcatgagtagggtagttcttctcatgcggacgtaactgacgagatgcataggcaaccaccttcccatcttgcatcagaacacaacctaacccaagtttggatgcatcgcaatacacttgaaaacccttctttggatcaggtaaaatcaaaataggagctgatatcaagcgattcttcaactcttgaaaactctgctcacattcttccgaccacttgtacttcacatctttctgaagcagtcgtgtcatgggcttagcaatcttggaaaaattttctataaacctccgataataacctgcgaggcctaggaaactgcgaatctctgaaactgtctttggttgtttccagttggttatggattccacattactaggatcgacggcaactcctccggctgagatgacgtgaccaaggaacttcacttcagacaaccaaaattcacacttgctaaacttagcatacagttgatgttctcgtagcttctctagtgcaaggcgaagatgttcttcatgttcttctttggttcgggagtagataagaatatcatcaataaagaccaccacgaacttgtctagatattccataaacaccatattcatcaagttcatgaagaaagcaggagcattggtaagtccaaaagacataacagtacattcgaacaacccatacctagtggtaaaagctgtcttaggtatatcttcctctttgattctcaactgatgataccctgatcgaagatctatcttggagaaaacggtggcacctttaagctgatcaaacaaatcatcaattctgggtagcggatacttattcttgataatcacatcatttagggcacgatagtccacacacatcctctgggtatggtctttcttttccacaaaaataaccggagctccccatggagatgaactcggtctgatgtatcctttctgaagcaaatcgtctacttgccttttgacttctgccaactcattggctggcattctataaggtctcttatggatcggagttgttcccggtaccaaatctattctgaactctatatcccttttaggcggcataccaggtaaatcatcggggaacacatcgggatactcccggactataggaatctcttccaaagttatttggttcagtcttgaccttaaagactcagaagacaatgcatgaacagttacaactcgaccatcattgctggtgagaattacttttctgttagcacagtctatcacacctttatatctggctaaccagtccatccctaggatgacatcaaggtctttggattctaacaggataagattggccagaaatggtacttcttgaatttctattctgacagaggtttcgttgcagccttagaagcgaagcccactctaattgatcaagttagagaagcccaaattaatgatcatgatattcaagaaattaagaagaatatgagaagaggaaaagctattggtttcttggaggatgagcacggaactgtatggttgggtgagagaatctgtgtccccgacaacaaagatttaaaagatgcaattctgaaagaagctcatgatactttatactccattcaccctggtagtactaagatgtaccaggatctcaaggaaaggttttggtgggcaagtatgaagcgtgaaattgcagaatacgtagcagtatgtgatgtttgtcagcgagtcaaggcagaacatcagaaacccgccggtttgttgcagcctttgaagattcctgaatggaaatgggaagaaatcggtatggattttatcactggtttgcccaaaacgtcattaggccatgactctatttgggtgatagtcgacagacttaccaaagtggcacatttcattccggtaaaaacaacctattccggaagtcgcttagcagaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaactgaaagggtgaatcagattttggaagacatgttgagagcttgtgctttagatttcggtggaagttgggataagaatctaccttatgcagaattttcatacaacaacagttatcaagctagtcttcagatggctccgtacgaagcactgtatggtcggaagtgccgcactccgcttttgtgggatcaagcgggagaacgtcaggttttcgggacggatatcctaagggaagcagaagaaaaggtgaaaatcattcaagaaagattgcgagtggcccagtctcgtcataagagttatgccgataatcgccgcagagatttgagttttgaagaaggagattatgtgtatcttcgtgtcacgcctcttcgaggagttcatcattttcacaccaacggaaaattggcaccgcgttttgtaggaccttataagattgtcagtcgaagaggagaggttgcttatcagttggagttacctcaatctttggcaggagtccataatgtgttccatgtgtcgcaactgaaaaagtgtttaagggtacctaccgaagaagctaatcatgaacagatagaagttcaagaggatctgacctatgttgagaaaccaatccgtattttggaaatagatgagagaagaaccagaaatcgagttatctgcttttgcaaagtccaatggagtaatcactcggaagaagaatcaacttgggaacgagaagatgaattgaagtcagctcatccgcatttgttcgccagttcttccgaatctcgaggacgagattctgtttaaggggggtaggtttgtcacaccctgaaaattcaaaatatataaattgttgtttaaatggaatttttagaatttattttaaaagcctagaagagaagatttaattttaattaataaattccaatataaaatggggccaaataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtggcccaagtcctttctctctctcctcggcccagtccggcccagtccgccgccgcgcgcgcgcgtccgcccgctgacaggtggggcccacctgtcagggtcgtcgtcaacctccggccgccgccgcccgaaaccctagtttcgcgccgccgctgttcccttccaaatccggccgttcctttccttcttcggccgaatcaaaagaggggaaatgatcctcgagatctcctctaccttttctcctttggaaacatcggctaattcgttttggaagttcgtggaatcgagttcgattcggatcggcctctttccttcgaaccctaaaccttccttctcgtcgccagctgccgtgggccttcgccgtcgcctccgagcccctttaaaaggttccccggtgtctcctctacccgtcgccgccttcgccttcgcctctcgtcgtcggaaacgccctagcgccgtgtgccctagcgtcgccgtcgccgccgtcgctccagccgtgcgcccccgccgttccagtcattgtcgtcgctcgggaagaccgccgtcggggtcgccaagtcgtcgccgtcctcgtccgccgcttcgccaccgccaaagaccaccagagcaccgtcgccgtcgtcaagccgaagagcgccgccgtttcaacctcgtcgccgtcgccgtccgttggtcttccgccgtcgctttggtcgccggtgagatcgccgtgctgtccgctacccgttggtgccctccgttcgtgctgaagcaccgccgttcgccggcgagcgtgcgccgtccgagccgtccgagccgccgccgccggtggtgacgtcatcgccgaggtcatcggggccgttcgctgtgagccggtcgtggaccgttcgatctcggccgtccgttttagatcaagtcgatctcggccgtccgttcgcgtgaaccgccgccgtgcgcccggtccaccgaaaccctagcccgctgacgcaataatccttcttttccttttcaaaaataattcattattgcgtcataattcaattaaaatcttcaaaaattcataagtaattcatcttagctccgatttagttggttcaagtctctaaatttttctaaaattgagatctacatgctaaaaatatccacatgtactgttcatgtttgtttatgtgctgttttggtgattttgcttctttctgtttagattccgtcgtttacggagagtccgtttttgcagaagaagaatttgaagagttccaaggccagcaaggcaagccaaacagatcccaaacaaccctttgagcatgttgatcccgtttaaagctactgtttcttttcaactattgcatttattttcgaatgtcattgggtggaattaacctattgtttgttatagcccttttgttcttgattactttattccttgataccttgggttattataatttgactagttgagctttatttatattggttcaactagatattagatataattgcttagccctgcttagaaacattagctcacttttgggataacttatgaatcactattacttaatgatggcttaataatagttcacgatggtcaatcgtgattggttaattaattaatgtgccaactaaaacctgataatggtgggttgtgagcacatggttttgatggtcgtgctcatgacaattaaggaccggttcatgagtttcggttgtgaaacattaaccgtgccagccacaagccagcatgggcaacggctttaccttttgtatagcatggttcattgcggggcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtccttcgtgattagtctcacacttctcaccatagtaaatgatgctataattggtaataatctgattagctcctggtttggaatggtatattcctggtttggagatagaactgtgcagccgggatggttgttcagaatggttgggcctatgcaaccgggtatgttgtatagcgttggattaacattgtctaatacttaactgttttattaaattctgaaatgtttgctaaatgctgcttctgcaaatgaaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccttggtcaagctgcctgtggagtggagcggtctgcgccgtttattttattttccgctgcttagatctttattgattgagaggaactatctacctctgtaatgacattttattcgcttattaattagagtaataattgtactctattatcaatttgttattgtgtgcctcggctgattcctggatgagggttcacacacatgtaagcgtttggaattttggatagaaattccgggcgtgacagcacgcctcctctcgaagccgcagctcctccgcgcgacgagccaccaaagcctctgcggctattgacagaaaacacgaggcctgggagatctgcttaactccagtgcaggtccaaaactcgccttcggatgtgtgagcgtgccagttgatttgatcctgcaatcaacaagaaacaaagacaaagaaaccgaaattaaatccataaatgatagccgatcggctaaatgccgatgacgtatcatttatctttgagccgatgtcatatgtaaatcgatcggcaagtgttaagtaaacaaatcagaactaaatctactcgatcggctgtagacatcaataatatataatccttatatcgatatatacttgaatcaagtgattgggatagatcggtcaccttgccgagacagtataaatcacttaaatcgaaatatatattattaatgagattatatatatatatattcatagcatagccgatgaaatagatctagcatgtatcggctaataccccgataccacttcgtattaagatattaaagcaagtagaatataccaaacagaagcctaatatacttaaatgcaacaagatcttaacataaagggcagatctaacatgtcaaacgatcatataggataaaagcagttagatcaggtaagatcggctgaaactccgatactaccctaatcggcaaccagtaggcaggctagatattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcaagaacacaaaccgccataacaagttttacctcttgttgaagatcgaaaccgatgcagctcaacccgaaagcaagaactcgttgaaataaaactaaagcaaaaagggtggcgatgcgccgaaattgtattgaacgtgtgtgttatccattacatagggctcggggcctatttatacccgagaattataagatatgtccatattggacacgactcttatccctaacaaactctaagataccataagtttttgcggcagacttttgcccacatttatctctaaggaatttacataaaatatcctaattaatagatacaattgccttcccaggactctatccatgcgtggcaatcatcttgaagcacatcaattcgaacccgatgtcgtacacaagtcatattatcggaatcggctgtatcacttaacacagtctgactcagacttagccgatctcaatcgtagccgatccggactccagctgattcttactctgtttccgcaacaacccttatcttcgattccgcttcgatccattttcatctcccatgctgatattaccaaatttggtcgttaacacatgccccccaagtccgggatatttgataatgttccggatttgccgtgtatcgactccgagcaagtttcgcactctaccgttttcccaaccgttactctagtgctttaaatactaaccgttatccccgagaaatctcacaccgtgacttccgttttcaccgcttaagcgaaactttaccctctctctctctggcgattcctccaatgcgcaaggcaattcccaggcgactccatccccagccagatctccgcctgcgacgatgtcaacctccgcgagcccatctgccgcaccatcggccaaatacgctgaggtaagtccccatcggctagatcccccttttcatcattagatcggttttctctcgcctcatactgctttctttttctcggttactttgaacttgtagcatctctccaatttagtcgcagttccaagcttgtcacatgaaaaccactactttctcggcccagtcggcaaccctgaccccactgagttcatcatcggtgaaaccaataggattcctttcagactatccaatccagatctaggtcattggaagaacacctttaaatcttggccgtctctagaaaaaacttcacccgagaaaagttggattacatggttcaagcgtatgtcagctagcaaacgagttcactggaacgaaatcggaatcggccaagcacttgacctaaccatagcaaactcagccaaagaagaacctctaatggcagctgcttcttacttttggtccaacactatcaatgccttcttattcaaccaagggccgatgaccctaactctcatagtcatcattatgatcacgggtctagatgtcacttcatcggctaaccccatgagtctgaacacaaaaaaccaatatgacttcaagaccaagagtataggaggttggtcaggttatgttgcagcatacatgggccaaggttcagttacccctcgagaacatgtagcctttttgctaatgtggttagagaaatttctcttttgtggatcaagctgtggtcctacaaccaactggcagtttgtagccgaagccttggaagcaaataaacaatttcctttaggcaaaatcctcctcggctacttgtaccaaatgctgaataatgcttcggctaagttatctgtcggctcggtagtcggagcaggtggaccatggtggctgctacagacttggttgaatctaatatgtcatgaaagtcgtcaatcgaccatccgtcacagaagctgaatttccaagattagagccgatcatagaagatgacgaagaatgcactcatcgccgatgtatgtcatatggagaatacgcatccacaccggccgatgctggagcaaagttatcagccgaactgctcaaagattggttctgcagtttctatgaaggctttcaaaaagatgctcgagtttggtttccctatgaagattcagcaaacctcgagctcccatcagatttcagatttgaagacattaatcatgaaagattccaaacatccagagaagtcttcatagctgcaatcagcccatgcattcttccagtcggcatccatcaaggaagaaacgtccaagcctcttacgaattctatcatccaatgagttcagctagacagcttggactgggccaacttccaatcggcttattctttgccgataagatccaatgccgaggagagatttcatcaactttaatgatggatcggctgctcaaccttcaaggacctccactgggtagcattgaaaacatagagctagtaatgtttaggagcaaaaactttgatagatggtggggtgaatagaagttgcatctattccaccaaccagcttcaatgtacatgacagacctctttccagatgttgtccctcaagtaagcctttgactttacttgatttcatttgaataactgcttagccgatttatcttaactaatcttttctttgatttctagacaacagaatcctctcctcctcgtcaaagcaacagtggcagggatatcacctacgccccaggcttaattcctaatggaggtgggccatctcctcctgtcatcggctatgatgcccccaagacttcagctcttcttcaagggcttatcagagaaccagccgatgccggtaagaaaaggaaaaccagatcatcggctgtagatactttagccccagctccaaagaagaagatcaaaaagaaagctaaaccagctgatgatctgcctgccctagatccatctattaaacaagctctggatgaagaagaaatcggagaggatgttgatcaagctgtagccgaaataagcgatactgaaagaacaccatcggcttcacctaagcaggtccctcaaactccttctgctccaactcattttacaagagtaagaaaccttctataaccacttttgtaatcatctcactttatggccgattgctcacatacttggtaactgcagaaaaggaaggctgctgtgaagaagaaatcggctccaatgacatctaaaccagctccactggtacaataaccttaattctttcattagttaatctcagccgattttatataacacttgtctattttcaacctccttcccctcctattcaacaagcatcaagcgatcggaccccatcagctgtagggagtcatcacatagaagaagaagttcaaccaactgctccagctatcccagtaaatttcttataaccaacatatgcagatcggctatgcctatttgatctctaactctctttaaatcatcactgcaggtcttagccgatcttttcttttttgatatcagagattatcttgatgaagagacagaggttgacaacactagcaaggctctagctcctttgtctgatgatgtgaagaaaactcttgaagatatctctcatcggctagagacatcatcactagatagcctagtagtcgactgtggatcaattaggactcggcttcacgaagtttacgctcaaatcctcgatgagttagccgatatccttactacagctgtttatcttgagcaacatcaatttaagctggaaaaggccaagctgagattagccgagcatcaagagcgcaaagacattgaagcaacaatccaggccaatcggcaatttgttcatgaagaaaaagccaagctcgatcaattatctaaaggcccgatcaaatccaatattgaccggcttgaagctcgcaagatcgaactcttagcacaacttcaagaatgcaatgctgaactggatctagagcacaagaggttagccgatctcccacagtctatcgaagaacaaaaagcaaggttaaaatcagctatcaagaatgttgctaatatgaccaaatctttgaaggtcattcctggaaccgacgctcaagatgcccaagccatagaagaagtagaacagattaggcaaagagctatatcggctatccagcgatacttatctgaataatctttgtgtaatatgacttggaattttgtaatcggctaagacattcggattaatatgatgtgtaagctttgctcaaaaatctcaaaaattttgcactgtattgtgatatatatatatgcccccctagttttacaatgtcaagagcattgataaaaatacgaaacaactaagggcgatataacaatatcggccattgtatatcagcaaaccacgactgattacaatagaaccactaagggcgatataacaatatcggccattgtacatcggcaaaccacaaccgattacaataaaacaactaagggcgatattacaatatcggccatctcaaggcgatgcaaatacatcggctatcatgtatcggcaatactagccgatcatgcgttaacccaaacacttggataatatttcttcaaatatttgccattaagcgctcgcccataaacttctccatcgagtccttgcaacatgtatgctccttgagacacaaccttatgtatttggaacggcccttcctaatttggtgaccacttgccaaatttgctatcccgggttccaatcggcaaaatcaatttccacacaagctcaccttccaaaaaagtcttaggcaccactttcttattataatgccgagcaacacgttccttatccctagtaacttttgcaagtgctcgcaatcgcgactgaaccaaatcctctcgttcatcggtcataagattatagtactcattggctgtcaaatcactttgcaactctgttcttcttgagccgattcgaacttcccatggtaaaacagcttcatgtccataaacaagcttataaggaggaacttggattgatccatgacaagccatccgataagaccacaatgcttcggctaaacgagtatgccattgccgaggataatcagaaatcttccttttaatcaacttgatcaaacttttgttagatgcctcggcttgcccattagcttgtgcataatacggtgaagaattcaacaactttatacccatactatcggcaaactgaacaaacttatcagacacaaagattgaaccttgatcaatcgtaatagtctgaggagtaccaaatcggtagattatatgttcttggacaaactgtattgcatccccagaatcagccttcttcaaaggaatcgcctctacccatttgatgaaataatcagttgccaccaatataaacttatgtcctttactcgatggtggattaatcatgccgatcatatcaattccccatcctctgaatggccatggtttaatgatgggattcatagccgacgccggcgctcgctgaattgctccaaatttctgacaatcttgacaacctttgtaatatctgaaacaatcttctaacatcgtcggccaaaaataccccgcacgccgaagtaaccacttcatcttatgagccgattgatgagtaccacaaattccttcatgaacttcgccgattgcaactttagcctgataagcactcagacacttaagcaatactccatcaatcgttcgataataaagctcatcatccaataaagtatatttcaacgctttatatcttaacttcctataagccgactgggatggattttgtaaatattgatgcacatcatatctccaatcatcggccgtcatggcagcaacttcaatctgaacatccttgatcatcggcttatatcccgatgccccttgagctaaatcatagacctcaatattctgctctcgagatacatgcttcaaagttactagccgaaactccttcatcagtttttggcacttctcattataaactatcaacgtatcattcttacactcatattctcatgccaactgactgattactaacaaagaatcccccatgatttcaacagcatcggcttcaacctccttgagcaattgcaaccctttaagtactgcctcatactcagccttattattagtcgcataaggtttgatagtataagcaaactcaaaacatgccccccgaggcgaaattatcctttgtgtagacgttcgaatcctccacgacgccctcaaaataatagcttgggttctccatcttcaattggctgtatatcagaatcggatacttttaaaaaatctccatcccaaacttttccagataaacaatcaaggccatccatctcccaaagagctaaatcggcacaagcaacattgactgacctgtcggctggtacgatctctatcttgttgccttgccattgaatcaagcattggtgcatggtcgaaggaatacaacaattagcatgaatccaatcccttccaagcaacaagctataagaacccttcccatcgatgacaaagaatgttgtagggatggttttactgccgactgtcaactccacgttcagaacccctttggtttctgatggattgccaccaaagtctttaagcaccatgtttgtcttgatgaggttttcggcgttcctacccaatttcttgaatgtagcataaggcatcaagtttactgcagccccaccatctaccatcatcttaggcatcggcttcccattgacataaccgtttatatacaatggtttaagatgccgattctctgtcccctcaggtttctcgaacactgcttgttctggtgacaaccaacttagccgattcctcttccaccttgtctacatcggcttgatcaatcccaaattcggctggcaatgtaaaaaccatgttaattggtgccactacaacactcttcccttttgccaacctctttgcctcatcggctacaacatcatcggctataggaatctgattcttaacacgcaattcctgtcttggttttgctttcttcagccgatggttaatttcttgttcaacctcctgaaggcgctccctgttcctcaatctttgaacccttctcttctgattcttcatgaaaataccagaaggacaccattgatttgtcctgactacgtcatcctcctggccacgaccttgattcactgggcccaatctttgacgaacagacactctttcctgcctcagccgattactcctattatatgactgacttgagctctcaatgatatcattgcacccaaggtagttttcgatagacggcaacctcatcccttcattccagcagaatctaaagaactcacaaccccaatgaggatcaaaaccatcatcgtgttcttcataatgcttctcctgctgcttctcatacttcctctgatatttgttgattatcttagccgaattcacttgaaaaccctttgcacggacgctatcggctgattggccagctgtatgtaccatattaacaggaaaaggattaccatcgaccttcattggcctcttcgaatcatcaaacttgatttttcctccctcaatatccgtttggatctgctgcctgaagaccttgcagtcattagtcgtatgagacccagaattatgccacttacaatacctctttttgcccaactcttcagccgatggaattgtatgtccagcaggaagttgaatctgtttttctcgaactagcaaatcaaatatcttatcagccttagttatgtcaaagtcatacctctcctcttttcctgagtttttcacccattggtaaggtataacctttttgctcctaacccactcagctgcagctatttcagaatcatcatcctcaccatccgatccatacatataaggataaacatgattaatcttcctagagttcttcctagcttccgcgaacctttgttgatgcaaacctaccttctgtgtaaggtacgacaagctttcggaatcttcagatgagaatttttccttgatcggagcaatcatcccttaaaaagccaaatcggctaactgggcatcagtcaagctcaagctgtaacacttattcctcatttccctgaacctttgaatatactcatgtaccggctcatcatgcttttgcttgattgacatgagatcagacagtttcatctcgtgaatcctactatagaaataactatgaaactgcttttctaaatcggcccaactgttaatcgacccatgtggcagcgaagaaaaccaagtaaaagccaacccagccaatgacaaccggaataacctaaccctcaaagcatctacagccgatgcctcaccacactgagctaaaaatcggctaatgtgctcataagtcgatgtagtgtcttgtcctgaaaactttgagaaatcaggtactttgaaccagttaggtaaaggaactctttcaaaccattcaggatatggttgtcggtacaaatttccagtctcctttggtttaagcccaaattgctccctcattacatcacctatcacatcagcccatggtcgctgctgaggtgttgcttgagattgttgtggtgtgggctcatgtcacgaccggaaataacccaacgggtgttccttacgtgcgtgtattattccttgtcccaggaggcaaggtacaccaaaagttaatacaattcagagtttaacaagcggaagcgtaaatagttaatttattacatgggcagcgaaggcccagcacacacagagacaaacgagaaacagcggaagactaggacgacgaccacaggcgcttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaaggtacttagttgctcaaagctattttgtaaacacgattctagaactataccatattatttatcatggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctatggccggaacccccgggacaggcaggtaggactgagcccctagcagcaggacaccagccctgtgccatgacatctcgactaccgggccgcagctcgtgtagccttcatttgccctggagatgtccatcgacccccgacttcttccatctccatccgtgtacttttgtttataaccagactgactcacaaactaagccttacccactagacatgtggaagtacggtagtgctttgcaacagaggcccgaagaccggtccttgtatggccgaggtgctactatcaaaaccatgcaccccgagcccagcctaaaaccattttgggattttgaatagaaggagcggtgtgaagccaattccacaataaccaaaccattccaaagtgtccaggtgatatgaatattcccaaagtctagagttgtaaaaccgcctaatgttacctaattaaattgcgaagcatctacctaaaattatactagtggtactatgagtagagtgtccactagttggggttttgtttattctagggtgaacaaggtaataataacaacaacaataataataaggtcataacaaaggtaaataggcatggctagataaaacagtgataacgcgggaatttaaataaagcggtaatgcaataatttaaatcaacataattttacaaactgggattcaatatgttcaaagatga

SEQ ID NO: 49590 - DNA, 10299 bp, Oryza sativa
gcgtcagcggagggtagggggcgcgcggccggggtccacggggagtggggccccggcgggcaacctcaaggtccacggtggaccgggggcacgcggctcacagtggccggcgccatgggtcgccacgcgtcagccgcacccgcgggcgcggacggctgacggccgggccccacctggcagccgcggggcgcgcccgaaggcggcctcgccggcacggccgacgggaggcggcgcgcccgcgccccgatggtcaccgccggcgaccaccggcgcggcggggtggcgcccgagagagaggagagaagagggaagcgaagcggcggtcctcggctcaccccgggtcgacggcggcgacaaaaacggcgaccgaagcggcgagaggcggcggtgcggttcggatcgacgaggacggcggcgctccgacggtcggcaggcgaaacgaaggggtggacgaggttgacggggacgcggcgaagccgaaggaggtgacgccgagacgggaggagatccggggcgacgacggcggcgaatcggagctcggcggcgacggcggagagagaggacaacggcgcgagctcgaatccgacggggagagaaagtggcgagtggcggaaacggaggagggaggcacggggagcgtttaaatagcgttgggagtgagagagggcggccggaggggaaggaaaccggcgcggcgatctcgggctccattgatgcgccggcgaagttcgcgggagtaaatccgaacgaatccgagggagagagagagggaaaagtgggggaaagagggagggaatcacggggagtgatttccccctctttatggcgcgcggggacggcgggatgcggcggattcggcggcggcggcggcgctagggcacgggcgggcggcgggtgcggcgcgaggtaggggatgacgggtgggccccacccgtcagcgagggtggcgggcgggccctcccgtcagcggcgcgcgcgcgggggaaggccgatgggccgcgggggagaggagagagagggagggagctgggccgagccggcccaagaagggaaggggggaaaagaagactttttagggtttttctttttataaaaccattttaactttgtttatttcttctcaattattatttgtgctctgaaaattccagtaaaatttatttacgcattttaggcttttaggaaatatacaaaaatcctccaagccttatttgacttttaaatttgcacattttaattgttggaggctttcacatggattttaattattctcggcataatttcgaggatgtattttagagtcgttttgggacgcgacaactgacccgcaaatggatgcatacgtctgcgaggtgcgatgcatggaacgccgcttcgacggactcgagctctgtcacatgccccggcgcgacaatgcagtcgctgacgagttgtcacgcatcgcgtcggcatgagccccactccccccggggaccttcgaggaaaggctcgcgcagccatcggcacgggtggaccccccgagggaccccgacgccacggcctccgccccgacccctaacgacccgcggccctcggggcccgagggggtcgaccccaacccccctcgtcaggtcgtttggttgactgacatttgggcgtatctcgataataatactcttcctgaggatcacgcagaagctgagaagctcacgcgtgtctctaagcgatacgtgctcatagaagggaccctctaccggcgtgccgccaacgggatactcttgaagtgtatttctcgggagcaatggggtcgagctcatctctaacgctcatcagggtgagtgtggggcccattcggccttacgtatattggtcagtaaagccttccaacaaggtttttactggccgactgcgttgcaagatgcccaagaatgggtccggcgatgcaaggcgtgccagttccatgccaagcaaacccatcagccggccgaagacttgcaggcatcccgctctcttgcctttcgcggtctgggggctacacatcctaggacccttcaaagcggcccgaggcgtatatcagcacctgtacgtcgccatcgacaagttcaccaagtggcgcaaatcttactgtaacaccctgaaaatttgaccaataaaaacaaaactctaaaaatacgggccttcgaaaacttttaaattaattgcatcatgccgatcttattcgcctattttatttggatttgatttcgaagttcattaatcgtgagtaaagtatagttaattaggaataaaccctagaagtaaattggtaaaataaatataacttaaaataaagactaggtgtggatagaaataaataaaatattatcgcgatcatatttgtatcaattaaatttaaatgcgatggaataagaattaaccctaattaaaaattcaaataaattatataaataaaatatgagtaatattaatcaagggtgaattcattagttgagataacacaaatattgagaaaaattcatacatgcaaaaattagaaattgtggaaccaaatttatataagaaatagactaaaatgagagaaataggaaaaagacactgttcattgcactctaggtgctcgatgtggttctgtagccctgcccctcctccatcgcctgtccctagccgccccgagccgtgccgacgtcaccatcgccgcctgccgtcgcgtcaccgtcatgtgcattgttgctgtggtggcttgttgagtacgattggtactcacccttgcaatatacaaacttaatcagcggtcggagatgaaccttcggaggatccctatgcttactaccaggatggtgatgaagaccatggccctcagtaggtcttagttacggtcgttgcctgtggcaatggcgtgccgctgccttaactccgctgccttacctacttctgtttttggaatgtattccggaccacttggtccgatgatttaagactatgcctgcgggcttatgatgtaataattcgttctagacactcgtgtatgtgcacttggtatttcagctatgaattcgtgtgtaccagactacttgatccagggaaatggtactgtttacacgattgatttctgttataaaaacgggggtccacacttacccaatcggtgcccaaccgtatcattacagataacgacacccagttcaccagtgaacttttcggcgactattgcgacgacatgggcatcaagctgtgctttgcctcgcctacccaccccaagagcaacggccaagtcgagcgagccaacgccgaaatcttcaaaggactcaagaccaagacgtacaacgtcctgaagaagcacggggattcatggctcgaggaactgcccgccgggctgtgggcgaatcggaccactcgaagtcgcgccccgggggaaacaccctttttcctggtgcatggcaccgaggcggtcctaccttcggagctttccctgggtttgccacgcgtcacgctgtacgatgaggccaaccaggatgatctttgccacgacgacctcgactatttagaagagcggagaaggtgcgcggccctgcgagcggtgcgctaccagcaaagcctgtggcgctaccatcacgccacgtccgggcccgatcactgcaagtcggcgatctcgtcttgcgccgcgtacagtcgcgcttggggctgagcaagctctcatcaatgtgggaagggccatacaaagtgatcggcgttccccagctgggctccgttcggctaaccacggaggacggcacggcgttgcctaacccctagaatatcaaacacctccgccgtttctatccatagagtcgcgcgtcttttgctttcttggaactcaggccaagccccacgctaccactgttaaatatgttgtatcttttgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaacgggaaacagcagaagactagggcgacgaccacaggcgcttgacggcaggcacgagctagacaccaaagccttcatcttccaggggctcctcttctgggtttgggaaaaattgagcaagactgagtacaaccaccgtactcaacaagacacacccacaagtgcaggataaatgcaagggagtacaagggggttataatataaagggttagggtttgcagcaaacagcattaaaagacacttagttgctcaaagctattttgtaaacacgattccagagctatacaatattattaatcaaggccgtgaacccacatgaaccagccttaacccaaggcctacgatgattcagaccgaactggcgacccgaccatgggtcccagctcgtcccaagccaacccaggccaaccattccatattttaattgttaagcaagttttaagaattaaaacactaacttgggtacattgctcggcttgcccataactgagggcgcggctattcgaatagattatactctgatcagaggtgtacatctgtcacgcccggaatttctatccaaaattccaaacgcttacatgtgtgtgaaccctcgtcgaggaatcagccgaggcacacaataacaaattgataatagagtacaattattactctaattaataagcgaataaaatgtcattacagaggtagatagtttctctcaaacaataaagatctaagcagcggaaaaaaaagataaacggcgcagacggctccactccacaggcagcttgaccaaggctacacctaatcctccacacctcagcctcattgaagaactcctcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaccagttaagtattaaacaatattaatccaacgctatacaacataccctgttgtataggcccaaccattctgaacaaccatcccggttgcgcagttctatctccaaaccatgaatataccatcccaaaccaggagctactcagattattaccaatgatagcatcctctactatggtgagaggtgtgggactaatcacgaaaaacattgttaaacccgcccataaccgcgggcacggctattcgaatagttttactctgatcagaggtgtaccactgtacccacaagacacagcctcaacatcatgtctaccatgcgtcgcgatactggaaagtacccgaatagaggctgtgacaataccctttgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattaatcatattttaattcccaattaattatcataacacgattaaccatcgtgagctaccattaaatataaccataaataataatgtagtacatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaataggttcacaccacccggtgacattcgaaaataaatgcacagttgaaataaatagaaaatttaaatataggatcaacatgctcaaaggattgtgtttaggatctgtgtgacttgccttgcaataatcggtcttcaattatcttcttgaatacttccggcgcactcgcgaaccttcgcaacgacggaaacgacaagctaacacgcaaaacaaagaaaaagactaataaaaaccaaataaacagtacataaaaagtaaacaaacatgtagatcataattttaagtgaattatgagacttgaacgcctcattctgacttcaaatgaatttaatatgaattttacaagattaaatctaattaaagcccatttaaaaagaattaaataaatttaattcaatttatggaccattttaatatgtagatctttattttatacaacttttgcaacttgaaccacattaaactgagttcaaatgaattagttatgaatttttaaagattaaatcggattaaaacacttatattgattttaattgaactatgacgcaataatgaattatttttgaaaaggaaaagaaggattattgcgtcagcggctagggtttgcggtggaccgggtgcacggcagcggttcacgcgaacggacggccgagatcgacttgatccaaacggacggccgagatcgatcggtccacgaccggctcacgggagacggggacgatgacgtcagcgacgaagtcacctccggcggcggctcggcggctctacggcacaaacggagggcaccaagacgtagatcacggcgcggcgaactcaccgatgaccaaaacgtcggcggaagaccaacggacggcggcggcgtcgaggaaaaggcggcggagaagatcgggtcgacggcggcgacggtgctccggcggtcttcagcgacggcgaaacggtggacggggacggcggcgacttggcgatcccgacggtggccttcccgagtgacgacgacgaccatagcgacggcggcgcacggctggacgaacggcggcgacggcggcgcaaaagctcagaggctagggcgctacacacgacggcgggcgaaggcgaaagaggcggcgggtagaggagagctcgggggtccttttaaaggggctagcgagcggcgacggaggcccacggcgaccggcggcgagaaggaaaggtcggattggagggagaaaagtcaatccgaatcgaactcaaatccaccggtttccaaagaaaattagccgatgattacaaaagagaaaaggaagaggagatcgaggagattatttcccctctatcgatttcaccggagaaggaaagacgcggccgaatttggaaggagacggcggcggcttgcgctagggtttcgggcggcagcggcgcgaggaggaagacaggcctgacagacgggccccacctgtcagcgagcgaaggcgcgcgcaaactgggccgacttgggccaactggccggggagggagaaaaggaaagagagaggttttgggccggctttcggcccaaagccaaaagaagactttttaaaacctttttcaatttaaattattcatgaaatgcaattccatttattaaaaatacttccttagctcaaataaatcctagaaaaatctaggaattatagaattaagcaaagtatttaacaaaattttatctagcccaattttatattgagatttaacaaattaaaattagatcttctcttctaggcttttaaaatcatttctaataattcctttttaaacaacagtttataatttaaggatttttaaacaagaaaagctcttaacaaatataattagatcattaatgatcaaataattactgaactgttctttgtaccatttaggaattgagctctgaaaaatccgagaaaatttcagagagttgacttaatcatggagaatttaataaaaattaaatccatccatgctttatatttaggaaattttatttcccacatttaacttcacttgtaaattaaagaacacttaatataaattctattattaatttattaaataatttataaaccctgaaacaaaaatcaggatgtgacacctggtcaagctgcttgtggagtggaaccgtctgcgccgtttatcttattttccgctgcttagatctttattgattgagaggaactatctacctctgtaatgacattttattcgcttattaattggagtaataattgtactctattatcaatttgttattgtgtgcctcggctgattcctagacgagggttcacacacatgtaagcatttggaattttggatagaaattccgggcgtgacaggggacgaggggccatcgctagtcaagggggcccctggtcccttctcatagccaggctcgcaacgcgggtcgccctcgtcgcgctcaactataagagcggcactcaccgcgtgggggtcgcggccaagtagagcagcaacggtttccctagccccagggctactaggatgggggggaggtgaggtaagctttcagctgattgagagcttgcttcgcttcctccgtccacacaaacggcccgaggcgtttgaggagtttgaataggggcagcgccctctctcccagcctcgatatgaatcgacttagggcgaccatgcatcccgtgacgcactgcacatccctaagtttgctggggggtgcatcctctctatcgcgcgtattttctctcctcgggagaagactagaaaaccgagtttgcccgccggcacaccaaacacacacttttcggggttcagtttcatgcgcgttgacctaaggctgtcgaaagtctcagccaagtcctgtaataacgtctcctggtggcgcgtctttaccaccaggtcatcgacatacgcctctacattgcgccttatttgattactcaaagtaatgcgagtcatgcgctgaaaagtaggacctgcgttcttaagaccaaaaggcatagttgtataacaaaaggtgcctacaggagtaatgaaagcagttttttcctcatcttccctagccatgcggatctggtgatacccagagtaggcatccaaaaaagacaaaaggtcgcaccccgcagtggagtcgactatctgatctatgcatggtaaagggaagggatccttagggcataccttgttgaggtccatgtagtcgatgcacatccggagcttgccgttggccttcgggacgaccaccgggtttgccagccactctgggtggatgacctctcggatgaagccggcctccaggagccgcgtcacctcctctcggatgaaggcttgccgctccggggcttggcgtcgtacattctgccggatgggtcgcgcatccggccgcacggcgaggcggtgctcaatcacctccctagggaccccgggcatatccgacggcttccacacgaagacatcggagtttgcccgcatgaaggagacgagcgcgctttcctatttggcgtccaaggtaccgccaatcttggcggtcttggacggatcatcgccaaggggaatctccttgactggcacctcgttggccgaggcaaggtgcttcttggaggcgttggacgcagaggcctccgggacctgcggctccatggctgccgccaggttgtcggcgcgatgctccgcgcaggcgagagcgaccttgacatcgccaaagacgatgatggggccgctggggccgggcatcttcatttagaggtaggcgtagtgggtggcggccatgaacttcaccaacgcaagtctgcccaggaccgcgttgtagggcagattgaggtctgccacgtcgaagtcgatccgctcggtgcggaagttggtggagtcgccgaaggtcaccgggagctcaacgtgacctagaggccacgtgtgacccggggttacgccgatgatcggcagtgacggctggagcttcattctcggggccttgagcgcgtcaaaggcagccaaggagatgatgctgaggctggtccccccatcgaccaggacacgcttcatcttgacgttgtggatggtcggggagaccacgaggaccaacttccctccccgagtgagcaccgtcggatggtcgctctggtcgaaggtgagctttacctctgaccagcgcgccttccgtgccgccttatgagtcgggacggcggccagaagctcacgcctcatggccttgaagccacggcgggaggtgtgagcacaagctcccccgtcgagggtggcgatggtcccctgaggtatctggaattccagatcctcactatcatcgccgtcgtcggcaggggccttcttcttggcctcccctcgccggtcattggtgggggtcgcgggtgctttgccctcccgtcaactctgccgcttctcctcatcggctttccgaaaccgctcgtccaagttcttgac

SEQ ID NO: 49591 - DNA, 862 bp, Oryza sativa
aatttaaaggatatattttagggtcgttttgggacatgacaaacctaccccccttaaacggaatctcaaccccgagattcagaagaaccggcgaagagatcgggatggactgccttcagctcgtcttcacgctcccaagtagcttcttcctcagcgtggttgctccattggaccttgcaaaaacggattacccggttcctggtcctgcgctccatggtgtccaggattttcactagcctctccacgtaggtcaagtcttcgcgaacttcaatttactctgaatcggcctgctcggatggcactcgaaggcatttcttgagttgcgacacatggaacacatcttgcacgttgcccaaggatgcgggcagctccaactggtaagcgacttctccgcgtcgagcaatgatacggaaaggacccacgaaccgagttgcgagcttcccttttatctgaaacctgtgtacgcctcgcaatggcgtgacccgaaggtacacaaaatcatccactgcgaattccaggttacgacgtcggttgtctgcataactcttctgccgagactgtgccacctttagattatcccgaatggttctgactttagcttcagcttctctcagtatatcggtcccgaacacttggctttccccaacttggtcccacaatagcggtgtccggcatttgcggccatacaacgcgcttcatagggtgccatttgtatgctggcttggtagctgttattgtagagaactcggcataagggagactcttaccccaggtcttcccaaaatctaggacacatgcgtgaagcatatcttcgaggatctggttcagacgctcggtctgtccatctgtctgcgggtgatac

SEQ ID NO: 49592 - DNA, 6069 bp, Oryza sativa
tgggttgcttccaattagtgacggcggtcaccgtttcggggtccacagcaactcctttagcggatatcacgtgccctaagaatttgacttcggacaaccagaactcacacttgctaagcttggcatacaattgatgttcccgcaactttcccaacaccagacggagatgctgctgatggtcttcctctgattgtgagtacatcaggatgtcgtcaataaagaccaccacaaacttatccaagttttccatgaacactttgtccattaagttcatgaagaaggcaggagcattggtcagaccgaacgacatcaccgtgaattcatacagtccataacgcgaggtgaatgcggtcttcggaatatcttcttcacggatacgcaattggtgatatccggaacgaagatcaattttagaaaagacagtggcacctttaagctgatcgaagagatcatcgatccggggaagagggtacttgtttttgatagtaacttcattgagagctctgtagtcaacgcacatccgctttgtcttgtctttcttctccacaaaaatcacgggagcactctagggggaagtgctcggccgtatataccccttttcttttaactcttccaactatttcttgacttcggccagttcatttgctgccatacggtagggtcgcttgtacagaggagtggttcctggagcaagatctatccggaactcaatctctcgcttgggcggcataccgagtagttcttccggaaacacgtctccgaactctctgacgatggggatttctgacagtcctatctgatgaagttctgaactactgacagaggttgggggcgcaaagaaaacaaccggttgttccggccctcggtacagagtgacagtgcgtcttgcgcaatccactactccttggaattgagccaaccatttcatcccaaggatcacatccaagttcttggtgtccagaagaatcaaatctgagggaaaaaggattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtacccacgataacgcctggagttgtcagcatatcctcggcagtcacgtggttcacacgaccccgaatgacatccttaccaccgttgttggggcggggaggcgcttggccttgctggcgcctcggctttgggcatttatccgcaaagtgcccgggctcgaagtagttgaagcacagacgctgctgaccatgaacgtctctgcggccttgtccaggctgcacggctggcgtaggaggacggggcgcacgggtcccttgctggctctgctgttgctgcggctgtgggacgcgcaccacgaattgaggtcggagcgcggagcgtggttgctgctgctgctgctacgaggaggatccccctggatagggattggtgtagcggatcctttggttagccccctgttgattgcggaaatttgccaagcgacgcttgtgtgactccagttccttgtgcttggcttccaagcggatgctcttgtccgccaaacgctggaaatccggataatccccggagaccatatgcacggacagctcagggtccattcctgccaagaacttctcctgcttctcctcatcttcacgaacatcctccggggcgtaccgggccaggttgttaaactcatgcaaatactccatcacagagcagttgccttgcttcaactctcggaattcccttttcttaagggtcatgactccggcgggcacatgggtcctccggaaagcggcggtgaagcgggcccaagtaataggctgtccttctggctgcgtagcctagaagtggtcccaccatagagatgcgggcccctgcagttggtgagcggcaaagatgactttctcctcatcgttgcactgcacggtgtctaactttttccccacggcatgcaaccaatccaaagcatccacggggttattggagctagagaaggtaggcggacggatgcggaggaactcggcaagtttagaatgttgcgggggtggtggtggaggtggagcattatgctgtggcggattttggatgtgatggaggaaagcagccatcatgttggcctgctgggcgaggatttgggtgaggatagagttggtgtctggtggtggtggtggaggcgggtgaggaggtggaggtgggctgccatggttgttgtagttgctgccttcggggtgactgccttcaccggtagcagcacttctcctggttgtcaccatctgaaactcccacacagaaccggcaaacagagagagctgactattaaaactaaccacccacgactaccataattcttgaatttatttctgctattaaattggtttattaaggttcaagttgcttaagcaaataaaataaagacaggccccgacacagttataccacacaccggtataaccatgccccacacgactctagcagaaaaacaaacgagaagaacacccgcgcaagcctactaactgctcgtctacttctgcgacgggccagcgcggaaggtgagcagcagtgcatcctccgtgctaccaacgccagaggctccctcatcctgagaaaccaagggcgcgggctcgtcacgaggggtctcgacgaagcaggtccatgccaaggactgacgaacaagctcgggcctggaggtactcttgcgggcggtgatcttcaggctgcggcagacgcggcagcgcttggggcgacagacctctccctaggcgatcttgagctgacacagctgcgcctcccctgcgtctaggtccttcttcagctgcagattctcctgacgtagctccaggatcttcatgttgttctcgaccatcccacggcgcaccatctgatggaagtcgatacgagccgcgtcgtacgcctccaccatgcgcgccaggtgcacgatggtagcgtcatcctccgagctagcatcccggaaggtggcgaagtcgcgggctcctccgcagcgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagtgaggatcactgcagtaacctcccacgcagcgtggggctctgcatcgtcaccctcctgctccggaagcggcctggcctggtagtccactccaggcggataccccaggacaacgcacatgccccgtagctccaaaacgaagccagtcaggtccaaaccacgatggttgatgctgccggccatctacaaacaaaaacaaaagagaatagcaacattttaaagatcagattttgacgataaatgaagcagcgggacagagagagactagaggattttcacaaataagaaaggaattttatttcgaaaatattgctaaggcttgggatctaaagctcgtcctagggtcaagggggctctgataccaacttgtcacgaccagaaataacccaacgggcgttccttacgtgcgtgcattattccttgtcccaggaggcaaggtacaccaaaagttgatacaattcagagtttaataagcggaagcgtaaataattaatttattacatgggcggcgaaagcccaacacacacaaagacaaacgggaaacagcggaagactagggcgatgaccacaggcgcttgacggcaggcacgagctaaacaccaaagccttcatcatccaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttataaatacgatcctagagctataccagattattaataagggccgtgaacccacacgaacctgccttaacccaaggcctacgatgattcagaccgaagtggcaacccgaccctgggtcccagctcgtcccaagccaacccaggccaaccattccacgttttagttgttaagcaggttttaagaattaaaacactaacttgggtacattgctcggcttgcccataaccgagggcgcggctattcgaacagattatactctgatcagaggtgtacatcacgtgtaaccatgtgccacataccaccacggtatacggacggaagacgtgacatagtttccaacccatcctagccatagacaagagtaccgacccaaccccacctacggccggaaccccccggacaggtaggcaggactgagcccctagcagcaggacaccagccctgtgccatgacatctcgactaccgggccgcagctcgtgtagccgtcatttgtcctagagatgtccatcgacccccgacttcgtccatctccatccatgtacttttgtttgtaaccagactgagccacaaactaagcattacccactagacatgtggaagtacggtagtgctttgcaacagaggcccgaagactgatccttatatggccgaggtgctactatcaaaaccagggaccccaagcccagcctaaaaccattttgaggattttgaatagaggggggggtgtgaatccaattccacaataatccaaccattccgtagtgtccaggtgatgagaatattcccatagtctagagttgtaaaaccacctaatgttgcctaattaaccagcgaagcatctacctaaattcatactagtggtaccatgagtagagtgtccactagttgaggttttgtttattctagggtgaacaaggtaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctacacgaagagcggatcttccaaagctgcagcgtctacacaaccaacggaaaataaaagggcttttactctaataaactccatataacaagcagtaacaaagcactaaaatgggttcttgacttcttaaggaaaaattagagacttgaatggtccaattccgagttcaaatggccaagttatggccatttgaagtttatatgttctttaaataaatatttgcgattttcttcatttaaaatttaatttaaaaagggtttattgcgtcagccgaggggaggggcgcgcggaccgggtccacgggagtggggcccacgcggcagcctcacggtccacggtggaccgggcgcacgcgggctcgcaccggccggcgccgtgggtcccacgcgtcagccgcacccgcgggcgcgggcggctgatggccgggccccacctggcagccgcggggcgcgcccgaaggcggcctcgccggcacggccgacgggaggcggcgcacccgcgccccgatggtcgccgccggcgaccaacggcgcggcggagcggcccccgagagagaggagggaagggggaagcgaacggagcggtccacggctcaccacgggacgacgagggcggcggaaacgacgagcggagcggaggaagacggcggcgcggctcgggtcgacgaggacggcggcgttccggcggtcggcgggcgaaacggaggagcggacgaggtcggcgaggacgcggcgaagccgaagggggcgatgccgaagcgggaggaggtccggggcgacgacggcggcgaaccggagctcggcggcgacggcggagagaaggtgcgacggcgcgggctcgattccgacggggagagtgagcggcgagaggcggaaacggaggagcggagcacggggaacgattatata

SEQ ID NO: 49593 - DNA, 2763 bp, Oryza sativa
aggtgcggggagggtttaaatagggttggaagggggagagagcagccggcgagatttgcgggggcaaatccacccgtttgaacgcaagagagagagggaaaaatggggggaaagggagaggggatcacggggagtatttccccccactttattgcacgcggggacggcgggatgcggcggatttggcggcggcggcgtcgcttggcgcgggcggagcggcgggagtgggggaggacggggatgatgggtgggccccacccgtcagcgagggtggcgggtgggcccgcccgtcagcggcgcgcgcgcggggagggaggccgaatgggccgcgggggagaggagagagagaggggggagagagatgggccgggccggcccaaggaagggaagggggacttttagggtttttctttttataaaactttttcaactttgtttatttcttaataattattatttgtgctctgaaaattccactaaaatttatttacgcattttaggcttttaggaaatatacaaaaatcctctaagccttgtttgacttttactttgcacattttattttttggaggctttcacacggattttaattattctaggcgtaatttaaaggatatattttagggtcgttttgggcgtgacacaccacaagtggcagcaatgttccgaagagggggaggaagttctcctctgtacccgggacccgccggaaggcgatgagcccagcggtaagcttctctttcgtccttgagtacgtagtcagaacgacttaacctcacatcatattatcttactcaggacttgggtgcgtctccaccgcctcagcgaaagcagaggttggtgacggtcggcgagaagtaagtaaatgtttttgaggtttttttattctcaaagttttgatcacctagcctcatggagaaaaaatcttcgcaggatggcactggtgaaagcggcgcacagtggggctgatgctgcttctagtgcgccccctgtggcgacctcgacggaagtcatggccagtactaaggaccaggaggcggcgccatgtagtcctatcgctcgcctcgtgcccgtccggcctctgtccgccgacaccctcacctgggggcagctccaggctaagatggagtgcatccttcaagcgggcgcccgcggcgtgggccgcgagatcgaggaggccagtgcagcggcgtcgtcggcaaatcattgtgccgatcagctggcatgtgatctggcggagtcccgcgaggacctccaaaagatgaaggagctggtagctggcaacgagacgtagcggcgtggactcgagcaccgtatgtcggagctcgagggccatctgacagccatccgaggttcgctgcggacatcgttcaccggcgtgcaccaactcgccggggagttcggtgtcacaacttcgatcccagcgcatcccgacgagtggttgctgacatcgtcgctcacggaactggctaaggcgatggaggagatcccctccagccacacggctaggcttggtgaggagacgtctaacggtatttacactggggcgtgccatgtccttgcgtttatgaggctagcgcatcgcgacttagaccttaaagaggctttggatcggggggccgccgatgacgcgcgtaaggacacgatggaggaagtcagtgacttgggggagttcgtcctccccctttttcaagagtaggatttttattttcctctgtactcctttatctacatgttgtaaaactttctgtgggttcgaactgcttttatttaaacagttgtttccctgtttccttagcatgtgatcccgagtacctttgtcattgtagatatgttgaagtcgaggatgtccagcagtgcgggcagcccgatacgtcagtagtcattccggcgctcacgcttgagcctcacgtgccggaggtggaaatcgatcaaagcccgtccgtggagacgaacatggtgatgacgtccttaggtttgtgtcttgatttccttcgctcctcgtgttcggattgacttaattagctgtgttctcgaaagagaagagtagcttgacttaatcttttctgtgttgggcaaatttcaagaacgtgttggcagaccgagatcgtcgaatccagtattggaagaccaaactcgaggtggccgaactcgaaaggaccatcgtggaggcgaagaaggaccaggccatggaaactctccgaggtcgcgaggtgtggttcaactcgtacctcaagggttgctgcacggccatggcggaagtttgcagggagctccgagttccccgcggagatcccatggagtccgctgctggttatatctcgtggatgaagggggcctacgcacagctctaagggattggcaagcgcatcgacgaggccctgaagcaggagtgtcgtcgagcgagccgctacgccgggggacatgtgctggcttgcatccaagataaccgctcgcagttgcacctcgagttccttcgtgaagggttctctcgttctcggaggacatccgtggagattgacggtcttgcgcagttgatggcgtcgcttgccgagaaggttttctgctccatgtattggcgttggccgtcctagtagcttttgtatcctgtagaaaaacatctcaaggaagcatgtaatatactaagttttcttattttgggtatgttgtgtatgagtgttttctcgttctgcgactttgattagtcatttgagccatacactctccctatcccccagccttgtctgatgaactactgtacca

SEQ ID NO: 49594 - DNA, 5315 bp, Oryza sativa
cggaggacataatctccgatcgaaagtgtacgtgctctgatgcgcttctcgtgatattggagaagggcctactagtagctgcctgctctgacggcaactctttctcgatgttcctcgagtagattcacatcgtcacttcgctgctcctcctgctcctcgtcggagtacttctgcactcgtgtgctctgatgtcgtagctccgtggggagcatagcctctgagccgtacacgaggaagaagggtgtctcctcattggattagttaattcagtcatttgaaattaaattataaagataatcatttatgattcagctgacagaagcttgatattagctcaaatctagatgcatacagatttggcataatactgggaatcttgacagtatttaattaaatctagactagaccactggtattaagaatgctttgtattatttacaaggcaactttaagtaacatgcttatatttctaaaagtctatttggtctctaaagtttagagatatttggacacacttattttgtgagatgtgtggatatttataaagattattaagctaatttagattaagctatgtccacacataggggagcaataaccatggaaaaggtccaaaataatctcttattgcatagtcgacgatgcagttggattttgtagcatgttatgattcagtcatatgtttaagaaaatttccctgaactaagagtggtaaatagcgctcataaaccactcaaaattatactatgctataagttgtgcactaattaaacacagttttctattctagtaacaacatgtgttttcacatatggttgtgaaagatatgtcccagggtctaattattaagctgagcatttgctcatggctccatactctaaaggctagtaaaattaagtttaactaagatatgttctagctagcacatgtgtaaattagagccttattaagatcctggatgaggggaacttaattttcaatcaatacccactaagttaagcttgagtttatttgcgtaccatagtgttgtctcagtgacgcttgtgacacattgtcttggggaggtattttatttagtaaactcgtcagttagtctcaaaatcaaggggagaatgttggatgattttcttggctaatgccggttagctaggaagaataaaatcccactggttttcctatcctaacaagaaaccaaagaagagaaatctgttttgtgtgatcggtacaaaatagattcgaatttagcttgagaaaaaaccctgagccccaccgatgtcgctatataaagaaagagaaggagggaggcaaattaacaacctaactctatctaaccctaaaccctaagtcaatcgtccgatcgattaggcactggaaggggttcgtgaggcatctctagaagaagaagaaagcagaagaacaatggcttcatttttaggtcagtaaatcaattaatttccgcataagtagaaggtgatcatgtctaggctaagatttaaccaattaagtgttttaaactccaacacatttatcataaatgacatatttgcaatggcatggatcgaattaacccaaaaaagcattccaagttatttggctttggtgtatgtcaaaatatataactttaagtagaacaaaccaaacaagcaacccatcgttttgctcaggcttatgcttataagccaaattctaaattttaaagcttaattttagagttgattttgtgcccttttcatcatagtttatatatttatttttaaattgctaataacatgtacataaaaatttcacctacaaattaattttttagttaataatatgtggtacggataataagcataaaatgatggggccgaaaatcccagccgactcttaaattttttgtttggcaatgatcaattaatgccacaccaaaataattggcagtgggccggggccgaggccgggccaggccctagttctttcaccgtggaacggttctctagccagctggcaaggactccatgaccaagagtccaggagcaaagcaacgagcacgtcatggagtagactaaactcgtggcgtcgacaggtatccatggtggtggtggcagctggctggggctggcatccatggcaaagacagcggaacctccatgagccatggcaaggtaggtggataggtctgctcccgctcccacccttctgggccatacttgtgctggcccagcacgaacagacccatcaaaaagcaagcaacagcttcgactcaacaagcggcgaccatgaccctagaaggcatcgaccttgaagtgcaagccgaagccgagatggggacgatgcgtcagaacatgaacaagttacaagacatgcttcgccaaatgcaactgcagcatcaagcctatgaagcggcaaaacaagtcaagccagccccatcggccccccacccgacttcgacagcgatggtcaccacccaaggtttcggccatgctgcacaaccccatgctccgccggcttcggccatgtacggacaagtctatcaagctccgctgtacgttgccaaagccgctccgaccgttacagtgcaaccggccccttacaccttcacgatgcccgttcagccggcagtgacacaagtacaaccggcgaagcatgtcgaagcacagcacgccgccatagaagcatctttgaccttacaagctcagttccaagctttccttcaacagctcaatcaaccccacacaatttcgaaaccaaccccatcggcgaatgccgttggaagcaagtcaaggtgccccggtctggcagccgtcaattcggtgcaatgcaccaagcgaatcagtcaagccagggggctccgacctggcaaccgataagtcaattcggcgcggcaatcaatcaaccaagtcaagggacaatagcctggtagcaagcactgagcttcgaacagaacaccatgacccaagcatcaacaactgatgtttatgggataatcaccggtttcggctccacacagcaagcgaaccagtcgaatcagggcgtggcctggatccaagcaccacagttcgacctaggcatggtgacacaggtagtttcagccaacatgcaaggagcactgttcagaaccggaccctagccgaaagcgatggcccaaccacgggtgcaggcgatgacttcgccattcgccatcccataaccgagcttgaactcatctttccaaggtgcaacgatgagaggcgggggcgaaaagaggccaccgttaagttgggtgctcaagaatcatcccatcccaccccaattcaagtacccacccgttgcaatatactcgcgtgaatcagacccaagtgagttcttgtcaatctacgagtccgcaatcgaagtggctcacggcaatgacaataccaaggcgaaggtaatacatgttgcgcttgacgggatcgcccgctcttggtatttcaatttgctatctaatattatatactcatgggagcaactctgtgaagtctttgttcttaacttctgaggcacctatgaggagccgaaaacgcagcaagacctcttcggcatttgctagaagacggagaaacaacaaggagtacattcgacacttctcgcaagcacgctgccaagtgcaagacatcacagaggcgtccgtcatcaatgctgcttcggcagggctccttccaagcgacctcacaagaagaatagcaaggaaagagccccagaccatcgagcgcttgtttcgcatcatcgacggccatgcacgtggcgaagaggacacaaagcgaaggctggagatacaagccgactatgacaaggccgccgcttccgctgcagctgcgcaagcggtgatgcaagcagctgaagccatgccgctggcgaatcgccaagtgcagccgacgaagaaggtgctgcccccaagacccagccaagctcccatgacgtgtaaaaagaccagagccgaacgtggaaaggttgtgagtggcagtcgaagaggtgtagaccctccacaaggtgcttgacacacaccaggacaccaatcaccagcaaccctttcgcaagaaggccaagaaggatctctactgcatgttccacgggcgctctttgcactccaccgagcaatgccgaaacattcggcagcaaggcaaccaacaggagccaagaccacagcaagtgaaggccgaagaggtgccctgtgaacctgttcaggacataatccctcaggccgaacaacagcaagacatcccgcaaagtgttatccaagtgataacaagagcagatccaccctcacagctgtgaagctgcaaagaaaaacgcagcttcgggcggtgcacaacagagaaacgccgagggggtcttgttcctacaccaagacccgctgatcatttcggcagagatagctagatttaaagtacgtcgaatccttgtggatggcggcagttcggcatatgtcatcttcgccgaagcatacactaggatggggttcctgaccttggctctctctcaggcgctcactttgcttcacggctttgggggcgaagcggtgcaagtcctaggccaagttcacttagctccggcgttcggcgcgggtcccaacagacacgagcagatgattctcttcggtgtcattgatatttcgtacaactacaacgccatcttcggcaccgccacgttgaacaagtttgaagctatcgcgcaccacaactacctcaagctgaagatgcctggtccggccggggtaatcgtagtcaaggggctgcagtctttggccgtgctagggagcgaaacaacagtgataagtagagaagtagacaatgtacaagctgaagatggtgagcgagcaagaatcgtgccgaagccgtccccacatggcaaggtgatcaaggtccaagttgacgaggctgaaccaacaaaggtggtttccctaggcggcgatataagtgaagaagaaacgaataacatcttggccgtgctcaagaaaaacatcaacatcttcgtctggggatcaaacgaggttgtgggcgtttggcccgacctcatcatacaccatctagtagtaaagctatatgcaagccaaagaagtagaagctacgcaaaatgtcgatagaccgccaacaggcagtgaagacagaagtctaaaagctgctcaaggctggtgtgattcgggagatcaaccacccggagtggttggcgaacccagtgttagtcaagaagtccaatggcaagtggcggatgtgtgttgatttcacggatctgaacaaggcttgttcgaaagatgacttcccactcccaaggattgatcaattggttgattcgaccgtgggctgtgtacttatgag

SEQ ID NO: 49595 - DNA, 2611 bp, Oryza sativa
ggaccaaggttgcaaggggtaagattaatgttttattttattactcctagttaacagttctgctaaatagtgccaccattttattttttcctttcgagtaaattacgtctacggtacataaaggaggtgggtgcgatctagcgcaaaaacttgagaaagagcatataagtgcaataacttggctagtgcgtgcattttggacttttggttaaaaggtctatattctacaccatactttttacgccatataaaaaaagccgccactcaaaccatctcgaaaaggatctacaagtattatatgttgctttcaattggtaagttataataataaaataatctgtcaatttaaaaccgaaagatatatgattatcaaaagtaaatgcatgactaatcaacatattcattatcgcgggttatgaacatggtgaaacacgaaaataaatccatgagccagcggtctagcaaagcttataataccaggattaatcaaaggtatgtattaaaactgcttaaaaaaaggtacgtattagtgttttggcctaaaatgcacatgattgtcaagtttatgtaccagtctactcattattcaagtccttacactaaatcgcactcacctaccaagtttttataccatgggtgcaatttactctgacctttcgctgtgtgtgcaccaaccctgttggtgtttaaattcattaactaaattttttttaccaggtttgatttgatcttttcgctatttgatttaggcgcaaaaaaagggaaaaacgtattgtgtattttagtaagcgtctatatatacacggccgtgtgttgcaagtttcacaagttgcataattttgtgtgtgtgtgtgatatataggatttgaacgggaacatgttcttcaagtagcgtccttaccatctcgcctataaagaactttgtgcatgtgggagagaagcttattcttttgacttcgcccctctaaaacttgtaatatataaattgcactataaatgatatcaaaaggaaaatttatcaaccacaaacttgtagatcacatcgagctctacaatttcgatatagagcacagctccatctgagttcatttaaaaacataaaagtttgtttattcaacaatagatttgagattttgtaacgaatatcaggacccgtaaaaagtctcgaatgaaaaaacattcaactatatagttgtagagctctccaattttcataaaaagattttcatcatacgacttcatatatatcaagatactactcctttcctattgtagtagtgctattatttttaagggtggtattttcaagagaaccgcctcaaaaattaatttttgcgtgcctttccatatgagaatcgccaaaaatgacatttctgtaggaagcccatctgaaaaaacttgttattctttgaaaatgtctaaactttaaagatttatagaaagttcattttaagttcaaatgaggtgaaccaaagttatatatgacccttacaatatttttgtatttatatttcagttagtataattgtttacttatcatttacctctaaatgagttggtatgttatctaacgtgacattagtgaataaccattctaaaataaatgttctaagaaaaatattaactaagttttactataagaagtactagaacgatctcggagaactttagtttacctcaataggacttaaaatgaattatctataaatttcttaaattttgattttttaaagaactgcttatagaaaaatagatactagagcttataaagatatttactacaaagttgtagatctagttaagttctacaattttaatatagaatgtctttatccaagatcgtttgaaatactcaaaagttcattttcaaaaatagatctgagagtttgtaacgcatatatatatttagacatcgatctaaacgtattatctaaaatgatgaaaaaaaactttcaatgtagatttcgtgaagagcgacaaattttataggcggtttcctaagaatttgccagttaaaaaataggatttcatacgtggtttataatcctggacagctaagccatcttcacacaggtgattttcattttgagttgcctgtcaagagaaaagaaaaagaagcctaagcctacgatttttttttactagtgacagttgatctaacgactaatatatatgatcctttttatatgcacagacatcaacgagtgtgatgtgtccaacaagaagaaatatccctgctacggcgtctgcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccatcgactatgtttttaattgtttctacaatataccattcaaccaaacaaagaatttcttataatgcctaaaaatataagggttgacagttaattgacaaaactaaaaaaaaaaatcaacaattttaaaaaattagcctcctagcacatgat

SEQ ID NO: 49596 - DNA, 3651 bp, Oryza sativa
  unsure (1)..(3651): unsure at all n locations
nnnnnnnnnnnnnnnnnnnnnnnnnnnnnnnnnnnnnnnnnnnnnnnnnncaaaatttcttcaaaaaagaggggaggtcatgccaaaatttatagtgaatttattttggtgattacatacaaatcggaggtgcctaaaaggtttgcaacttcatcctccaatgttttttttgtcatattacatttggagctatgttttgcacacttttttgtctccaaaatttagttgtcagttgatgagagagaaaatttgtgtggggaagaaagaatatatagaaatttagttgatttgctaaagaaggttttataaaatagttgagaaggaaaatatagtgaaagttaatcttaaataatagaaaacaaactaaaatgaaaattaaaagaagtaaaacacattaatattagtttaaaactttagaaatagtaaataagaattatttggtgtaatattttatgatttttgtataaataaagatatgtcattattgtatgactcttgaaagagtttgtaattatcttataattattgtatgactgtcattattgtaagaataattatttgtgtacgattttttttcatgtcatgtagatggatcggcaatggatgtacgctgaccggcggtccaaagagtttattgacggcgtgcattattttttgagagtggccgaagctaacaggcaaaagggttttatttgttgtccatgcaataagtgtaagaatcagaaggagtattctgcatccaggactattcatttccacttgtttgagtcggggttcatgccaagctataattgttagacatcccacggagagtaaggtgttgaaatggaagaagatgaagtggaagatgacaatattccggactttgctcaatacgttggatttgaaggaaatcaaacgggcgaggaggaaagggatgctgatggtaataacgttgcggataatcttggtcagatgttgcaggacgccaaggaggactgcgaaagtgaaaagggggcccataaattggacaagatgttagaggaccacagaacgtcgttgtacccaggttgcgagtaggggcacaaaaagttggataccactctggagttcttgcaatggaaggcaaaaaatggggttagtgaaaaggcatttggcgatttattgaaactcgtcaagaacattcttccggagggaaacaaattgcccgagacaacgtacgaggctaagaagatagtctgccctctaggactggaagttcagaagattcacgcatgtccgaatgattgtatcctatatcgcagtgaggagtacgagaaactagaagcttgccctgtttgcaaagcactacaatacaagattagacgagacaatctaggagaagttgacgggcagctaacaaagaagagaattcctgctaaggtgatgtggtatttccctataataccacggctaaggcatttgttcaagaacaaggggaatgctagaatgatgcgatggcacgctgaagagcgtcaacaggacggaatgctgagacaccctgccgatggttcgcagtggcgaaacatcgacagaaaatttaaagactttggaaaggacacacgaaacatacggtttggtttgagtacggatggcatgaatccttttggagagatgagcagcggccatagcacttggtccgttacgatgtgtatctacaacctcccccctggctatgcatgaagaggaagtacataatgatgccgattattattcaaggccccaagcaacctggtaacgacatcgatgtgtacctaagaccactggtcgagatgttaactgttgtggaagaaggaaggtgtccccgtgtgggacgaggacaaacagaggaggtcatcgaattttgcgtagaatttattgaagaccttcgcccaatcggggtacctgaatcacgccatgaagggagactacggggaaagggaactctcggaaggaaagcaataatgacggtagacaacaatttattccgtaaagcccatttcacggttctgcaacaatcttcattggtagctccttacattgagaagcacttgctctagttcccgccaggaacatcggtaagtccgatgcatggattatacggcatcacattgatacttttcccgtgtggctacgacaacatctcatgggtaacgagtcgatcaaccaacaacttgccttcctggcgaggggatcgtctgggtcgatcgcgacattccagggatatgagatcaatgggtacacattctacacgagagcccaagacataaagagcacgaaccaaaatagcgctgttcgtgtcgatgccatgggacacgatggaacaactggcacgtattacggtgccatcgaggacatatgggaacttgactatggtcctctcaaggtccctctgttccggtgccaatgggttaggttgactggtgaaggcgtaatgattgatgacagtgggatgacaacggttgaccttaacaaggttggatactcagacgaaccttttgtccttgctaatgatgtaacgcaagtctttcacgtgaaggacatgtctagcaaaggaaagaagggcagagggcctgacgagcctaagcgtcacgtggttctcccaggcaaaagaaaaatcgtcggagttgaggacaagactgagaggattacgatcagttggatgggcaaccccctttcacggtgacgattgaccctagcatcctcctatcaaatgaagataccccttactcacgtagcgatcacaaggagggaacaatagtgaggagaaagtacgtgcggtcaaccgtcaccgccgatgtattgccgtaattattgtgtacacgatgtaaactattttggatgtattgattatccatataaatcaattgttgtatggcatatgttaattacgcacgattattagaggttttaacaattttaaatcatgtatatgctgctagttatatgcgataattacaatttttaaaagttttaaatcacgcaggtggcattttcatatgttaattagagtttttaacaattaattactatcattcatatgctaattatatatgactattcgaatttttaaaaattttaaatcatgcatgtggcatttacatatgttaattagagtttttaacaattaatttaatatcattcatatgctaattatatatgattattacaatttttattaattttaaatcatgcatggcgtatgtatatacatatgttaattagagtttttaacaatttaatatcattcatatgctaagtatatatgattattagaatttttattaattttaaatcttatatttgtttattacgttttatccacttaatttattacatacaacaataatttttcgaagtaattatcattaatttttctacattaaataattttaatgcattattttctattttagaaacacatatgtaatggaaattaatattcagtgcgcttattagtagtcccagttcttaaccctaaccgggtttaaaaagaatttcgaaatagcgggaaaatatctttagtcccgattgatgagaacaaccgggagtaaagatatctttactcctggttgttctcatcaaccgggggactaaagatctaggggtatatatattcccgatgcgtgacctcgtcttctccaccaacactta

SEQ ID NO: 49597 - DNA, 30550 bp, Oryza sativa
ggaatggttggcctgggttggcttgggacgagctgggacccagggtcgggttgccagttcggtctaaatcatagaggccttgggttaaggcaggttcgtaagggttcccggccttgattaataatattgtgtagctctaggatcgtctttataaatggctttgagcaactaagtgacttttaaatgcggttttctgcaaaacttaaccccgatattattatccccttgtactcccttgcattaatcatgcatctgccggtgtgacttgctgagtactgtggttgtactcattcttgctcaatctttcccccccttcagttagagaagctttggagaagaagtcttaggtggagtcctggcttataccccagttgagcgcctgtgaagatggagccgtaggcccgctagtccgctgctgtttatttttgtttgtcaggtcttatgtgcctttgtaataatgtaaatattattgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgccgaagctccagaaggctgcaggatccgctagtgaagtgagggaagcagtgaagccagctgtgaagccggagtgaagatcttggagaacccgtcgcagaacctaagccaccctctagggtagagtcgttagtcgtgtgctcctttgcttgtgtgtgtagcgcgtggtttgcatcggtgggttgtgatgtaaccatgctaggttgtttgcttaatcaacttgcagaataagtgaaacaaacaacacatcaacaagaagagttagttcctttaaggtcctatctctagttctggtctattctttcctggcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccgagcatgctgcttggttcacagctaccattggttggaagtcaagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagctccttcctttggtttagcagggcaggcatcgctaaaccagcctcctcgcaccaagtcaagcttgcagcctagtgtgcaaagtagagagcccaatggagagaatccattgaatcccgagaattgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcatgacagttgacccagcacctcctaagccatggtggcagagtatctgatagtgaagggtcagatcaagtctcctcggatgatgaagatgagtctccccgacatctcggcgaggaagaaatggaatcaaaggcatgcacccgttgtggagaaattggacacgttgctagcatgtgtctcacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacggttgtctcatcagctagtcagctccaatagcaacatcgacaatatcatccacaacaccaatgctcctcctgctccacctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaataccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggtttttagttcgctacttatcattgtgtaatcgggagtttgcagcaatcatgtaataaataaatacattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttttaagaggattctattggaagatgcggatatgtgatcatgtgtataattgtttactgataaaggagacctagggtctcatttcagaggaatcatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcgggtatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacatcaaggtttcactgaaaggcagcaagccaaaggacttcatcgtccccagaagcgtccgcaatccacattaaagagtaccacctgttagagataagccgaaagaagattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtgtttctttgaaggcaaggaatgaaatctttaactcggtatcagatgctacacggagtgaaaagtgcaagcaccggttaccaggcaatgccatgtcttgggagatgatccaatgggaaagagcacatcaaggttaaaggtgtaaaggaatacgttgaatgctaactaaggacaacctgaagataatagtgggaaataaactgaatgtaaagaaagtgaatccgagctgcttgtttgtgggagctattcccagttatgaaccaagtgatatgttcgaagatagtctacagaggtcagacaacgaagcttcagatttggcaggataacgatcaaacaataagaaatccagcaataaagccatttgggaagacgtcaaagtatgtcaagtgggataagttggttctcttgggaagcataattcaaaggcaacgttatcgacccttgcatcaaatagcagaagtagctattacccggagaccgggaaagctaatatgaggcagctggtggcaagttagaagtgaatgacaagcatgatattcttatgatgacaaacatggtatcctagtaatgacaagctagtgttgacgcatgacatgaagtggtaacttccatgaggttgacgccaaaaatatggactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaaaccctaaaaagtcctttttccccccttcccctcttgggccggctcggcccatctccctccctctctctcctcctccccgcggcccactcggcctctccccgcgcgcgcgccgctgacgggcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccatgattccctctctctttccccccatttttccctccctctctccctcggattcggttggaaaccgctcccctaatcccgccggcgccattgatggcggccgacctcccgcgccggtttcctcccttccccggccaccctctctcgccccggctctatttaaaccctccccgcaccccctccgtccggttccgcctctcgccgctctctctctccgccggaatcgagctcgcgccgtcgctctctctctccgccgtcgccgccgagctccggtccgccgccgtcgtcgccccggacctcctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgccgttcccgtcgccgccgtcgacccggggtgagccgtggaccgccgtttcgcttcccccttccctcccctctctcgggcgccgctccgccgcgccggtggtcaccggcagcgaccatcggggcgcgggtgcgccgcctcccgtcggctgtgccggcctggccgccttcgggcgcgccccgcggctgccatgtggggcccggccgtcagccgcccgcgccctcgggtgcggctgacacgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaaatttaaatgaagaaattcgcaaatatccatttaaaaagcatataaacttcaaattgccataacttggccatttgaactcggaattggaccgttcaagtctctaatttttccttaagaagtcaagaacccatttttgtgctttgtttctgcttgttatatggagtttattagagtaaaagccgtttcttttccgttggacgtgtagacgctgcagcttcggaagatccgctcttcgtggaagttgaagccgacgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgacattattattgctattgttattattaccttgttcaccctaggaaaataaaaccccaactagtgggtactctatttatggttccactagtgtgaacttaggtagatgtttcgctggttaattaggcaacattaggtggttttataactttagactctgggaaatctcatatcatttggacattatggaattgttggattatggtggaattggacatacccctcccttcctctttcaaagcccctaaaacctgtttttcggtggggtttgggtgcatgccagttgtgggaagtagcaccccggccactataaggattaagctcgggcctctgttgcaaagcactatcgtacttccacatgtctagtgggtaaggcttagtttgtggctcactctggttataaacaaaagtacacggatggagatggacgaagtcgggggtcgatggacatctctaggacaaatgaaggctacacgagctgcggcccggtagtcgagatgtcatggcacagggctggtgtcctgctgctagggggctcaatcctgcctgcctgtcccgggggttccggccgtaggtagggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtgtagctctaggatcgtctttataaatggctttgagcaactaagtgacttttaaatgcggttttctgcaaaacttaaccccgatattattatccccttgtactcccttgcattaatcatgcatctgccggtgtgacttgctgagtactgtggttgtactcattctcgctcaatcttccccccccttcagtaagagaagctttggagaagaagtcttaggtggagtcctggcttataccccagttgagcgcctgtgaagatggagccgtaggcccgctagtccgctgctgtttatttttgtttgtcaggtcttaagtgcctttataataatgtaaatattgttgatataataaagatgtgtcttttatatcatgtttatgtggtgtaccccggcttttcctgggacggggattaatacactagcgttcgggaaaaggcaattttcccggtcgcgccagtagggttctaatatacgacagttagactacgcatatatgactatttaagttttagtataagattatttgagttttaatataagattattatatttgtaattagacttagtatataattattgactagctagggtcctataatatacgtcacctagacttagcatatatcactatttgagttttagtataagattattagatttgtaattggacttagcatataagattgtgtagggttctaatatacgacagttacacttagcatatatgactatttgagttttagtagaagattatttgagttttaatataagattattatatttgtaattagacttagtatataattattgactagctagggtcctataatatacgtcacctagacttagcataaatcactatttgagttttagtataagattatttgagttttcgtataagattattattgttttaatatacgattattagatttgtaattagacttagcatatacgagagttagacttagcatatacgatagttagactaagcatatatgacttcgcatatacgacagttagacgtagtatgtatgacttagcatatatgattgttagcatataagattgttaaaacataaatgtctcatgacttagcagcagtttcctgtatgaacatatggctgatcgcgatgagacatagtatgtatgacttagcatatatgattgttagcatataagattgttaaaacataaatgtctcatgacttagcagcagtttcctgtatgaacatatggctgatcgcgatgaggaacagatattgtacgatacaatcgcggagggaagcagccagtactggaacgaagaagaggggaacgaggatccaaaccagtatttgaacgaggaagggaacgtggagagggatgcggaggggaaccaggaggagcacgtggagagggatgtggaggggaaccaggaggaggaggctagtggaagtcaaccctccgctggacagaagagggcacgcgggcaacgaggtgccgcaaagaagcttgagggtcggcacatcataacggaagtggacgaagacggccgacctagtgccccggcagaagccgccaagaactatgtacgtcacagcggttgggttgtgcgggataacgtgcctgtcagtacggtgtactggcgcagaacaagggcacgcagagatcatgagagctttgtcccagattcggagaaagagatgatgtggaccacaatgctcgaaacattcacccttcccgcgggtacagaggacaaagtgaaaaggtggactctgaagaaaatggcagaacagtttcagagcttcaagggagatctgtaccagaaatatatcctgaaggggcagacaccgaacttcaacacattcccaaagctaagggatcactgggacgagttcgttgcatataagacaggtgaaaaagggcaggcgatgatggaaagaaacaaagaaaatgctgccaagaagaagtaccatcaccacttggggtcaggcggctatagcatcgtgatgccgaagtgggaggagatggaggctagcttgcttgagaggggtatcgaaccggccaccgctaattggccggaacgatcgaagttctggtactatgctcacggtggaacgctcaacccagctgatggctccctggtcttcggcgatcagatatgcgaggctgcgtgttgactaacagacgcagtggaagcctcttcttagggcacgttccgaccggacagagagaaggacgagctgtcactcgccctgcagactccagagcatccaggacgaacacgagagaaatgggtgattccttggaagattgggttcaaggaggacatccacacgtataggagtcggatgaggagcaagagagataccgaggcgaagattgcagatcttgagttcagggtatcgagctacgagctcagcatgcaagaggaggtggcaaggaaggttgatgaacgcatggacgcacatcggtcccatgatccctagccgaccatttctcctgcaatggtgagcccgtcaggaaatcgtagcagctgcgcctcaacggggcaggtaggatcacagagcatggacgccatgcaaacccaggacgaaaccacctgcccggtgatgacatcactcagcggacaccatgtgagctgcatattcccttcaagaacttatcaataaaggtaagctcgtagtttatagatgttagatttggccattccgctagttgctgcttatatatgttgattactaataaataacctctcaccacatgaaggtggcgtcgggcatggccatcccaacggacccttcaggtacttaccactgtaggccgattccagcaggatactccaaggtcaaagttgagttggtcgaaggcgcgtacgaggacctcgagctggattaccctggaggagacggtgagacgcatctacgagacacaagccacgccattattctatggcacaagcggtacatcatcctccctgggtgacaagcggcgtctcgtgcaccatctcctccggctccgccatctcctcctcaggctcctgcaccgactcctcctcaggctcctacaccgactcctcctcaagctcctcttccggcaccttccaagtcaagggcccccaagctccaccgcctgcccccacaagggcaacgaagaaggcgaaagttgacaccgccaagaacaaggacccagggtacgattgcacgcaagaggagcttgacgcttacgtggcattagaagtcaggagacaattgaagcctcgaagtccagaaaagaagattcctatagacccgagtgtcaggaacttcttcaggggtatgtatgcacctgccaaggaggccataaagctatcggactatgagcgaacactcaagaaagcatcttctggaaagtccaaaccagtccctcagcttggagagcaactaaaccaggagatcgagccgttggtgaccggtgaagattttggaatacaagactttattaatgacaccggactaactacggatcaattgctacgagacgcaccaatcgaaaaggcggaagtgaaatacatgtacgaactcggtaaaccgcttgtcaagcttgagctgctgtagtccctacccacacaaatgtacaagtaccattagctgtacatggagatgagcgccaccggtagagagatgatcggagcgaggatcagggacacggacttcttgcaaggagatgacattctctggatcaatttcaagggattctacgaactataccagctggacgccctcgacgtctttattatgagttgctggattttgtaagtatatcgttcagttagatttcttacaacgtttcctttaattaattaggtccttgtatataagtagactatataaaatatatactctcttttatcgttgtagaatggagattcaaagggcccgacggcggggggttttcgatactggattcatcgaccctcggaaagtaaacgttgcaatgctcgaccaatatccgcaagccacagaggacaatctcgtccatctcctgaaggcgcagcattacaagatgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagataggtactgtcataagttcctatgttaattaagaatcttgttatagttaatttctactacgaatcatagctttaaactccatgtggggcttggtattggttccgtcatttgattcgcggcaaatggagagaaagacttagcggaagttcaaatttcctgtgagtacacatgctctacatttatatttctccgcttcaaatacatacaagtatatattaattagatctctcgttgtttgtcatttatttatagtgcgcaaagcaaaagcagggaattaacttgtgcggctactacatgttcgagtattgccactgccttgcagaccaaatcatcaccacaagagagcttgatgtacgtacaaataaattcaaaatttcattacgtatcggtttgttgtttaattactaatcaatttcatacattcatatagtttattcgcatgagggataacctgatcacacacaaggaatttatcgcggcggttcaagaacaactcatgggattcatcaacgaacaaatccttgatcccaagggtgaattctactacgacggaaatacaattcataggtccttatcgtctgagatagcgactactactacgtcaaaatcgtagctagctaggacatataatggattgtaattaatacatgactatgtttctatatgcatgtgtacacattttctataatgtaaatatatattttggtcatatatatatacatatgcatttgcataacatatatatatgtataaatacatatatattatgcatgtacatatgtattgaaacatatataaatataatataatatatatatatatacatatatatgtgtatatattgaaacatatatatgcatggtttatatatatatataaaccttgcagcaacagggccatgtaaaaaaaaaaggtcagctcgatctttagttccggttggtaacaccaaccgggactaacgatggctcagccggccacgtggttgagccaccaaccgggactaaagatcgatctttagtcccggttatttcacccgggactaaagatagcgatctttagtcccggattggtagtcccggtttggaaaccgggactaaagggggtttacgaaccgggagtacaaacgctttctccaccagtgctagttcaacatctaaaaatctaaatgtcatgcaatccgcaattgtgatttaagatatatatatatatatacatatatatatatatacatatgtatatatatatatatatacacatctctgtggtcggtaggagggagctcgctagctgcctttcttttttctttctgcatgcggctgtaaatataatcctatgatcatgtcagcccatactcccatgtgaagatttgagtacccaccaaaaatgtgttttttctgtcgagagtctcggacacaggcatgaagtacagtatctagctattttgagctaattaatggatgtgtgctcacaagagcaagttaaatattagagctcactactaattataagcctatactatagcttatatatataatcagaaaacagacaacggtatcctattggaacgggatacccttttatgagacagtacctgatacctctgttatggtaccagctgcatagtactcgatacctgtgatacctattactcggtacttgtgatacctaggatctaatatctgtgatacttgtgcaagataatagttaatatgtctatgccattgtcgcgtcccaaaatgactctaaaatacatcctcgaaattatgcctagaataattaaaatccttgtgaaagcctcccacaagtaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaatcctaaaaagtcttttcccccctccccctcttgggccggctcggcccatctccttccctctctctcctcctccccgcggcccattcggcctcctccccgcgcgcgcgccgctgacgggcgggcccgcccgccaccctcgctgacgggtggggcccacccgtcatccccttcctcccgccgctcccgccgtctcgcccgtgccctagcgccgccgccgccgcaaatcccgccgctcccgtccgccccgcgtgcaatcaagaggggggaaatattccccgtgattccctccctctttccccccatttttccctccctctcttcctcggattcgttcggaatctttccccctaaacctcgccggcgcatcaatggcggccggatcttccgcgcccgtttccccctcatccggccgccctctctcactcccaaccctatataaacactccccgtgcctccctccaccgtttccgccactcgccgctctctctctccgccggaatcgagctcgcgccgtcgctctctctctccgccgtcaccaccgagctccggtttgccgccgtcgtcgccccggaccttctcccgcttcggcgccgcctcctttggtttcgccgcaacctcgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggccgcgaccatcggggcgcgggtgcgccgcctcccgtcggctgtgccggcgtggccgccttcgggcgcgccccgcggctgccatgtggggcccggccgtcagccgcccgcgccctcgggtgcggctgatgcgtgggacccacggcgccggccggtgtgagccgggagcacccggtccaccgtggaccgtgaggctgccgcgtgggccccactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcagaattggaccgttcaagtctctaatttttccttaagaagtcaagaacccatttttgtgctttgtttttgcttgttatatggagtttattagagtaaaagcctatttacctttgttatgaccttattattgttattgttattatttccttgttcaccctagattaaacaaaaccccaactagtggacactctactcatggtaccacttgtatgatgttaggtagatgcttcgctatttaattaggtaacattaggcggttttacaactctatactttgggatattcatatcacctggacactttggaattgttggagtattgtggaattggattcacaccgcccctctattcaaaattcccaaaatggttttaggctgggctcggggtgcatggttttgatagtagcacctcggccatataaggaccggtcttcgggcctctgttgcaaagtactaccgtacttccacatgtctagtgggtaaggcttagtttgtggctcagtctggttataaacaaaagtacacgaatggagatggacgaagtcgggggtcgatggacatctctagggcaaatgaaggctacacgagctgcggcccggtagtcgagatgtcgtggcacagggccggtgtcctgctgctaggggctcagtcctgcctgcctgtcccgggggttccggccgtaggtgggattgggtcggtactcttgtctatggctaggatgggttggaaactatgtcatgtcttccgtccatataccatggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaatttttaaaacctgcttaacaactaaaatgtggaatggttggcctgggttggcttgggacgagctgggacccagggtcgggttgccggttcggtctgaatcatcgtaggccttgggttaaggcaggttcgtgtgggttcacggccttgataaataatattgcatagttctaaaatcgtgtttacaaaatagctttgagcaactaagcatctttaaatgctgtttactgcaaccctaaccctttatattataactcccttgtaatcccttgcatttattatgcacttgtgggtgtgtcttgttgagtacggtggttgtactcagtcttgctcaatttttcccaacccagaagaggagcccctcgttgatgaaggctttggtgtctagctcgtgcctgccgtcaagcgcctgtggtcgtcgccctagtcttccgctgtttctcgtttgtctttgtgtgtgctgggccttcgtcgcccatgtaataaattatctatttatgcttccgcttgttaaactctgaattgtatcaactcttggtgtaccttgcctcctgggacaaggaataatacacgcacgaaaggaacgcccgttgggttaattccggtcgtgacagccattacaacggaatcctgttttgtagcagctctctatagattttgccttgaaaactactatcacaatatcataaaacttatagtattttatattctaatataaaaatgccacgatatgagcacctaacaccgacctgaacattactagttctcatgaaaaaaaaagaacattagtaattaattaattaattaattactaaatttgcatgttctagagtcacatccgatgcaagccacgcacaagtctgatccatcgttgcggccaccaaatcaatatatatatgtagctaagtccacctctgctccctactggtgttttttgcgccttaaagcgaggataatagtaagctacaaataagctattgttaacttggcggttcccggtgactcctcaattacgattatgggatttactgacatccccaaccgtcattagcagctataaaaggatgtcactctcttacttataacacactccttaaggagctattctctctatttcatattgtatctttataatatttgtggaaataggttaaaattatcttcggtcctatagttttcttgagatcccagtatgcctttagcactttacttttcttgtaagactatagttgaattaatagaattattatttatatattcttattttcataatttatatactgctttagtagttatgttctttatgaataggatgtaattcatttatatgtttcacttgactaggtaggccagtcgatctatattgaggtaacggtccaacgaccttgatgggttgctctagctctaacttgtccatccgaaaggtgaaagtcccgagggagttagttttattatttactaccataaatatggtgcttaggttagataaatgccattgggtgtgggtgtgccccacggaaagtgagggaggcaacacgtggtgacaatcctctgtatttctccacgattgggtatgacgtaagagtgcataaatgacataaccaagctggcagactagcatggagtgattttttagtagtatttgaataccaagaactaagttctagccttgtgagcatgtatgtgtgcatcgcactaccccttaatcatatttatcctaacccttatttagactatggtaagttaattaattataggttgactaatgatgtataaactatgtctttacactaccgccttctctgcaaaaatataaataagatacccttagaaatactcatgggcgaagtgctataatgatattcgtgtgcttgtgaatttaactgtgaacgtaagaaataccattagctataagcttatgtgaaagaaagagagaaagaaaaatagaaagtcttagctctcgtgcaagagctaattctatcaatgttccaaaaaatatgcattaaattcatagtgtgagaaagaataaagagggaaaaacatagctaacctattcagaaaaactacctaacggcatcccgtggtgacgggataagtggataaccatccattcttatcagttctctttctgtctctctctctctctctcgccgatcctcgcttcgtcgtcatccttcgccccactctccctctgtaacttctcttttcgttcctagcagaggttgggacatgattccatggcaagccctttaacaagatcggaatagtccagcgcttgctgtgctaatgtcgcatcaccgacggtggccatggggctctcgcatgccagggtcggggaagagatgcaacaagttcaaggtgggagatgagttgaggtgtgtcgcagatgatgtctgcaaccatcacacttgtgtgggtgtcgaggatctgggcaacgatgctctggatcgaggatgacaacaagaatgaatggcatccctccacctctaaggaagtaaccatctcattttcgcgcttgcctttgccttctttcctttctcttcatggctctcatcagtgtgaatacatagtactcacagagtatttgatgcctgggtatcaagttcctgatacctaggtatcgagtaactggtacccagattatccggattagtaccataagtagcaagcctgatacctcaggtatcagggtaccaggtacctagggtctgacacccataggtaccaaacctagtactgatatcgggtacctaggtatcaagtacttggtatctagatcaatttgatacatgtaggtaccagatacctagattgatctgacacccataggtatcagacctagtacgggtattgggtacctaggtatcaagtacttggtatctagatcagtctgatacctgtaggtaccagacctggcactgggtatcgggtacctaggtatcaagtacttggtactttgatcagtataatacacatatgtatcagacctgatactaggtatcgagtacctggtacctagaccaatctggtactcaaaatggccctggtgttagcatcataacaatcgaaacgggtgtgttgtgtctctagtgagaagacgtgcactgacgtgttatcccttgtgaggacacgaagagacgtgggctgacacatgaaccctcacgtggggtgaagttgataaaataataagagaggttagttggtcaaatagtcatgctcattaaattatcccgttggaacgggagtcagtgctctagcagtcctcaaatctatagtatgtatatatattttaaaactatgcattgagaagttagtgatggtcatttttaaaattttgccgaagtcttaaccttaaaacattcatcactggaggaagcggatatattccatatcagccaagtttctcaggagaagtatttaaagcatcttcttttttatccaccctaaatcaactagtacgatacattgaagaacaaacctttaaacaaatgccagtgctaacgcaatgccctgcaccgaaacacaccgcataccttatgtgcaaaccatagcaattagtgaaaagtgcatagctatagagatactagaactttggaaaacactagtatgggacgtccaatccctaacaaaaatttcaatgttcccaattcaaattgactacccattcctcttcccatgaaatagctctttttagcacctttttaaattattttttcctacactatttatctgattcatcttattcatcgtaattaaatctttaccataagatctcacaagcttatattttgacaaaaaaatatttgtttcaatcattaaaatttgatgtttcacatgtaaacaagcaagtgtttcaactagaattccactttgttgcacttttttaatggtttttttaagtgttgcacatgcactactacaaaaatggtttttcctggcaccacatgttttaatttgttggcgggtaaaatagaaaaccccagtgaaaatacaacatgaggttcctagttagtgaccgccattgaaaatctatttttgcaagcggtcgtcttaagagatctgccattaaaaataacactgtttttacagacctcttaagtgaccgccaatgaaaatcgattttcgctagtagccactgaagagcatcgtcgtgaaaaactacagccctattaaaactctccacgccctcccccctctagatgtctccagtgacccctccaagtctccttatccctcctcctcttccttcctccttccgcacgtgcagggggttcggcggcaacgaatcgcgaggagggccggcggcggtgactcgtgaggcagccgatccgatagcaactcgcgaggcggcgggtccggcggcaacgaggtgcgtagagggtggatccggcggcggcaactcacgctggaggctgatccggcggcggcgagtctagcagcaacaaggtgcgccgatggcagatcctgcggcggtgagtcacgcgatggtagtggcgactttcgtgtgtaggggatccggtgccgagttaggcggcgtcgactcccaagggcggtagtgggcggctcgccgacaaggaagacgagcggtggcggcagctcggtgacaaggaggaggagtggcggtggcatggcgatgaggaggaggggcggctcgtcaacgaagatgaggagtggtgtgttggcaactttttgtgacaagtcgataagcacgatcgcagcacataaataccttgcggtgatatagagtcgccaacctccttaatctagccaaaagaccaaatcaagatgggttttctagaaaaacggctaagccggctagcggagccgatttagagatcaaaatcagcctctaggccgatttttctaggataatttcctgtcttgtgggaaaaacggaaggttttcaggacaaacctacaaagaggtgtcgcactctcgcagcggtagcggacgatttacagcgcatatcgacaaagatagactaaaactagggtaaagtagaaaacatggtaaaggaacgattcaagtagattatattcgggattttacaatgaaccggccttgacccttaaataggggttggtcttgccctctacaggcccttcttcacatccaactcgggatagaaataaaaggaaacatgaaacatagccttctcgagcaaactcgggctcggactctgccggtcagaccggccacacaccgccagtctgaccggcccactgtcggaggtctgaccggccaacacacggcggtcagacaggccctcatagagaaaaaccagcagacttccaaactttgaaaattttccctattttatccctaggtgccaaatttgggtgtaaacacatctccccccctccctttttgatgaatatcgagaacctaaaagcatagaacatgttgtcttagggcgataatccaattacctgccatggaacttcctaagcatcttgccaaacgctaagtatttcttcaagtatttcctattaattgctctctgaaaacaccatcttaaagtgcctccatctctttcaaagtgttcaaacacttaccgatgacgtcttcaaaattacctcccatcatggtctttaatcttcaaccgacaagtcgtcttacttgaaataccgaagagagccaagacttacctcaactggcaaaatggcttttgtccagaaaccaactcaaaaggagtgacttcggtagcaccatgcttagatatcctatgagcctataatgcttccgaaagcacttcatgccacttcttttgacgttctttaatcttctctttgactaaatttaacaatgatttattactcgactcggcttatccattggcctgagcatagtaagaagaagaactccacaacttaatatcataagattcggcaaaacttctcacctccttggacataaaagaagctccttgatcaaagtttaaggagtaccgaatctatgaacaatatgcttcaaaacaaagtcaattacctccgtgtaaataaaattcatgaacggcacggcttcggcccacttggtgaagtaattcatcgcaattagcacgaaccggtgcccctttgatgacgaaggataaatttgaccaataaaatccaaagcccaacctcggaacagccatggtttaatgataggattcaacacagcggtaagcgctaattgaacattgccgatccgttgacaaacttcacatcctctatagtacttgaaacaatcatcaatcacttttggccaatagaatccaactctcctaagcaactaatccatcttacgggccgatttatgagttccacaaatcccttcatgtacttctcccatagcaaccttagattgatcattatctaagaacttcaaaattactccatctatttttcggcgatataactctctatcaagcaaagtatatttgaacacttgccgccgaattttccgatcaaccctaagactaggatctttcaaatattctattcaaagggattctctagttttcttttgactcttgggcacaaatatccgaattaataattaattcggcctttgaatcaattgtaacgtgccccctagctctctacccaagatcggtcagaccggccacgcaatgccggttagactgccttgtctgcacggttagaccggccatgcagagccggtcagaccgtaggtccaccactggtcagaccggccgtgcaatgccggtcagactgcccctggtcacccgaagattaaaaatcaagcaccgacttttctagtataaaaaatactcctttcttcatattatagccagatgcttggtgtatcaaattattggaccaaaatttcttatttttagacatacgaaaaattataacatccaactaatatgtctagatgaatactaactcaagtggcttttgaaacaataaacatcaaggcatcaaaaacacttagccacttgaagtatgatcaataatgaatcaccaaagtcatatgtgtcacatgcatagattccaataaactacaaatgtaagtaatcggcttgagcatgtatgcaaaatattaacaatgccaacgttcctaaagaaaaccactctagagcaaatcatcacattgaccattgacattagccaaattactaataagcaaaactttcatggtgcaataattatgaaatctatatcctctgtggtgatccataaaaaaaacatgatttggcttttaataaatatcaaagactcatgagccaaatcatacctcaatcaaattatatgccaacttaccgattctactacttagaactggcatttgcaacatgtatgtgtaatgtgaatttgataagcaaacacatgtgctagatagcaagcaatgttctaacatggcataggcatataatataatgatgaacacaataaacccataccttgccttagcatccaacaaacggcggctcaaagatgaaatgttatatccatcaccgttcatcttctcttgatttcttcatgagcatattaatgtcttgccccccgagtaaaatcgattttcttgattgcacgatttcgaaggcaagatgtataccgcactaacaaccatagcatcatgtgaaggcaacttttctctaatgaccgatgattcttctctcaccaaattaaatctatcactactttgggaaatcactagtctcttaacttttacttctttaggtctccacatttgcttagatgctgttcgaggctctaaattattacatgttttgttctccacatcttcggcctccttttcttttttatctatggcccgaagacgttgtagcctcctcttttgagagcgagataagccagaaggtatccactacggctgtggttgtttttcaggagccaagcaatgattcttgatatctttggttaaagtagaagctcctgtgttactctcaattttctcactcttctctaatgccgcccggtcagaccggcctctgggcccgatcagaccggccgtagtctggcggtcagaccagccagacgcctcagtcagacctccgcttttgacaatcacggtgtcggcttcgatctcctttgcttgtatgatttccaccgcatctacagtaagtacttgaacatcttgagactcctccttgataataacgaccgccagagctttggcttcttttctcacccacaccttctttacctttttcacctttgatccaccggaccgattattttacgagaaacggtcttgtcttgaattagatgaatgacttggtactgacctaggtgattccttccatccttgatgaaacggcgtagagaattgaggcatccatggcatgtaatacatgaaaggataaccaaacggtgacattggatatggataccttggcatcacaaccggaggtttgtatggagttggtatagttgatggctgcgattgctttggtgtttgtccaaatctcttcctacgagatgatcttgatctttttgaatcactagtttggttatgaaatcgttgaccagctaatcctttcttgtacttagccataagcatctcaaaagtgagcttcaactttttagttttttgggaactagatgactcatcctttgcaactttatgatcttcggcctttgaattattgatcctaattgtcttgggccgaggatccctaataataacacttttccatttctttttgtcaacatcaataggactaatagagagaggatcactaataattccggtcttaggcataggtgtaaccgaaatagttccacaagtgaccgatgaatcatcaatcaacctttgctccatcaagcttacatctttaaaataatcatgaaactcatactccatttgtgaccatgtagagattgaactaggagcaagtaaactataccatgtagatgcaaagtttgacaaagaaagaggaaacaactttaacttaagcaaatcattactaccaaccttaccacattgatcagtaaattggccaatatgctccattgtagtcatagcattctgacctgttaatttcgtgaagttgggcacctcaaatccttgcgggtatgggaccgaatctacatgtttaggatatggcctttggtatgtatgcatagctacttacgattctatttcactgctataccgcaagacattgtcatcatcttttccaacattcacatgaccgatttgtgattcggtcttaggtaacaatgctatttcagtttcgcttgtgaaacaattcgaaccgtcatttagtttagttatactctcaatggtgtcattgtctaaactagcaacacaatccgaaccatcacttggttcggctattccatcattgtctaaactagtaacataatcataatcatcgcttggttcagctatattggttattgcattgttatccaagttagtaatacaatccgaaccaacatttgtttcggctatacttattatggcactattgcacaaattattagcacaatccgaaccatcgcttggttcggcaatacatgaaattgcactattatctaaactagcatttaagctattgtcatccactcggctttcctgagccagagcttcatgcaacacatgatcaacatcaagaaatatctggccattcaatctctctttaataaaatcaagcaatccatcatatgcaatgtcggccaaatctttgtcaaatattttcaaactaacacatcggcttttaatatctctaaacctttcaatataatcagcaacagattcattgtatttatgcctaatcgatgataaatcagataacctaagctcagtttcactagtgtgaaaataatcatgaaatttttgttctaattgagcccaagtatgaatagaatttgccggtaaagaagttaaccatgtaaaagcagtaccggacaaagataaaaaaacaaacgcaatttacatgtatccatattactagccctaccacattgcgctaaaaattgacctacatgctcgcatgtggtcctactatcctcaccactaaacttggtaaattcagaaattctataatcacgaggatatgggagaatatcataataatcaggatatggcttttggtactctctagcacgattccttggctcaactgcgaaattttccctgataatatttctaagccaatcctccacagtttcaggcctcggtgaatctagtggtgggtttggtggcctaaggggtggttgttgcggcacaatattattatactggccatacccagtgtcatgagaatatcctccattaggatcattgtaagcattagggattagggatgtgtggagtagtatgactaacggtattaataggtttataataattaaaatcagtactgctagtcgtggaatgaaaacctggagaaatttccagggaaccggtctgaccggctatagatagcccggtctgacaggccaagcacccggtctgaccggcccatggcccagtctgaccggtggtcagtggtgcggtcagaccggccacaggaggcgctatctggtcaggatagggcacggtctgaccggcgtagtacacggtctgaccggccatggtgggtacggtctgactggcataggatgcggttagaccggtgtcacgaccggtcatgtcgttagctaggttctgcatatagccgattcctgcgtaatcggatgtataaacatccattgacccccatagcattataagcatattgtataggagcaaaactagaagtagcatatgcatctacacaacgattattaaccttttgaatagcaaaggacgagttgggcgaatcggaggttacctttggtgaaactacaacttgaggtagcgggacgttctttttcacgacgccttgatcggtcctaatgtattgtgtagtaatattgttgaacccgtttccgctcgtcatagttgatgaagaaattccttcattaatttcggccatatagctcatagccgaaatctttgatcgaataaatttgatttcttgatatgtcactgtgtttagccaattttatcaaaaactagcctttgttgattgatacagggtactcggtactgtagcaaatataccgaaaaatcaaccgatctattagattcgatcggctgctatgtttttttttttttgttttcggtatgtgggcagaaaaaaatcggcttttgatagcctgatctctcttttttttttagaactcgtatactcagcaaaccgaattgagtaagattcaaattttcctgccgtgtacagcaatacctgctgctgttgatcggtagatcgactctagtagcctgatcttttctttgttgccgtgtgaaacaaaaaggaaacgttgctaagccggctgctgcttcctgataattatcttcggtacacacggcaagtgctatatgaatttgatgactaccaaatagctttgccgccgaatagatttagcgataagaacagtgcagcggctataacaattaaggtgtagattaatttcggccgtttggcggaaacaaactgatttgacgagatgactagagtaaaccaaattcggctgtaatatgaccgaattgatcgattccccagggagtgctcaaaaatcgtattggcaacttttttgataagtcgataagtacgatcgcagcatctaaacgtcttgcagtgatatggagtcgccaaccacctcgatctagccaaatggccgaatcaagatgggttttgtagaaaaacggctaaaccggctagcggagccgatttagagatcaaaatcagcctctaggccaatttagatcgatatgaggataactacgcgtctcgtgggcaaaacggaaggacaaacctacaaagaggtgtcgcactctcgcagcggcagcggacgatttacaacacaaatcgacaaagatagactaaaactagggtaaagtagaaaacatggtaaaggaacgattcaagtagattatattcggggctttacaatgaaccgtccttatctcttaaataggggttggtcttgccctctacaggcccttctccacgtccaactcgggatagaaaccaaaggaaacacgaaacatagccttccctagcaaggaaactcgaaacccgatgaaacagactcgggctcgggctctgccggtcagaccggccacacaccgccgatctgactagcccactgtcgacggtctgaccggccaacacacggtggtcagaaccggccctcacaaagaaaaaccagcagacttctaaattttggcaattttccctattttatctctagatgccaaatttgggtgtaaaaatggtggtggcggcttggctcctcagacctgtggtggccgggcttgatagcgacagcctagcgtaaccagcaggagagaagatctggagttggtgacccacctcgtcgtcgacctccgtcctccctaccgctgactatggtgtcatgtagctcgattttcatttttttttcaaaatctggatactgttttccatttttttaatccaaaaaatattttcacttgtggttgtctttatcttgccgccagtgaaaatagtttttttttttgctgtcattcgtcgatgtaaatccattttggccatcagcgaaaatgacctttgtagtagtgatggtgttatttggatgtttcaagaagtactttttgctgtttcacttgtttcaaatgcaaataatgcatgcgttgtttttggataagcttaaagtatttagaaatgtttcacaagctcatttataacgattgcacatggtattatttgagtgtttaagtaaatattgtgtgatgtttcaatggttacaacttgatgattcatgtatctaataaaaatgtttcaatatattttttatccgaaatataaccgagtccgatcttattgtaaagatttaattataacgaatttaagggtgcacttggatagcatattcgataagtaatttagaataaaaagtgatttaaagatcgctaataaagtataaaagagaaaagataagaagagaagatactgcaccaagtgtatgcatgcatgagcaaatagcctaaacacaagtggttgaaaatactatagatttgtagcccacgcaaaaaggtatttgtagcccacgcaaaaaggtagtaagcagaagatgttggcatacgcgtaggctacgatagtataaatcaaaattttctatcgcgtaaaccaggaaccatgcaagtattagattatagatcgttaccactcgacgcgctgcgcagcgaaagaagacgctgagaagtcgaaggaactctcgcgaagaagcacaccggctcgaccttctcctcctcgtgcgttctcctcgccgtactcccatgccgatcagcaccgcaaaccagcagtgcctctaccggtatccacacgtacagggacggaacgccacgcgcagatgtgctagcacccgcgcacggctagggttttgctcgggggagggaagtgacggctagggtttctcgcatgatgcaatgcctccgccggccacacccctcacgaatatataggatccatcactcgggcctccaacgcccgtaggactcctattcggatccctatccgaattaagctcatattggatctccatccaatccccttattccggcccattaagcgtccgaccctgtaggttcatgtatacttggctgtaacccgaaaactctttttcggtccacgcgtcaatagcggcccctagtagaacgtattgacacaccgggcatacataaagatcatatcggctgaacctctagtgtatacttgtatgaacccctttgcctcatgatatcgattaagctcaaggctagatatgtgtcatcctctaatagctcaatcattcactcgaacctgttgatagattatataacttgtgattgactcctcaatcacctttgccatggccatgaacttccataatctacaacatcgaggggctcagagatatctctccataggaggggcaaatcccatcttgattattcatatccaatacatgtttcatagcatacccgaaaactacttttataacaacccaattacggagtagcgtttagcagtccctaagtaagctacaacacatgttgggaaccatgataatctcaggtctaaggattcaacaccaacactaaatgagataactgatgacacaacacatatggctcttgcagtgtctcatgttgggtctatccaacaacatgttcactaacatgtgtccacattattaatttggtatctctataccatgatccatgagacatgatcatcaattaatacatgtgctgatcatctaaacatatttgttccacatatgatatttgattagggatcctttagaaatagcaacacataacataaagagtctcatgaaagaatcacatattcattaaccaataatgagtttatctatttcaaggaacaaagtcgaataaatatgtaaacatagtatgtgatacaatcatctctatgattgcctctagggcatatcactaacagtctcccacttgcactagagtcaatcatgaacgtatcttatacccattgccctagtgtgtgcctcatgcttaggctgagggagtggctttgtcaatggatctgcaacattcaaatccgtatgtattttgcatatcttcacatctcctctacccactatctcgcgaatgaggtgataccgccgtaaaatgtatttagatttttgatgcgatctaggctccttggcttgcgcaatggcaccactattatcgcaatagaggtccatagggctagaaacactagtcatcacacctagttgagaaacgaatttcattatccaaacagcctcctttgctgcttcagaagtggcaatgtattcggcttctgttgtagaatcagccactgtatcttgcttggaactcttccaacttacagcgcctccattcaggcagaacacaaatccagactgcgatctaaaatcatctttgtcggtttggaaggttgcgtaagtgtaaccatttacaacgagctcttcctgtcctccatagactaggaaaatatccttagttcttctcaagtacttaaggatattctttaaagctatccagtgactctcacctggatctgat

SEQ ID NO: 49598 - DNA, 6712 bp, Oryza sativa
gttcattgaaaaactatttttcaacgatgtcttaacagattcatgcataggaatatcattcccaatctataatatgtcatctacatataggattataaacaccagtgcgctccactaatcttcttgtatacacaaggctcttcttcgtttttgacaaagcccaacaccttgactacttcgtcaaaacgaatattccaactccgagatgcttgcttcaacccataaatggatttctgcaatttgcatatccttttagctgattgtggatcaacaaatctcttgggttgtgtcatgtacacatcctcatcgagatttccattgaggaaagctgttttgacatccatttgccatatctcaaatcgaaataggcagcaatcgctaaaacaatccgaatagattttagcatggcgactggcgagaaagtttcatcataatcaacaccttgaatttgtctgaaacatttcgccaccaatcgtgccttgtagatgtgaacattttgtaacatactgaaaatttagaattttctaattatgcatcatgccagttcttatgttcttattaaccttttaaacctaggaaaatataattagagcgacctcctaaaactaacttgcataaaatccctttttgatatttaaaagcttttgtgactttcatttaaaattatcttgggatatttcttgatttggttttaatttaaaaccttattctgacaaaattccttttattcaaatttagtttgaaaaccctcttttatttttgtgaattgaggtccaaggaaaatccttcaaaccaaatccttgcaattccaatgttattggaattatttgttaacccatcctttgattctcgatccaaatatccaaatcatttcttttaatctagccaccaatttaattcttgtggcttgattttcttctcggcacaagaaatattattattgcaaatattatgaataattgctctttgttgacgaaaaaatcgaacacactggcctgagagatctgcttagctcctttgcaggtccaaatatgatgagatgcgggcgtgccagtcagtttgatcctgcaactgacaagatatgcaaatagtagattaaaacagccgatcggctgacaagccgatggattagttccagccgatagccgataatagccgatgccgataccagccgatagtgatagggttttgtgctatcggctatatgtccaatgtagataatgatataaaggaaatcggttgatgatgatgtaataaaataacaatataatccagtataaactaatcagcaaataatgatatgataaataagcattgatccgaaggttaaagcacacatcggcaggaggtccgatgtcatgaaatccacaagattagattaaacagtgaaacatttgttgtcatcggctaaatccaacttatatgtatatgcaatccttatgagccgatgcaacgtccagataactcaccggctgaaaccccgatgaaacccttattggcaatcaagaagcaggctagagattatggcaatcaaacgtatctgatgcagcactaagtatgaaaagaaacataatatctagacaatcaaaccgttgactgagttttcagggtggtagatgtctaagctaatctaactagcaacgcgattaagccgatactggcagaaaccctaaaacgagaagcagccgatagaactaaattgatatgctaagactagattaacaaagacatatgataaataggtaggcaaaaatatcatccaaaccagagcaatccaataggtcgaatgtactgatgcaaccttaaatgacgccgacatagacgatacaattgcatggaccgacagaacattggacttacctcttagccagagatcgaacaccgatgcaaccccacgtcaggtgccaaatcccgccggacgataaaataaagtagaaaagataaaaggtggcgatgtgccgaattgtattgatcgtaaagataaattacatagaccccgggtgtacatatttatacccatgggttgatacaagtccttatcggacaagaaagaaattttcctaaatataaaaggaaaagataaagtccttataggacactaaacacactttcctaaagataaaaggaaactaacaaactattcctaattagtagataacttaccatgccgtattctctttgaactcggtctcttctagataagcttcctttagtagatcaatttctttaaccgaatatagcaagaatccgacaactgacgacttggcaactctcatcggctaatctcagaactttgaagccaatgctgactctaagccgatgattactccgggcttaccaaatttcactgttaacactcttgtgctaagaaaatagattatatctttgtcatccaaatttcctattagcctcaaacaattctttgaaacccatgccatatattttgaggctaaaaccctacttatccttctccaattatcttcttcccaccttcctatttacacattcaatttcattcatatatcccttaccctttcatttgagtgcatcaaataaattccattatatgctacctctaaaatattgcactcaaataattaggaaatctctctttggaaattatctccaaaataaattcatctcaaaggttagccacttaaatttcttccaaatattaatttggatttaaattccatccctcaattccctacacaaattagaaagccttcctattcatttgggcggaattttctctctcttccttcggcccagaccggcccaagtcggcccagcccctcccacccaagccgactccctgcttctcctcccatgggcgcttccaggcgccgccaccgtgcgccattacctgccgccgtgcacgactcagctaccgccgccgccatcttgctgtcgacgcgaaggaaccgccacccgacgtcagctacacttcattccgccgacgtcagcaacagggacgaaccgccatcgtcggccgatcagaggacagagccggcgccgtcattcttttctccacgtcgctgcagccgtgtcctcatcgaccttctcctctgaaccgccatcagccaccgcctctcgccgcctataaatataaggcgagccctccccttttctccacacatcaacagagcctcgagctccctttctctctctccatccatggccgatcgtcgacgccgtcggtcgatctccccatccgtagctccacctcccctatcctcgcgccatcggcttcgcctccatccggagagtccgtttttcccctttcccctctccctccacctttaagtgaagccaccaccgcattcatccatgccggctcgaggtgagcccttgccgccgccgttccggctatatatctctcactctcggccagccaccgacctccccgggtgcgcgtcgctcgggaacacgcgtggccgctgccgtcgaggccgttcatccaccggagcatcggcgcccctcctctcccttctctctgtttgctcggctggaagagaagaagcagaagaaggaaggaggaagaagaaagagaaaagaagaagaagagacgaagaactgacaggtgggcccctgtatagtactatttcgtaatttccctatttaattcaaattctattctttagaagcccatatctcctaaaccgtagatccgattccagtgaaacttggacctaaattcatctaaattcaaaatctacattttgatatcaaattttctattttaatattttatttgaatttattcaaataccgtttgaatttatatttgacttttcaaatattttcttttatcccaattaccctttagccactaaaaagccgccggttggaactttacgccttccgtggggacgttcacggttttctatccccaacatcgaaccgttagttgtaaagcccggcataaaccaaacccaaggtcgaagtgctgctcctggcaccctacgccttgatgcgtatagcggtcggagtttcactattctatcgacctccacagcacgccgcacagttagctctcagtctctgtgtgatcctagccgttccgccgccacccacggttgtcagagtaacacttccgccctactaaacctacacccacctcctattccctctggccgatatgctgtctgctgacactggcaagagaagacactgaatctagtcgttatgctgccaactctagcaacgactagcaaacaaccaaaccctagctgataccctgctagtcaaatcccagttgtcatccaaattccataccctctacaatatcacctatccaccatactctcatccacctactttctgtctaccacaacctatacataaaatatagagcctggccgatatattgccctactcctcaatcggcctaaatataaccaaaccctaggtataatcttatccaaacctactatcagccaataccagtcacatatctgctcaaccaattcaattatccactatactccctatccaccaaccaatcaaagtctgcacataaaatataggtgatcttagccgcttaattccttctccaccccagctgccaactctttagaaccgacacataaaatatcagctcagtaatccatataccctataaaagagataggctataccctaaatcctaaccctcccaactgtttatctctttctcgctattttatggcttttattgaatttggttcttcctcttctgtagtagagtctattatattttggatggcaaccggtggtatttcaaggatcggacaatcaggttgcgtatctcggatttatttgcgttggagcaaggcaagttattattcctctccttgagcataataatcctatattctatatctccagtatcttgtgcattagccatacatgattctaaatgcataacctgaatatatagcaaaccagatatatgctagattttgcttagccatgcctagttagattacataaaatataataaacttagattggaacagtacggtagaaatggttgatttatgggtggctagtactgtttcaaccgacataaaattgccaagtacatgtgaagaacatacgagtacgaccgcaattctcgtatgggcatagacctagctgattaagttatctagcaaaggtggtacatctgtacattggttctattttaagtcctcgcgcaggaggcaaatttacaccgagcagggcgattgtgatatttaccgaggcgtaggtaaatatatgagatttattgatgtcgacttgtttgtgaaccctgattgcgatgacatggtgtcatacaatcagttctctctaaagacctcgggaacgccagaactcctctcgctgttgataacgttacgttcagagcgtatggggactagagttcatggaacagttaccactgatgttagtaaccgaaaagctttgccatgacaaggctaatgtgtttggcacgtcatggattgcgggtaaagcgtacatttactgcagtagagtataaatgaatctattcgaatagccgtgctcacggatttgagcattgggactcatatggtatttggttagaaacttaattctaaactttattaaatactgttgcatttaaaacattctaggctttcttcctttttatattatttgctttctgcaagtaaacctagctctactcagatattaccatttcatgcattcattattgaatataatagcttgctgagtatgttgtactcacccttgcttcaacccctctttttcagagtcattttggagttcttatcgaaattgggagttcaatcacataagttagtttcatttcaatctaattctcaagtctagattagatagatggtttaagtctatagccaaacattagagctaagtcattctatagcttctgctgtattagttagccacaagtttgtaaatacccatatgttttgtaataatatctcctttggagccttattcaaacgtatgcaatgaagatccagagtgttgaacctgtatcaatttactaatccagggcttgatacagtctaaacatgtcgattaccaaatcattagttttgggacccgacacatttccatctacatctgtcttcttcttaaagacccatttgcactcaatggcttttacaccatcaggttgatcaactaagttccaaacttgattgacatgcatggattctatttcggatttcatggctccaagccatttctcagagtctggtcccaccattgcttcctcataggtagtaggttcatcgttgtctaacaacagtatatcacgttgtcctgtagttaacaccgcatacctcgtaggtgtacgtcgtatcctttcggaccttcgtgaagccggtgcttccacaactggttcaacaacaacttgttcaacctgttgaacaacatcttgctcagcttgttgtggttgtgtggacgttgaagcgttttccggtgtttcctgaatttcttcaagtcaaaccatgctcccactaacctttcttgaaataaactctttttccaagaaaacaccgtgtcaggcgacaaacactttgccctcttcccaattataaaaataatatccttccgtttccttgggataccccacaaagaagcatttatctgatttaggtgtgagtttgttcgattgcaaacgttttacatagacctcacagccccaaatctttaggaaagacaaactgggacgctt

SEQ ID NO: 49599 - DNA, 17796 bp, Oryza sativa
caatgtacgattcctccgttcagacaccccattccactgaggcgttcctggcggagtgagttgtggaacaattccacactcctttacatgattaccaaattcaaggctcaagtactctccaccacgatcagatcatatatacttgattgtcttgcccaaatgattttgtacctcattctgaaattccttgaacttttcaaaggactcagacttatgcctcattaagtagacataaccatatctactaaagtcatcggtaaaggtaataaagtacccaaaaccacctctagcagttgagctcattggtccacatacatcagtatgtactagtcctaatagttcacttgccctttcactttgacccgtgaaaggtgcctttgtcattttgctaagtaaacaagattcgcatgtcaaatgattcaaaatcaaaccagtgtagaagtccatctctatgaagcttctctatgtgtttctcatttatatgacccaagcgacaatgccaaataaaagtgggattcaaatcattaggacgttgcctttttgcattaatgttatagactgaacatccatcaagattcacaatgtataagccattcataatgggtgcatgggaatagaaaatgtcattataatagactaaacaaccattgtccacagatctaaaaccataaccctctgcttgcaaacaagaagcagagataacgttcttgcacaaagctggaatgcaataacaattatttaactccaaaactaatcctgacggtaaagataatagcatagagccgaccgcaacagcagcaactcttgctccattgcccacgcgaatgtccacttcgcctcttgctaagttcctacttctttttagcccctgcaatgatttgcatatgtgagcaactgaccaggtatcaaatacctaagaatcagtagagaaagtagcaagattaatttctataacattaatacctgagatggaactctttccatcctgctgcttctgcttgagctgctctaggtatttcttacagtttctcttccaatgacctgtctccttgcaaaagaagcactctgcatccttagtgggccctgtcttttgaaccttggtcttagagttgctagtactcgtgatctcatcagagtttagctttatcttttgaccacttttcttgttgttgggcttgcgttatgtataaccatcacatggttggagtttttcttaatgctttcctcagcagtctttagcatcccatgcaattctgccaaggtcctgttcaggttgttcatgttgaaattcattatgaatggctcaaagctgggagggagcaactggagaatcaaatcagtagccaactctcggctaaggggaaaaccaagcttatctagactctcggtgtaaccaatcattttgatcacatatgggctcactggattaccttctgtaagcctgcacgcaaacaaggactttgaggtattaaacctctcagctcttgcatgctcctcaaacatgttacgtaatcccgtgattatcgtatgagcatccaatgcctcatattgcctttgaagctcaggagtcatagtagcaagcatgagacagcttatatcaagataatcattgcatcgcttttcatgctccctatgttgagcagcaggagcattattgggcaagtcagttggaaaaggctgtgtaagcacaaactctttgtgctcttgtctgaacaattctcaggttgcgataccaatccatgaagtttgttccagtcaacttctctttctcaagaatagaccgcaagttaaaactggatggtgcaggagctgccatgatctacaatagaaatatatgtatgcaaaatcagcaccatgtttacatttaacctttcattaaacaatttaacaaaagatacttccactatgtattgtgaaacaaaattccctctagtaacatagtgagtcaagatcctcattttattagtgtctaatgagctttggcatcacaactagacaactatcaaaataggtaaccaacaccttgctaatcacatcatatgtgactcttgtgctgttggggtgatatctccatgtccaacccaacctatgccccaaggtccaaaactgttttgataactttgtcaagtaaaccaataatctccgcatatagatgtctgacatctatcctattttatcatgataaaaagtgacactttgctatggcaaaccataataggtgcaattattggaagagcataaattaaacataatttttctgagggaatctatcctaccatgtcatatcaaatatataataggaataaagtaagatagatataaagccccaagcgaaatctaaggggcaatgcacacggcggtcccgctatgtgaaaaccttaacggcgtaatcaaattatgccgaaaccgagtcaatctcattggctcgtttttctcattggcgtgtggttccagtggacatcggactatccgatgaacacaatcgcgctcggccttggtgagtactagacattccagtgaagtcaccaacacacataccgattgatctcatcaacccatgcggctattagctcatctcatgttccgatcacctaagaactcatatacaacataatagatctcatctactacacctgcatatcaattatatgcaatgatctagatcataaactatacaaggcggctctgataccactgttgggatacgcgtaggctacgatagcataaatcaaaattttctattgcgtaaaccaggaaccatgcaagtattagatcataaatcgttaccactcgatgcgctgcgcagcggaagaagacgctgagaagtagaaggaactctcgcgaagtagcgcgcgtcgatgtagaggaagtagtcaatcgcaccggctcgaccttctcctcctcgtgcgttcttctcgccgtactcccacgccgatcagcaccgtaaaccagcggtgcctctactggtatccacacatacagagacagaacgccacacacagatgtgctagcacctgcgcgcggctagggttttgctcggggagggaagtgacggctagagtttctcacgtgatgcaatgcctccgctggtcacacccctcacgaatatataggatccatcactcgggcctccaaggcccataggacttctattcggatccctatgcgaattaagctcatattggatctccatccaatccccttcttccggcccattaagcgtgcgaccctgtaggtttatgtatactcggctgtaacccgaaaactccttttcagttcacgcgtcaacagcggcccctagcagaacgtattgacccattgggcatacgaaaagatcatatcggctgaacctctagtgtatacatgtatgaacccctttgcctcacgatatcgattaagctcaatgctagatatgtgccatcctctaatagcttaatcattcactcaaacctgttgatagattatataacttgtgattgactcctcaatcacctttggcatggccatgcatttccataatctacaacatcgaggggcccaaagatatctctccataggagggacaaatcccatctcgattattcatatcccactacatgtttcatagcatacccgaaaactacttttataactacccaattacagagtagcatttagcagtccctaagtaagctactacacatgttgggaaccataataatctcaagtataaggattcaacaccaacactaaatgagatcactgatgacacaacacatatggctcttgcagtgtctcatgttgggtctatccaacaacatgttcactaacatgtgtccacattattaatttggtatctctatacgatgatccatgacacatgatcatcaattaatacatgtgctgatcatctaaacatatttgttccacatatgatatttgatcaggaatcctttagaaatagcaacacataacataaagagttatgaaagaatcatatattaattaaccaataatgagtttatctatttcaaggaacaaagtcgaataaatatgtaaacatagtgtgtaatacaatcttctctatgattgcctctagcagaagaggggtgttcaatattttgatttttatcggatgtccgacgtctagtcgtctcgtagaacttccaatcattagattagaacttttaatttatatgtaaaatccatcgaatgctcactagagaggggcccatctaggcaagcatatgacagtgtgttctagtttgcctagcaacacctagcgcatcctcctctatcatagattctaacacttctagctaatgcatagtcggcatttgaactatctgaaattaaaaagtcactgattaccaattacagctaattctgaaagaatatgctgcgttaatgcgagaaaacggacctgtaggggtgaggacaggaggaattgtggcggagggtgttaggttatcgtattagtgttattaaattgctatacatttgagaaaaaatatataatggggtaaaattaagtcacaagcgtgtttatatgcatattggaaaaaaaatgaccaaagtcgttaaatattgtaaaatagtaccatcaaaatctctattcttaattaataatatcaccgaggtagagtgatgaggtcatgcagtatgaatgcagcaatgttatttctgtgtctgatttttccttatcatgagcagctgctgcatgcctgcactagaagcagcagaaatcactgcatcagcaatcctttcaactatcgtgctgtcagggagtcgagagtcgagcaggcatgtttttactgtattttccgtcctctgaacgaagccacaatgcagacgtgcagtgtggactgtcgttttggtacatggtagtagatggtacgaacagtcgtcgcaggcaatgttgacgacgtaagtgtacatgaacccatcgccttgcctctgtagatgaactgcgccccccgacccctcatggcctgtgacgcccgtgcgatctcagtggcgcggcacaacacaagcgagcacggacgcctcgacttccataatttctctctcaagggtccgtagcagggcctgatcgctcgcttaggatgcgtttgattcgtagtcaagttttgataggatacagtgatccgttttttatgagtcggtggatattattatcatccaatttttttatggatagaaggaatataatgaaaacaataacaaaatatgttattatcggaaacggatcctctattgtagagctaatactgcacaggtgctgtagcgatcaaatcaagccatctgattagattaagcggctctgattccgtccttaaacaccgaaaatatttttgataatttggaaactaacaaactgattttaaggaggaaaagtcaagatcaccttgatggagggaaaatcacgaatcctctagagtacttggcgccaaaataatacaggttctccctttgctttcttcctccttgggacttggtgccaaaaggagatacaaaggtttcactttgccttgttctgtccagaaactttgatgatcagataaagtaagccatcagtctccaacaaacaggtatgtatgccatgtcttgtactctttttgtgatcatgtcctcacaaaaaaaaaaccaaaagcattgttgtgtgattcttatgattggagtggatacactctacactcgtgtagcgctaaacagagtatacctacagatctgaggccttatggcgaacgactcaaactccaaccatcataattcaaataggtgagatcaatttcattcaggtcaacatagttttatcatctacatttttcttttctctgactatgttgttgatctcattactgaataggatcttaatcatgaccacatagcaatccatatttaacactgtatttctttgttgtaaaaaaaaaagagttgatccctgtttctttttacagcacaaatatgattcctagttggattcctcaatttggcatgaaatttaaatctacaaaagaggcatgggaattttggacttattatggaggtcgtactggttttgatgttaggataaattatgaaaataagagtaaagttgatggagtaattacttctgcaagatatgtttgttccaatgagggataccgggcaatagacaaaagagatcacaacaccaagcgtcctcgtgctaaaacaagaacaggttgcaaagctcggatcggaatcacagtagatagagaagtggacgattattcagtatatgatttagttctcgaacataaccacgaacttcaattgccttcaacatgccatttgatgccatcacagagaaagatatcatcattgcaagcatttgaaattgaaacaatggatgattcgggcattggaccaaaagctgcacatgagcttgctagtcggcaagttggtggttcagtaaaccttggttatacacgtcgtgatctcaagaaccatttaagaaccaagcgtcaaagggagttgatgtatggcgaagccggaagtatgttgaagtactttcaggacaaagttgcagagaacacttcatttcattatgcccttcagttggattgtgaagaacaaataacaaatattttttgggctgatgctaagatgataatcgactatgctcagtttggagatgttgttacttttgacacaacatttgggacaaacaaagaatacaggccctttggtgtctttgttggattcaaccattttagatagagtcatttttggagccgctcttttgtatgatgaaacatttgattctttcaaatggttgtttgagacctttttagctgtacataatcaaaaacagcctacaacaatctacacagatcaagatattgcaatgggaaaggcaattgaggtggtatttacagaagcatggattgtgcacttttcatataatgcaaaatgctatcaaacacttacctcgtaccaagaaagaagacacaaacattttgtctgatttcagtgcttgtatgtatgaatatgaagatgaagcaacttttcaggaagatttcagtaccatcagaagcaaggtgcataagcagacttggctaaacagtatatataaggtaaaagagaaatgggcggaatgctacatgaggaatgtttacacattagggatgagaagcacacagttgagtgagcttaaataatgacttgaaaaaccatctcaagtctgatcttgacattattcggtttttcaataatcttgaaagagttatcaaaggaaaacgagacaacgaattagatgcagaatatgaagcaagaaaaaaattgcctagaattaaaatgagagttcctatattggtgcaagcaagtaagatttacacaccttgtatatttgaatattttcaaaatgaatatgaaagatccatggctacatacatcaagtcatcagaacataatgaattcattgttgcaattgaggctcctggtgaagggtcaacatttgaagaggagtgcaaagttgtaggcaattatgcagagcaataggcattgtgcacctgtggacaatttgaaaggactggaatattgtgcagtcatgctttgaaagtccttgatgtgatgaatattaagtctttgccaaagagatatattttgaagcgatggactcgagaagcacgagttggtgctattgaggactgttatggcaagattgtcgtagaagatcccagattggaggataggtgcctcttgaagtttcttattcacaaatttcttggtatagctattcgagctgctgaatctaaagagtgcagcacactagtggacagtgttctagagagcctgaggaaagaagttgatgaaaaaacacctaatagtcaactaggtgaagttgcatctgaagaagcaaacggctctttgcacactgcacgtctgaagaaaaaagaaactcaaaagtgtagcacaaggagaaagaaaaattggcttgataagcagcatcccaccaaaaagaaggtacaagttgtacctgacaaacaaaatatctcggtatgttacttacgaactattcaattagactatatatgtactattcaattagactatatatgtactgattatatatagagtaatattttatctggatggttttgcttagcagcaagtgaaggattgttccatagcacagaaccaaattctggtggagaagactaatggaacgaatgagaagggatctgaagaatatggatggatcaatagctatgcagaactactgagggtattccacttatatatactaaaacttatatatttagtgcatactgtctagcagcatcaatattatttttctaattactctaattcattgtatagggtgatggcatggagcagaacatatttgatactacctggaattttgggttcagtgcaaattttgatgggagatagctagatacctgggtatcaaattgacaataacaaatcaagccattgaacatttacttttgagaacatccattcattttttttcaatgccacagaaaatttatgctatgcattcttctgtcagtttctgtcagcgtttagtactgaactattggcacacatgcagttacctttgtacatgtttccatcagagtattatgtttaatcttcctgaaaccttttcatcagagcactattttgtagagggtgtaaatgaacgatgcaacttttttagtgttacacaacttttttagtgttacactttggaataagtgtagacttcacagtgaggcgatgctctgcttatgatatttgtagaagatgtgaaatgggaggcatattgttagatgaacagcacacacatatgtataaacagagtctgaagctttcatggccttagccatgtaactgtcaagtaagtggtgggcagattgagcaaaatcagagccatctaatgtaatctgatggcttgatttaatcgctacagcacctgtgcagtattaactgtacagtagacgatccgtttccgttattatcattaacatagtcataatcatggaatattccatcctatcgtcccttacccaccaaccaaacaaacccaaaaactaaccatatctagggatatctttttaaccaaccacacccttagaccaccgtagctcacggcgcgctatcgttggacggcgttgcatggccgtggcatgtctgctaggggcaccgtggaccggtcaacggaggcaggcggcctcgaacacccggttctctcacaccttgcgtggtcgcgtctgcctgctgctctactactgcacaacaggttttcgaattggggctttgctctgtttttatgttgtctagaaaaggagaatagacaacctagtctgattggtctatggtcgcggggtgtctggtctaggtagtctctctggtcgccaattcgttcccccctctccgattcatcccgttcagcaatacgaggtgcagagtggcagcagcgcaacacagtgtgtgtgtttggggtggggtggggtgggggggttgatcttctcaactccctccgtccaaaaaaacgaacctaagactagacgtgatatattctagtacaatgaatctggacagaggtatatccagattcatagtactaggatatgtcacgtccagtcaaagttattaggaccggaccggacgtggaaccggtgaagccctcggttcacggtttgaatggctcaaccggttggaccgccggctcaacacgagtcaaatatcttcacatattaatcaaaaacatcaacgagtccatagcacagtggtgggagattacttcttgtgaccacaggtaggcaatttgaatcctatgcgcggcccttttcctcctatttttctcttctcacccatcccacgttcccactgccctgttaccggcttattccccaatttaatgtacattttttctccagttcatacctaaaaccggcggttcaatcggttttcctccggtttaattacatggccggtcttttggctggaccgcactgccctgttaccaccttattccccgatctaatgtatagttttaatgtacattttttctccagttcatacctaaaaccggcggttcaatcggttttcctccggtttaattacatggccggtcttttggctggactgcactgccctgttaccagcttattccccgatctaatgtacagtttttctccagttcatacctaaaaccggtagttcaaccggttttcctctgatttgattacatggccggtcttttggctagaccgcggaccagccgaggccagttttctccagttcatacctaataccggcggttcaactccggtttgattacatggcctgtcttttggctggaccgcggaccgaccgaggccctggttcggatcgccggtccggtccggttttaataactgtgcgtccagtaatatattggttttttatgggacggaaggagtagtgtgtaattttgctggcatcgtagaaaaataattcttaaggcctgttcagattgtagccaaaataaacctaaccaagttttggcaatgccaaaattttggcaagatatcaatattgccaaaatgttggcaggatttcttatgtattggccaaattcggccacaactaaacgtagacattttttttggcaactttgccaaaaaaaataatatatggttgaaaatagcatctgcccttagcataagggaaggggcacgcggcggaaaaaaaaaagcgtgcatcgccgccacctgactccaccgccggcctaagctagtttagcgattgccattcataagttgattttctttaagaaaaacggaaaggcatggtttcagaaggtctagttgcttccagaatcatgcaaaatatggcaaggggtgccatgcgttctatatggcactcagcaagtgccaagtgccataaaaaaaaattttctgccgcgtgtgctcctagccttctaccaactcgcgtctacaatgcgcacatggatgagtcagtggcatagggtctagggagcgacttgtacggtcattattcgattaatccctcctacaagggatcgatgaaggattttggtggagacatatcatgagggccttcatccgaacctgccaaaaccaccaatgagctgtaaaacaaccagaagccaagtctggatgaaggcgaggcccatggcgaagcacgaaggcggagcctagggcgaagcagggacgcaacttcgcacgggcccaacccgagaaggctgttaggaggcccacaacttaatagacattggttacccctgtaaatgtcaccatcataaaggcattcatataatataccctataaacaataaaccctagagggtaacagcttatactagatccatgtaatgagggatcctaaaaattttactaagtcaaaacatccaaccaagtttcatgttctttgatgagacgcaattgtcatttgacagcagatttagagataatttatttcatttttattgtggtgttgaattattttttctcaatccactccgatccctcgctcttagggattaatcgacgccactttcttgctgttggatgcataggaattgcatcgaagatgaggtcctgacgggatgaggctgggttcaagagttcaagcaaaatttagttcaactaggccttaggtaaaatgctcaatgaatagcaaaacacaaaacagcaaggtcttgagaaatctaatgatataattttgttttgaacaaaaggttttccttccctatgcatcactccttttctttctaaaattaaactacattgctactatccactaatcatcagctagaacgaaattgcttatattgccctttaaagctttatattgcaatgaatgaatctgattcagaaaaatgtcgctcatccccagattagctacaaatcggactgcaccacaacttatacctgttcatatagggtggcaaatcatattagttttgcctggatcggtagttcaaaaaaaaaatcacaacttgtatccccgaacacaacctcccaaatttgcattctctagaaacttcatcacagtttaccttaagtatttgctagtgacaaatttcatctttttcccagcagcgcataccacctaaaccctttgaagataatgagccaatcattgccaaaaggaaactaaggtcagtgcatcaacaacagaaagaataaaaagctgtgcagtcattcatgcaatccttaatatgaatggcaaggcacgaaaaaaaatatatacagcactcattcgtgcaatccataacacgaatggcaaggaagaaaagccacagctacaatttagtttcaagagaagatgttaagcgcaatttgcataccatgcaaatctatgattaacatctagtaaaaaaatgctatccctatttgcagctctgaaagagacatatatattcagtacaaggtcaggtaatgggagtctctatcacttgacagtaaatcgtaaaaagccactaagtttgattgctagataatttcaactcgtgcaacctaaagttatcactgggtgtgtatacagaattgcaagaaatatagtaagccagacaattgatagtccagcagccaccaccttttcccatactaacttgagccagaggtgcgaagttttctgcattgcagagcatgtcttgcaccaacgggtctgcaatctacatgcactaagaattaaggagcccaagatgacgatggcaacggactactaagaatgaaggaacccatggtggagatggcaatggactgcttggtgatggatctgttgttctgcaacaaatcgatccatcctgaccatgctgaaaccgagtgttatcagctgaaggatcattgcagtgggtaaaacatttttgaccatatcgattgctccattgcaggcacaaaccattagaggtgggggaaagggaagaaagtatacctgtctttttttttcaccaaataccagcagagtgacgtcaaagcaaaaatggatacaagcaaagatccacttgctagatgcagtgctcccagaatgcactcaagaacgaacaagttccaggcagatccactcgctagatccattgctcttgaggatggcagcaagaacaatcaagtggctgggacatgaggggaggtttactttggagaattacctctgcacatccgtccggaccgcccaatttcctgagccgggatcaaccacctcgccgtcaacctcaagctctaatctcgtgaatggggtgttgcgctgggaccagattagtggcgtcccatcgatttccagccctagctcatgccaccgcgcctgctttcggctgccgccgccgccgttcccccaagctccttctcccttctcctgacaagctcgccagatccagcgagaggcatcggtgggcgggcagttgcggcgcggcgaggctcaagccacgagccaccatagcaggggaggaaggggaaaaggcagcggcagggagagcaagggaggatggcatgggaacagtggctggctagggtttcgtgggagggggattggccaattgggtatgctcattttttcaaaagaacccctttctgttcgatgttttcgagcgcagttctatttttggatttttctcttcttcatataaagttttccttcttgtgaagggcctacaacaaattactaacaatgtaaagggtctttttgcaaaatctccaccctcatcatcctaccgttcaatgaagccgatcggacggcgagcgggcacaaggagggaggctgcctcccagggcgcgggggcgacgtggatagttccgcgtgcgaacacgccgccctgaatcgctctcagctcgccaattcagggcaggttttaatttaaccgatgaagtaatgaacagctagcctagtgaagtaccaggctgaaattaattatggcatcgccacagcatgcatattaactctctcaaatcataacacactcaggcactttgttcattcgcgcaatcttcaggactaacgtcatttgaattaacacgccccgcgatctgatgcggtggtggccgcgtaaatttcatgcgtgcgtcgccgccgccggccgcttgcccgctgccgcctcatttctgtgtgcgtcgctgtcgccggcctcggcgagcctagcaatttcttcgctagtaaaactggaaacgtagaggtttagttgtcaggtgtcaaaatcttgtaatggatgccatgcattctatatggcatggggtgccattgaatttcagttttttccgcaggcacccaccgagaagcttagcgcgatcaatggaaccacagcccgcgcacgggcccctcttgaagccgcggcctcatctcggcgcgactcaacggcccgggaggctggcgtgttggggtggcctggcccatccgtgcgcccggggcaccagcgcggcaccggccgaaaaagcggctgcccacgcatctgcacgcagaaaatcccagaggaataagttcaccagaggtccctcaacttaacagcaagattttctgagatccctcaaccataaaaccagaaatgttcgctcctaaactcattcaaaccattcaccggaggtcccttggcagtatttttgcctgattttggggacgtggcatcctagtcagcaaaaataataaaaaatttcgtggggcccacatgtacgtgagaaaaaaatataggatcaaccatcttagtcagcaatcttctctcttttcattttttttcttcttctctttcggcatgagtgatagcagatatgacgagcagtgagagcagtgaggcagaggggcggcgtcggcgatcgtagagggcgagcgccggcgtgcggccggagcaggcggagggccggtgtcggcggctgcaggcgatggaaagcggcggacacgcgcggtcgcagagtgcgagaggcagcgggtgacggtgcgcggctgcagcaggcggagggcggcgtcagtgggcgagcgtggctgtggcggtggcaagcggcgggcaagcggcggctttgggcttgggcggagcagaggggcggaggacgcggggtgcgcgacgacgcagatggggagcggcaacagtgtgcgactggaggcaggcggagcggcgacgtctgcggtggcaggcgagcgtggttgcggagcatcggcgttggcgggcgagaggctgacggcggagtagaaaggcagcgacgggcgagcgcggagtgagacaaggtcaccgccgccgctcggagggaggcgaggtcatcgccttgggtgcctctcgtgctgctttgacggcgggaaagatggggaaggggagggagaggactccgatgctacagtacgggaacgacgcgagtgcgcacagcgccgtgcccaggacgaggagggggagcgggcggagagacgagcgccaagccgccctgcctgacaacgacgattacgagctcccagcgccgccacacccgctcggggacgacgacgacgccgccgaccgcctgccaccgcctccttcctctcccggtctcgcccgccgtccgctccgcccgcagcccgccgccgctatgcccgccgcctgcatccgcgctcgcccgccgtccgctccgccgcagctcgccgccgcactattgtctcgctcgcccgccacccgcatccacgctctcccatcactgctgcgcccgccaccggcctgaagaagagaagagagaggagataaaagagaagggaaggagaagaaaagagaagaaaaaagatgtgcagctgacatgtgggccccacgaaattttttaatttgtttttactgactaggataccacgtcagcaaaaccaggcaaaaatactgccaagggacctccggtgaacggtttgaatgagtttaggggtaaatatttctcgttttgtgattgagggacctcaaaaaatctcgttgttaagttgagggacctccggtgaacttattccaatccccgagggcgccgctgcggagcctcgacccaagaggaaaaagtcatcgctacgctctgcgctccgctggctgtccgtccgtacgcgcaaacgagcccggtgcgtcgttgggtctaggttgggcctgctggcagcgctgtgtgtgtatgacttgtgaggaggcgtggtcctcacaataatctgttgcgctgcaatttgagttgagacctgaacggggtttactgtttccagatgcgctggcagctttctttctctatcaagccagggatctttgccatgctatctccgcgcttcgcttcgcttcgggggctgcgccgagcgtgcgtctggccttgggtccttggcccacgttgccttgcttgttggctgcggcacaccaatgctgttgctggtcaaatatatacgtgtatgtctatattaatagcgatacatccatgctgttggtggtggcaagttaggagcgacctatcagtgatatgaatcatagagatgattgtattacatactatgtttacatatttatccgatattgttccttgaaatagataacttattatttgttaatgaatatgtgattcttttatgagactctttatattgtatattgctatttctaaaggatccctgatcaaatattatatgtggaacaaacatgtttatatgatcagcacatgtattaattgataattatgtctcataaatcgtggtatagagataccaaattaataatgtggacacatgatggggaacatgttgttggatagacccaacatgagacactgcaagagtcatatgtgttgtgtcatcagtgatcttatttagtgttagtgttagtattgaatccttagacctgagattatcatggttctcaacatgtgtagtagcatacttagggactgctaaacgctactccgtaattgggtagttataaaagtagtttccgggtatgctataaaacatgtagtgggatatgaataatcaatatgggatttgcctctcctatgaagagatatatctgggcccctcgatgttataaattatggaagtgcatggccatgccaaaggtgattgaggagtcaatcacaaattatataatatatcataagttcgagtgaatgattgagctattagaggatggcacatatctagccttgagcttaatcgatattgtgaggcaaaagggttcatacaagtttacactagaggttcaaccgatatgatctttatgtatgcccggtgggtcaatacgttctgctaggggccgctgttgacacgtggaccgaaaaggaattttcgagttacagcctagtgtatacgaacctgcagggtcgcacgcttaaagggccagaataaagggattggatggagatccaatatgcactcaatcaaatagggattcgagtaggactcctatgggcctcgaaggcccagtcgcggatcctatatattcatgaggggaagtgaccggcggaattaacacaccacgtgaaaccctagccgtcactgccatccccgagcaaaccctagccgctcgtgggtgcaagcacatctgcacgtggcgttccgtccctgtatgtgtggacaccggtagaggcgccgctggtttatggtgctgatcggcatgggagtacggtgaggagaacgcaagaggaggagaaggtcgagccggtgcgatcgactacttcctctacgtcgacacgcgctacattacgagggttccttcgccttcttagtgccttcttccaccgcgcagcgcgttccaatacttgcatggttcatggtttacgcggtagaaaattttgatttatgctatcgtagcctacgcgtatcccaacacaaccgagcacttatagttaataacaagagcaagaccttcctactaatataggatggctgttg

SEQ ID NO: 49600 - DNA, 2386 bp, Oryza sativa
ttaatgtaagaatgtgggtcctccatataagggcatgtatatagtgaggatactatatagcctataccttgttgatcggtatatgcactactatagaaagttagaaacaatatttccaaacagctaaaatatatttttgtaaatgggtgtagcatctgccaacccctagctgtatgtagaaatagggatttttcaggtgggcagcataaccacatgcgaaaacaaaatattggcacggggcatgttattgccacctaactgtattttttttcatgctaaacgaaacaaaaatccccaaaattgaaatcctataaaccctagttcacctaccgagttgggtttactcactttttggggtggctcggttgcggcgggagtggtgggagtttgctcaatcatgtcgagattccttttgtcacactgcacaaccatcttttcgtttctcggtattgtgattattcctttaggtcctggaaccttaatccgctagtatgcgcagtgcgaagccccatgaattttgcaagtgccgctcttttgatgatagcattgtacgcagtgtgaaactctgctacatcaaaggtgatctgctttgtccggaagttatcagccttgccgaaagtcacaagcaacattatcttccataacaatcttgatgatgactatgtgtaacgccatggaagagctgctttgaagaaatgagctcacttctagggatccctattgcgtcaagagtatctgcaaagaggaggttgattgtgctgccatcgttgatgagaacacgtgcaactttgacattccaaatagtaggctcgactactatcggatatctatcaggggttgttatcagagaactcgatcttctgacctgaccacttcattttggacattgatacccgggatgtggagcaaacttcacgttctaccttcttgcattctcgcttaaaggaataggatgttgaaccaccgaagatgtgtgccacgtgttggtcgaagttaggaaaatctggttcgtcgtcggatgaagggtcgctgttacccttgtctcaggctattttcctagccttggctttttggaacacgttgcactcgaatatgtgagcactagtcttatgcactgaacaccattgttgttcctttgacattgatgttccttgtgtcaagtgacctgcatattgcactgtgaagactcatttccggttacctcacctgctcctgcatgaattatcttcttcagaaaatataaccacataattgatgccctacacagttcagatacttatgaagcagtaatttccacgaaacaagaacaattcaagtgaagagcacggtgctggccagggaggtcgcgcggtggccatgatttgcagtgcggggatgatgagatgtagatatcgcgtaaattcctatgcaagcaatcaacgaggaatcgccgagtgcagcagaagcacctggattccatatttccatgtgaggaacaaaaatggggagatgtggaggggcagcgacgccgagtcaatttcgcacgatgggcggtgacaggcagtgggaaatcactgaaggcggaaggcgtgtatgaaccgagggggtgagatagacgagtggttcggtcgaatcaggatgacttgaaccagaaggcggacgccgttgtcagtagcgtcccgagctagacattgataaaaatagcgtccgaaagtggatgctctttccaacggcgtccttactaattttctaattcatgccttctatttattacttgtttaattttgggattaataattctataaataaaaaatttagctcagcagcacagcactcatgtcatctaaattaccctcaattttcataacccatttacacaagagacacaagttcataactttaagtattttaaaaccccatatctccatactccataggtctacacagagcttgccacttgaccatgtggtatttcctctttttctccacaccctgccagtaaaacctccccctcactccaaccatcttcttatggaactcctcaagaagtttataaaacccatagtgaataagggaatactggaaatgcaacaagtaattctaatttccctacccccataggaaaaatatccactctgccaagaccctagcctgttttcaaaacaccctcccccctccccattgcttgatcagattgtgcatagatttggttgtgaaaataccattttttgtgtgaggccaaaatgttttatctggttcctcacttagagtaagcccacttagtaaggccataatctccccaaaactctacttgtccaagaggtccagctttcttgtagaggatatatcccaagaaacctcattagtgacttcttttgaagttgcatattgctgccttcaaattttg

SEQ ID NO: 49601 - DNA, 1715 bp, Oryza sativa
aggcggaaccggacggagggggtgcggggagggtttaaatagagccggggcgagagagggtggccggggaagggaggaaaccggcgcgggaggtcggccgccatcaatggcgccggcgggattaggggagcggtttccaaccgaatccgagggagagagggagggaaaaatggggggaaagagagagggaatcacggggagtgattttcccctctttattgcgcgcggggacggcgggaggcggcgggattcgcggcggcggcggcgctagggcacgggcgaggcggcgggagcggcgggaggatagggatgacaggtgggccccacccgtcagcgagggtggcgggcgggcccgcccgtcagcggcgcgcgcgcggggagaggccgagtgggccgcggggaggaggagagagagggagggagatgggccgagccggcccaagaggggaaggggggaaaaaggactttttagggtttttctttttataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcgaattttaattaattctattattccttttagcgaatgatttttaattcgggatgaatttatcaggacgtgacacctacacaatcttacatgctaagtctagttacaaatctaataatcttatattaaaactataataatcttatattaaaactaagtctaagtgtcgtatattaaatctaatagtcttaattgcattacaaatataacaatcatatatataattacgtcacttgcctgcgcgaattccttcgagggctagctaccactccggcttgagggacgacgacgacaacgtcttttctgcaacatacaaaaagatgtattgggataaacgcgaagtaacatatattatatttgacgttcacgtttcgttcacgatcgttcacgttcgcgttctcgttaaggtcacgtttcattcacctacgttcgttcgttcacgttcactcacctacatatattgcatttcacgttcacgttcgttcatgttcacgttcacgttcgttgacgttcgttcacgctcgttcgttcacgttcgttcgttctttcacattcaattctcgttcacgttcgttcgctcgttcatgttctcgttcatgttcgttcgctcgttctcgttcacgttcgttcgctcgttcacgttctcgttcgttcgctcgttcacgttcgttcacgttcacgttcacgttaattcgttcgatcacgtggcggcagcggagcggcggtggggcggcgcggcggtggcatggcggcggcgtgcggcgcgcggcacgcggcccggcggcggcgttgtgcggtggcggtgtggcggcgcggcggtgccgtgccacggcggcgtcgtggcgtcccggcgtgtcgtgccgccgcagcgtcctggcgtggcgtcgtgtcgtgacgacgtcggcgtcggcgtcggcaacgaggcggccggcggcaaccgagagggagagagagatcgagatcggagagagagagctgagagggaggcggcggcgtggctctcaccccagagatgcggcggcggcgccggaggcggaggcggcgacgacgacgagcgcgagacga

SEQ ID NO: 49602 - DNA, 959 bp, Oryza sativa
cacggatataccattgtagcatttcacccgagagtaatccaagggtatcgtatttattttatcccgtgggaagatcttgtagagagaactcaactaataatttatatattacttatgataatcatattctaagcaggggttatgataatccaagggtagagtgacacacaagcattacctactcatccttataaaaaataatctaagctaggtggaaagaaaagagaaagtaaatctattcctatacttctaaatacatagtatacatacattctagttaactgatatactagctaataccctctattcgatgccctcctggtagttcgagaagccaccccgactgccaagttccttacgacagcccgtcatgaccatccaaccggggctaaatacggaggaataccctccccaggaaattaacttaggattatatataggcgcggaggaatacccgtactgagctgtcaccatcagcggcccacctctcatccacaatatataaccccaactaatgatatcccgtaatctagacaccacgtctaaactaccagatactactctaatatcatcgtcatgacatagagtaattgcataagcaaacactatacccgcaccaaagcatctcccagataagccagccgtatactcagtataacaagattataatgtaaagttggtactcatatacttggaaagtatttcaataccagaaatgtatatagaagagtattctaataaaagtacaaagcttacaaaagaggaaaggaaagctactagagccatacccgaactcttccgaagacttccggactcctgattcctattctaattctattccaccagctagatactactaaactaaacttgagaggaatgagagagctcttgcttgaggtgtgtgttgaagtgaagagagtgagctccttatatagaggtggttatgacggttgtggaag

SEQ ID NO: 49603 - DNA, 11607 bp, Oryza sativa
  unsure (1)..(11607): unsure at all n locations
aaaacttctcaaaaaagatccatcaaatgtgatataaatcatgacaataggtgagtctaaatcgcctaagctataactctcactatatcaaaataagcatataatcatgccgagagaatgacttacaaaaaccagtcatctcaataaaacccagacagcctttgcagcctaaaaagacttacaaaattagtataacacttttccgtcgagcacctttttatttgcatcgtagtaattccaaggaattatctaactgcgtcaaaaaggattttaacagcattgggttaaactgttgtgagcaaatgttgtcgaagcaaaatgcctaagtccctaaggatcacaactaaaccacgccgatagcaaaattgggctgaagtactgatttaggcccaggcccattagtactcccgataccctaataaaactaaaacctaagcgtcagttcgtcttccccgctgaaactcttgccactttccccattctctgctacagtgcaaaaccacaccgatggagctagggttcacagattcgctccaatccagccttcaaggctccacgaaaatctcccacacaaccaccgcatcaatctcccatccattcccagccatatttctaaccaaatcacatcatccaattcgcatccatggcggaagagagagagctttgagagccagtggacgccctccgacgtaacggaggaaaacctaaaggagatggtggcgcacggtgttcttccggccaaggagatcatcgggtggcgtccagcatacggcgaaatgtttccaacccacgacacacacgaggtggttgtattctcctatttcttttacggcgggttttctcttccaacctcaaacttcttccaaggaattctggatttctatggtattagtctgcatcacctaaaccccaattccatagtccacattgccaacttcatccacgcttgcgaagcttttctggggattaggctgcatttcgctctattccgccgcatcttctttctcaagccccagccaaacaagagcaaaccatgtgttgttgggggagccagttttcaactgagggggaccttgagccaaaaatacttctccatgccattcaagacctggaataaatgttggcatgcaaattggttctatgtacaaaaccccgagccagtgtttcctgggtactcttgtctgcctccggtatatcaagatacccggaattcgcttcccatgggggatgaggcagcccaagcacttgcactgatggattgcatgctgaggctcaaagagcagggtctgcaaggagaacagatcacccgacattttataaaaagccgactagggccaattaaagagagatcccgcacagcctttgaatttgacggcaagcatgaccccacccgtgaagatccagattcacttgagtttaaagtcatgaaggagagaatgtacaaaatcttctcgaatgctatcgtggtcagttattcgcacttgctgccagtagtgctatacaacgccttcaaccctcctccaccggtatgtcttatacaactcagcttttctcaaagcatacttttatcttctgtaaggtcaactgaaaactcggagtatcatgcacaggaattcgctttgatgaaatctgaccctccaattgctcaacgccattcaccccattggaagacaagccaggctagtggagggccaaaaatcaagcctgctaatcaacctgacacttcgaagttgactaatcaatctgactctcggaagaggaaattgatttcaagtgacgatgaaggtgatgatgcggaaaagacgggtaacaaaagggtgactggaaaacagtcaaagcaaaccaatccgaagaagaaaacgcccagtcgtcccatgccaaaaataaggaagtcatccaggtatgtatcatctagcaatttcttctgtttcgctagtcactcactattgaagcaaagctaatagcatgtctcaaatatgtagaaaaccatctgacatagatccctctggaaaagaccccacgtcaactgacacggagaccggtccttcagaagaaactggaccgactgccgaagaccgcctgggtaataatcaaccggcaaccgacaatgtagataccagcaacgagcccccgactggaaaccagtcggccgagactgaagtcagtgctgatcaggagcccccgactggaaaccagtcgggtatagaaccaaataaagatatcctagaagtagaagctcaagctaacaaccctcccaagacagacactggtgctagccctagaactaattctcctgttagggtgcaaggaactgctcgtcctcgaccggaaattatcacaggtaaacacatcctccgaacctgctttgatccaacaaactttcttcaattacttcacttattattcatgactatctaaggtccgatgatcggtgatgaagaagaggttctccggatacaatcggctgaagattctcgcccacccattttagtcaagtggtgggatgacgacatgcaaccacagggaattgtaataaataagcaaaaggaagatgaggaagtatgcctactgaaaaagacactcggccaagccactcgtcttgtaaatgtaagtctccatatatatagcctcaatcatcctgtcgatcaccttacttgaacaaagataaatttgtggtgcagagaatccatcttaggaatgaggcgaatactgcaacccttgaaaagttagttccccaccttggaacccttgaagccactagaaaccagctgcacgaagctaaagagcttgccaagaagactgagcatgatgtgagagaccggatcgccaagctccaagactccaactttgagctgagcggttcatcaaaaggtaaatatcatctttgtctgacttgtttcgtgttgctatccatgtgcatctgacaaatgaaaaacaatacagtgcaagcttctaagatatctgagctgaagaagcgaatccaagctctagagaaagacaaggccgaattggcaaaacagagggactcggctctgaaagatgtcgaaggtattggtagctgacacttcaaaaaccactctcatcttcatgcctagtcgttgatgtaaacctatttgtacaaatcgcaaaatcaaatcccaggctcaattcgatgtcttagttaacaaaatcaagaagcttgaaggagccagagataaagtcgccaatgccgctacgccactcgtccaggttcgagtttttcaataacaacggtccgagttcaattgatgttgtcgaaatcttcgacaaactgagaactgctccggacacctattttaagaatatcaaagaagctggatgcatgagagcgagcctggcgttggcaatgaccaagtccttgtacccgaagattgacatcgatgctgttgatggctttgcagacgggacaagcgaagaagccgcccttgacctcatcaatgatgcgaaaaaagctgctgacaagatagccactgatgtagttgagaggttccaggaaaacgacctcaggccaactgggtctgacaattctaatgatgaaaaaactgaaactgattaatgttgtattttgatgataatgatgatgatgatggaggcacaatttgtacaatactgataaatttatgctgtgctttatggtttgaacatagctccagatttcttaaaagtttttgtcaaaccttattgagcctagaaccctcaaaagtttttaaaaaactctcagtcctcattggctaagccaaaaaatcaaacaaggcaatgataaatcaagtaagcaaattgaattgataaaaatcacactccattattattatagtagcccccgactgataactcaagggacaacttgatgttaacagtcaaagaggaagatacaaaagtaatgcttaagcataaaaatgacgaagatgttcaatattccaagagttgtcgatatgagtaccatcttcacgcttgagtcggtaagaacctggccgagtgacttcagaaattatgaacggtccttcccacaagggagataacttgtgccgatcccgtgtagtttgaatttttctcagaaccaggtcgccgactaaaaaagctcgagatcgaacattgcagttgtgataacggcgtaacccttgtaagtaccgagctgactaaattaaggctgcctcacgggcttcttccagtcggttgagatcatctactcggtcttctccgtagcgattcaaattccacctcacttggcaacatcgcttccactccatagactaggaaaaacggcgactggcccgtagcccgactcggagtggtgcgcagggaccaaagtacagatggcaactgttctacgcatttgccagcatagggacgcagtcgatcaaaaactcgtgcttttattccttgaagtaccataccattggcgcgttcaacttgtccattactcatgggatgcgctacggaggcataacaaattttgatgccaaagtcctcacataaatctttaaatactctgcctgtgaattgagtgccgttatcagtgatgatccgattgggtaccccaaaccggtgcacaatgttgatgaagaaatctctagccttgtctgccgcgattgttataacttgtttggcttcaatccacttggaaaacttgtcaacagctacaaagagatgagtataaccacctactgcctttttaaatgggccgaccatgtcgagcccccaaaccgcgaacggccaagacaacgggatggtttgcaactcctgagccggtagatgagtttgtcgggcgaaaaattgacaaccctcacatgttcgcacaattttgtcagcgtcagacacggctgtgggccagaaaaaaccttgctggtaagccttgccaacgatggttcgtgtggcagcgtgattgtcgcagattcctgagtgtatatcctttaccaattgtcttccctcctccaaagacatacagcgttgtaggattcctgatggactttttttgtacagctcggtctcatgtatgacataaagtctgctgcgcctggagatccgctcggcttcatctttatcttgagggagttcttgttttgtcaaaaatcttatgaggggctctctccagtcggcttcaatcatgcttatgtcttgagtgtccatggcctcgattgtttctttccttggtacggttggctcgtagagatgttcacaaaacacgtcggaaggagctgcttctcgttttgaaccaaaattagccagtctatcggctgcctcattattgtgtcgaagaacatgggtgagctcaagtctatcgaatttgtcttccaacttgcgtacctcttgccggtaagcggttatgttatcatcaaggcaggaccactctttcatgacttgattaacaactaactaagaatctccacgaactaccagacgccgaatccccaaggagattgcaatccttagtccgtgaagaagcgcctcatattccgccacgttgtgagacgtagaaaaatgtatccacaatacgttgctcagcctctctccagtcagggaaattagaactactcccactctagtgcctgaaagcctcttcgacccgtcaaaatgcttagtccaatactccatcttctccgtgggcatgtcttcttggcactcagtctactcggcgacgaagtcagctaaagcttgagacttgatcgaagtttgcagcttgaaagatatatccaaagacatcaattctaagacccattttgcgatccgcccgtttgcttcgcgattgtgaagtatgtccccgagtggaaacgacgtaaccaccgtaaccgagttaccttggaagtagtgagataatttccttacggtaactaaaacaccatataatagcttttgaacctgagggtatcttgtcttggagtcagccaaaatctcgctaacgaagtagattggtcgttggactttttgaacatggccttcttcttcacgttcaacaaccaggactgtgcttacaacctgggaagttgccgacacgtataacaacagttgctcttgcggatgtggtgaagctaagactggtggagtagtgagaagttttttgaagtcttcaaaggcttttcgtgggtccccactggaaattgtcggttttctttaacagcttgaaaaaaggcatcccccgctccccgagtcgtgagacgaaccggctgagcgccgccatgcagccagttaacttttggacgtctttctgggagctcggcagtttcattttgaggatggcattgattttctccgggttggcttgtatgcctctatgggacaccataaatccaagcagcttccctgacggtactccgaagatgcacttttcagggtttaatttcatcctgaaagcgcggatgctctcaaaggtctcttctagatccacaatcaaatcatccttctgctttgtcttgacgactatgtcatccacataagcttcacgttgcggccgatctgagttgaaaaacatctctggatcatgcgttgataagttgctcctgcgttctttaatccaaaaggcatggtgatgtagcagtaggccccgaagggcgtgatgaatgaagtctttaagcagtcggattcctttagtcggatcggatgatatcccgagtagcaatccaaaaaactgagtagctcacagccggccgttgagtcaactacctggtcaatgcgaggtaacccaaaaggatctttgggacaagacttgttgaggtcggtgtaatcaacacacatgcgccattgccccgtcttcttctgaaccaggactgggttggccagccagtcgggatgaaggacttccttgatgaagcccgctgctaacagcttggtcaattctaccttgatcgcatccttcctatcctatgcgaaacggcggagtcgttgcttgattggtttagcgtcttccttgacatgtaaagagtgctcaatcacctctctaggaataccaggcatatcaaatggtttccacgcaaagatatctttattattttgaagaaaggtgatgagcgcgctttcctatttacaatctaactcagcgcctattacagcagtcttagtaggatcagaaggatctagaggaatcttcttggtcttggtgtcgcttgccccgctctttggcatcttggtcgcaggcacttctccttcgcttgctgtggacgcagccagtcggatttcttctcggtcgagcgtgatctcgcggaactgggccatctcgcagctttccttgtcacacgtgacggcttgcttgatgtcactccgcagggatatgactccttgaggaccaggcatcttcatcatcatgtaggtatagtgcgggacagccatgaacttggctaacatcgggcgtccgagtatggcgtgatacgctgtcctcaaaacaaatgttctctgtgtggaagttctcccaagtgccgaaagtaatgggaagagtgatctggctgagtggtgtagcagatagccctgagatgactccgtgaaagggcgcattactcggctttaattccatgcgagggatctgcatgtcgtccagagtcttgacgaaaaggatgttgagtgcactgccaccatcgatgagggatctgcgaagcttgacgttgcgaaccactgggtctagtaccagggggtaccgccctgggtggaccacacggtaaggatgatccaagcggtcaaacataattgttgtctctgaccaccgaagatattggggcgtgtcgggctgaatagcgttgatctcccgttcggttagcttttgctttctcttggattcataggacaggggtccgccaaagatgtggttgagttccttgcgatggtcttgaaaaccagtcggggcgtcaacttcatcatccttctttaacgtgctttgatctccgtcagaggccttgcgtgcattcttggcgtattgttctgcaaactgtttatagacgaagcaatctttggccgcgtgattggagtttggatgatgcggacattgggagttcatgatcttgtcagaagtgttgacccgtgaacgttgtcgggaggatggtgtagtagttgccacaagttccttgggtttacgcttgcgatccttgtgattggtacttccactcccccctgtagttggcgtatctttcttcggcttccaagtggtgcccgactgcttggacgcggtaatgacatcttctgcttgaccgtcctgggaggcttgcgcccgaacttgccgactaggtcatcatggcaaatgcccttggtgaaggcggcgatgatgacgtcgtcggtgatgtcggagatcttgttgcgttgctcggaaaaacgtcggatgtaatctcgaagggattctccagacttctaaacaacgttatagagatcaaactgtgtaccagggcattcaaaggtaccctggaagttggcgatgaagtggtcgcgaagttctgcccaagatccgattgtgccacggggtaagccgtgaagccaggaccgggcagagtccgctagggccacaggcaaatagtttgccatgactttgctatctcgtcctgctgcgcgaatagcgagaccgtagatggtgagccaagactccgggttagtggtgccgtcatacttctcgattccagtcggcttgaagccggctggccaatccactcgacgcaatttgcttgtgaaggcagcaactccatccacgtcgttgtcgtagcgatctagtgaatggtgggaagcgtattctcttgccgcgcagcgctggttgatagtatcgcgaagatcgacggggcgcctgcgatatgaggagcgaggtcgttcaactcgatgctccctgtgtcattcaggaggcgagtggacagatcgctcgtcgtgacccttactcctgcgactggatcccgcaccgacgacgctgaggcttggttggtgatagtcttgagatcgaagagggggaactcggctaccagtcagcgtgcggacgcttgcagagttaaccgggaccaaggcagagatcatgatcttggtctggttcaagatgttgacgacgtgattggcttgattgagtacgtcttccttgaggagggtgtcgaggagggtgatcgctgcaaccgcgttctgttgaggggtgcgaaaaacagccgttccctcaacgtcttgctgcccgataagttctcgtgctcgtcgcccgacatccaaggcgtgctgtcgccggtcctcagcctcttttgcagcccgttcgcactcctgttgctcacgctgcagccgttctcgctcttgtgcttggcgctcctcttccagtcagggtcgttcggcttcctgttgcacgcgttgttcttctgcttctcgggctttacgctgttcttccgtctcgttttcagccatgaagatgccgaagtagagaggcgtgtagttatcttcaaagtcttagtcgaagtcgtcgaggttgcggtctacggtagccgaagtcgtcgtactcaatgatctccgttggccgtgagtcgacgccgggggagctgaggtagccatccagttgttccgtcgaaaccgtgccgagaggctagagtatgacgccgacttccctggagctaggctggatcgaggtagaggccggatcccgcctagattgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcactaagaagaaaactgcagcggaaaataaaatctagcgaagctccggctccactcccacaggcagctcaactgggatataagccaaacgtcttctccttctggatcctttttcttcaactgaggttgattgattattgcaaagtgagcatatgacatactcagcaagccacacagcaaatatgcaagtgcacaaggataccaaaggatggcataatataggctcatttgcgaaagcagcatttagcaaagagttaagagtagtaaaacagtagagtaattaatcagaaattttaatcaacactgaacagcacacccatgctgtacaggcccaaccatcctgaacaaccatacccggctgtacagatctaactccaaaccaggagctaagcaaattgttaccagttataacatccataattattgtgagaggtgtgggactaatcacgaaaaacattgctcaacccgcccataaccacgggcacggctattcgaatagttttactctggccagaggtgtaccactgtacccacaagacacagcctcatcatcatgtctaccatgcgtcgcgatactggaaagtacccgaatagaggctgtgacaataccctttgcacaacacaactcaccacagtgcaccattcctggatcataatcaccccctcaaaaaccagaggcatggactccccagcgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaacaatgagtcataagttatctcaaaagtgtgctaatgtttctaagcatagctaagcaatcatatctaatatctagctgaaccaatatatatatagcccaactagtcaagttataataacccaaggtatcaaggaatagaataatcaatgcaaattggccataacaaaggaatagattcacaccacccaatgacattcgaaaataaatgcacagttgaaataaatagagaatttaagtataggatcaacatgctcaaaggattgtgtttaggatctatgtgacttgtcttgcaataatcggtcttcaattaatcttctgaacactcccgacgcactcacgaaccttcgcaacgacagaaacgacaagctaacacgcaaaaagaagaaaaagactaataaaaaccaaataaacagtacatataaagtaaacaaacatgtagatcatgattttagatgaatttagcaacttgaacgactcaaaaccgagttacgatgatttagttatgaatttccgaagatttaatctattagaaaaacaggaaaaagaaaaaaaaaacgatgatgacgtcagcgatgacctcatcaatggtggccggctcggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49604 - DNA, 712 bp, Oryza sativa
tccagggacataactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattagactcattagattcgtctcgcaaattagtccaagattatggatgggttttattaatagtctacgtttaatatttataattaattttcaaacatccgatgtgatagggacttgaaagttttagtcccatctaaacatggccttactgttaacaagagggccctcactgctgttgagtgttgacaagatgtggagtggctggtgcatgtacgtcttcagagtctctttcgaaaattactgacaaggaaatgtttgtctcagaggagaatggtctctctgtgaaccaaagacgggaagcaccgaccaatcgggaaacggcattagccattgacccccttggtttaacgcactctgctgcaccatgtatgacgagacgtacacgtaagggaacgtgcggtaggtagtagtagcaggcaagaaaatatcaggaaaaattcttccttgtgcagtcttgcatgcttgcagggggggtgtgcccgttccctgaagggagtagcactatcgataaatttttcctcagacgtataaatata

SEQ ID NO: 49605 - DNA, 4333 bp, Oryza sativa
tttgttgacgcgctcgcgcgatactgtgttggtttcagaattatcctgtttttcatcgggataccggtatatagcagccctcttttataaacaacaaaatccgggcattcatcaacagaaggaaacgattccagataatcaaccagagagggttaggatgcaatgctgattgatatggtctcaattctaccaactagacaaggtttacagcttcagggaaaaaaaaagcatcatcatttcatcaccaaccaaacatggcagatttctacattactcatctactggtgtatattggagaaatatgttacatgatgacatgtcataacaattgacataggacaaacttgtgacaaggaggtgagttccattttccttgctttcttgatgaaatggctcctggagactgctacctaatcaaagaggctctctacaccgggctgaatttttcttctttggcccgtaaaagaaatgcaatgatcaagtaagttgacatgatcaagactgcaacgaaaaatatatttgttgagttcaggggttacatgtctagagacctctagttgcagtaactattcatcctcaaagatcatgaggcagcaaagaggctccatgagttgtgtttcggatatgtgctctgataagcagaggttggatagcagtcacacttcaattccttctccggctcaaatgccacactcttgttgctcttttgttcaagttcatctgaatcctttagtgaaccttgttcttctgagcctttcttgcgcttttcagtatcttcgagtctttcggtaccttattttgttcttctgaatccttcgccgccttcatatcttctttcgagttcgatggcttttgactctttcaaaatttttggtggcttcggttgttttgaatcttttgacggctttgattccctggattcctttgatgacttcgaataccgggattcctttcatgactttgaatctttcgatgatttgccagactgtttagattaggcatcacagataacagtgagcaccatgacttcaggatcatagctaattatatacaacatgaaagagcacatagactagtgcatgaagttcaaagtagagcctttttcaattttcacaattgtatagtgcatgaaatggggaaatatgtaactaaattttgactcaggtaccttctttgtcagtttattgagatcttcaggtccattttcttcaataaacttatcaagtgccgtgaggaagtcatcaaatttaccggaaagaccctttttctctgagggatataccaaatatttactatctggttctttataaacacagatatcacataattttggtacacataggctgcaccgctgaaatatggcaagacaggccagcaaataaagatcaatttcatggatggccaaaaaggaagcctgcaaaaatataagatggagagaccaaggaatttaatcagtcaatgtatcatgctaaccaatcataaatttgtgcaagccaaagggagggagagatattagagcaagcatgaactaacagatctttcttccttaccattatgttgtaatcaccatccaaaccaaaatatgcaatgctaaaaatcacaattgcattattaaaaatcctacaaaccttttatcacacagcaatggcatgaattgaaccatataattgcagaacacttgtaaacttgtattgatatctctttacatttttgaaaaagggaggagggtgcacctgacagaggaaaggtgtatgtttccgtactatatctaaacaatgcatgacaagaactaaataatgcttgcagttgcagggtgaccaagtgaactcgtaatttccctgcattagaataggcaacatgtattcccccaaaaatgccaaaatggtcgaagcctgtttgttacttttttgcaactgtttttttcatgtaggcatgttagaacattgtatggtcatagctactactgtttctatgctaatgataagcatctagcgtacctggatttcacgtggtcgtgtagtcctttagtactgagagtgccaatgtggtgcctattttcagatctaaaaaatgtctattcacagctcacaaagaaaatctggcgggagattgaagaactgggtggtgagatcagggttgcagtatagtgcaacggtgagaagaaactcaccgctcacaaaaagctgggacttgggccgtgcagagctagcacggcacggcccagtgtgcttcgtgccaaattgggccgtgtcggcccagcacgccccactcgtcgtgccgtgccgtgccagcacggcctcttcaggacgcggcccaagcacagcccaatggcccgacgggcctattcgtgccgggccggcacaagcacggcccaaaagatgggagcaggccggctgcgctgagaagaaactctggcggcgacgcgccagcggtggcttgcggcttcgtcgtcccgtcgcggcgacgcggcagtgacagccacacccatcctgctcctcctcgtcggctcgtcgcggcgacgtagcccaccggcgcggcggcgtgagtcagccaacaatcttgccaaatgctagtgctggcctgctgggctgctggccttgctggttgctgctacgtgctaccgatgagccgatgaagaaaacgagctgctacttgctgctacctgctggctgcataggaaatttgaccgtggatgggtgatgactgatgacctcgtgctgcagcagccattcgcgtaccgtgccggcccaagcacggcccagtggtcgtgccgtgccgtgccgcccgtcgtgcccgttgtccaggcccaggcacggctcacgtacgggccgtgccggcccagcccatttacgggccgtgtcggaccgtgctttctatcgtaccgggccatcatgccttgggccggcttgataaagcatggcccaagtcccagctctaagcaaggggtaaactttgccccctcccccccaaaaaaaaaaaaaattggccaaaaacacatttcgcccaaaaagcctacttaaagataaaatactcagagagtttcccctaaaatataaaaactcgaatgaagttctcctctttatagaaaagttcttttaggacatgtttttacccaaaggaaacagcgttatgaggaaaagtacattcgagttaatgtcaagtagacagatgtattcgagccaacttcatccacctgacattatttttcctaatagttgtatccgagcaggttcctatggagtgacaaggcgccaagataatgggaaagtatattcgagttctctggtgcggccaagacagctgaaataacaagaaaagaaggaaaagtcttatcgagcagttgactcattcgaggaaaataatcgtggggaccacttcgactactctaaccagctggcaccagatgtcgcctagggaccactagcaaagtactattatacccctagggcctatggatcactaggggtaatacggtaactttatgtaagcccatgatgacaaagatgtaaatatttgtggtcatggtcaaacactataaaaggccgaccagagtcctgtagcaagaacacaatgaaatagagaaaaagtaccttatatacatcctgacatctacttttgggctcactctcagggtaaacgggaatctacactttcccgtttacccccaactctgttcgtgccctaaggtcgtgacagtggcgccgtccgtggggacgtaaagtctccattggagtgggcccaagtggtaaatgcgacgttctcagagaccgaaaactgtgccaattcgttacactgacacttttgcaagtgggacaatagcacttgagaaggaacttgagaaggagtttgaaagagcatttgagcaaagtgatattgcgaacgtaacaaaaacgcttgaagagaagtgggcggaacaagtcaggaaaaggaaactgcgaatccctcaaaggaggaagcggggaaaacaaccacaagtgaagtggaacttgccgaaatggcacaagcacaaggggctgttatgataagcaaagaacaatacgaaggactatagagagagctacaaagactccaggctttgcacagtcaagcaattggagcaagtggatctggtgatcaactggagacataagaggctgatggaaaacaaccaaacttggcagaaaacactcatcaaggagatactttagctggagatcctcaagtcgtgaagttagcagaagagattcctcaagcccaaattatcaaaatacaagttcccacccaacaaatccttcaaatgcaaaaccccacccaacaaatccctcaaatgcaaaaccccacccaaatccaaaat

SEQ ID NO: 49606 - DNA, 2534 bp, Oryza sativa
ggtggtactccgcatggatgcgattttgcttattttcacaccattcggcgctatacaaggcaaaactcccaatttgggtgtgttaactttatgccacgcttaaatcgcggttgtccttggccagttgtctctgttatgtggaccaaatggggaactcattggcagtcaaaatggttctatcataagattccagcagatctgaaaaccatggaaaaatgcccttttgtgttttcttgtaaatctttgagtgtcatctcagatccagctgttactttgtcaaaagactttgctgacattcgccctcgaattgaagaacttgtctctaaatttagtgttcgagacttggtcgaggagttcatttatcttggtattcgacctctttctgccaactggactttatctcttggtgaaattcctgagggttctagttctttgcttcctcctttcgagatatctgcgaatagtaagtgtttaccttgtatatgtattttttatttcaagcattatatatatatatatatgtaattcatttttttcttctttttttcttctctttttttcttttttttgcagcaaaaattgtgaaggacgtggatgggccaagcaagaaatatattggcccttataccaagaaagagcatggcacatatcttgcggttcagcaaggtagaaaacaaaacaggattctaagtgccctcggccaagatatgatggttcgagttcatcctgatttgaagaagaaaaagaagaaaaactcgaatatcaatccaaaagatgctgcatcttcatcttctgataatgaggagaatagcttggatggggagtctgattcaagtgatgaatcgtctgatgacagcggctcctctgagtcgagcgaacatactcacactgctccttttgtgcaagaaaactcgagtcctgctttgaagcgtaaaaagatgccttcaagttctcctgttgactcgaacttgaaaaaagttcgaattgctctggatagtgatgatgaggatgaaaacattctgtcttatgagctacctgctatcagtgagataagttcagttgagattgggaatgtttcgaacgttaattctctttcagctgcagctgattacctctctgctcccttgaacgttcttacttctgctgccaaagaggttgaggaacctatttgcattgatgctattgatgtggacatgaaccctgtcaatcctgtaacaaacagagaacttcctgaagttgttaatctgaatttccaatccagaaaaaacatagttgaagatcaagccacagaatgaccccttctcccgagttgataaaagatatacttggtggtttcagcgagcgatgttcgaaaaatggacaacttggttgatgggtttgcctgatttttgcgcggatggggagactagcagtcgaggttctaagttgtgtcttgatgaccttaagtatcgctcgtctcttcatcagcttggaaatgaaattgctcctagcctcatcactccggagcttgaaaaggaatttttggagcacaatgatcttatctcagcttggacggcttttcttcttctttctttttctctaactctgctggggtccattctgccacaaattttgccaacacttgtgactttatcgctgttcttgatgtgtatttcaagtcaaaaggcaaaagttccatagcccatttggcaattcttcctgctatttccttgttcgacaacacctctcctattggataagttgatggtactgttatgtcgtgagataagaaataatgtctcaattttcttgatgccatcacaatagaatatatcatcttttccacttctgtataccttgtttttggtccttgcaatgcttcggacataaaataaactggcatttgcttgttaccctgttcttgtactaagactgcgcttactgtcaccagtgtggcagctacatatagcaacaaaggttctcctttttgtggacttgacaaagttggcatgttatgaaggtaatctttgagatcgtcaaaatctttttggcattcttcgttccattcaaagttgtttacccctcttaatgtcttgaaaaagggtaaacctctttctgctgatttggaaagaaatctactaagcgaggccattctccctgttaatctttgcatttctcttgtatttttgggtggctccattcctattttgcacaattcctcttttggatactaaaaacccaagtaactttccagctctgacaccaaacacgcacttttcaggattcaacttcactgaaaacttcctcaagttctcaaacgtttcttgtaagtcttttccatgtgtaaaagctttcttacttttcaccacaatgtcatcaacatatgcttctacgtttcggccaagttgatttgccagaaccttgcatatcaatcttgcaaatgtggcacccgcatttttcagaccaaatggcattcttatgtagcagtatgttccaaaaggtgttatgaatgatgttttttcttcatcttcttttaccatgaatacctggtgata

SEQ ID NO: 49607 - DNA, 704 bp, Oryza sativa
ccacagcgacccttcatccgacgacgaaccagattttcctaacttcgaccaacacgtggcacacatcttcggtggttcaacatcctattcctttaagcgagaatgcaagaaggtagaacgtgaagtttgctccacatcccgggtatcaatgtccaaaatgaagtggtcaggtcagaagatcgagttctctgataacaacccctgatagatatccgatagtagtcgagcctactatttggaatgtcaaagttgcacgtgttctcatcaacgatggcagcacaatcaacctcctctttgcagatactcttgacgcaatagggatccctagaagtgagctcatttcttcaaagcagctcttccatggcgttacacatagtcatcatcaagattgttatggaagataatgttgcttgtgactttcggcaaggctgataacttccggacaaagcagatcacctttgatgtagcagagtttcacactgcgtacaatgctatcatcaaaagagcggcacttgcaaaattcatggggcttcgcactgcgcatactagcggattaaggttccaggacctaaaggaataatcacaataccgagaaacgaaaagatggttgtgcagtgtgacaaaaggaatctcgacatgattgagcaaactgccaccactcccgccgcaaccgagccaccccaaaaagtgagtaaacccaactc

SEQ ID NO: 49608 - DNA, 13503 bp, Oryza sativa
tgtgttgtgaacaaatttattacttcattgcagatggtaagacattcagaagccacgtcgcccttacgagaaggagcgtcttgatgcagagctgaagctagtgggtgagtatggactgaggtgcaagcgtgagctgtggcgtgttcagtatgctttgagccgtatccgtaacaatgcaaggcatctgctcacacttgatgagaagaatccacgccgcatctttgagggtgaggcactgcttcgccgcatgaaccgttatgggctccttgctgatgggcagaacaagcttgattatgtccttgccctcactgttgagaacttcctcgcaaggcgtcttcagactcttgtcttcaaggctggcatggccaagtccatccaccatgctcgtgtcctgatcaggcaacgccacatcaggtatgatgatttaactactacagatctcctgtcttgtaaatgggtaaatatgaagctctaacctttatattacaatttccatgtctcagtatgttctctctttagtttcaattcccaagtatgcttctatatgatttttctacagcagcatggaagctgtatcattctctcatagtaatcgttcattgtatattcatcatttctcttgatctagcattgtgtaggcagagctaaaatgtcattttaggcacaacacatgctctattagctgaaagctgaaggccataatatattagtattggtcctgtactcctgttaacttcccatcatttgagtgtgcagatgctttcaagttagtctttttcgtgcatttgatactcttgttgggcttgtcaatgtcgcatttgagagtgttagtcttttcatatgtagatattacctgtgatgtttaactttgaacaagcaatttggcacgcaccacttgctgttgctgtagttcgttactttacatgatgttcctttacatcaatgttcctttacaagtgttactcttttcatatgtacatattgcctgtgatgtttaactttgaacaagcaatttggcacgcaccacttgctgttgctgtagttcgttacatgcctgctgcagtgttataattctagattagcgatgatgagaccatttggcaacttcacatgattttgtcctgaaaaaggctactgccacaacattctttaatgcactctaaagttactactattttagaggacttgtcgaccataagttgaacatgatgttgctattgctaatatttttttccaagttgatagcctttctgaagttcattcattaaagtttcaaaatcactgtgcagggtcggcaggcaaattgtcaacatcccgtcgttcatggtgagggttgagtctgagaagcacattgacttctcactgacaagcccattcggtggaggcccccctggtagggtgaagaggaagaaccagaagaaggcaagtggcggtggcggtgacggtgaggaggaagatgaggaatgagaacagaagtttgcaactagttgtttccgtaatgatcataaaactctgtgctgagtaactaggcccaaattctgtagcttgcctatctgggattcagaattcaagcaggttgtgcttcaggtgttggtttatgttaaccctttttggcattatgttaggtatagacttgtggttaatgctgttttatggattcgtttcatggtaatcctcatcgtaccagtgcgcttgaactagtgatactcactcgtaccaatgctgtttttaatgtttttatggattcgaagttgcaacatggattatggagttgttaagattaatttagtagcgtctcaggtaatatttacatgttcagaccaaaagatccaaatccaatcatacagcgcattttcctacaaatggcgttcgctagatagttcactcctatgttatcgacaaattttgaagaagtgtcatcaaaatccatcgaattccatcaaaaacctgttactgatggcattattcagaagatttttcctcctgttctttttgcgtttcaatactctgctcgaaaaaaatttgtcctcctattttttgcatttcaactgatatccccatcatcctgatgtgataatcagagcaatgtacaaaattctctcaaacattaatgaggttcagaaaatttctccttttgcatttcaaaatcagtaaacagcaatgattcattcactatgcatcctgggaagaaaagaaaagaggaggcagcggccatgggaccagtgtccacggagcaaactctggacgctgcattcgggcgtcacgccggtgttggctatgctgctgctacccgttcgctggagggacgagacgagctgcctcgacgacccaccgagccggagcccaaggaggaggctcccctgcgcgttcgcgggttcggcagtgacgatgaccgcggaggacggcgtgcgttggccgagtggctaagtcgatggtggcggcgggacgctggtccgctcgaacatcggctggtcatgtaggcgtatggcctcctatgcacatatagcaaaggaggaaaatgagcagctaaccattcatagtacgcaagaaaaaatggttgccagatttgctaggtccgcgtaacgtagaatacctgtcaggcaaatgggagcaacactgctattagagcatcaaattcaccggctcgacggcgatcgccacggccgcgacagtcacccggcgagcccggaggagcatgaggccgtggcggctgccctgaccgcgagctccatggaagaccgcgacctggaagaagaagttgaggcaggggttgccggagtcggcataggtggcggatcgaatcgttctcggtgcaggccttccatagcttcggtttctatccggagatcctcccgctcctccgcggcctgtccatcgccaccaagaagctcgcttacggctgccatggcgcctgcctccacctccgcgcccgtcgccgcggcgcccggccccgcctcagccttcacacccaccgccgctgctcccggccagccgtcgccgccgcgccaccgcgccgcccgtatgctgtaaaaaatgagagagagagagatgaggaagggagagagatgatgacgtggtcacctgacgtgtgggacccatgctgactctgccgttacgtagaacaaaaccggggtcaaaaccagcaaaggatataaagtgaaccgttttgttagttgagggacgtccgatatctcgttttgcggttgagggacgattttgtatattggatgacaggttgagggaccttcggtgtacttttttctttactttgtaagtttggaataagtccatttttgtctcgctcatctcttgcgcttgcgtgaataacatccctaaactggaaaaccgggtataacgcatccttcatctctaaaaaccagagcaaatcacctccctcggtggttttgctggcggtttcatccgacgtggcgttgttgactaggttgacaagcggactcaacgtggtgggacccacatgtcagtgtgtagctctctctctcccttatctctctctcccccggcctttcccttcaccccggtgcggctcgtcgacgtgggtcgagcccaaggcggccggcggcgcattgcgacagagaaaggtagccgtgcggcggcggcgatgcggaagcgcgcacggtggcgggcggcgcggacggcgcggtagttgactatgggtgaccttgcgcagtgggccaactatgcgcgggcacggcggatggtgaggccgggcacggggtggcgcggcgcgcggcgacctggcgcggcctgatggtggcggcacgacgcggtttgccagtgaggctcggcagtgcggcggcaaggcgcggtcgatggtggcctggcacaagcatttcgtgggcgcgacgcaggtcacggaggcctttgcggtgtggcgcgcggcagccttgtgcaggcgccggcgaggtgttgatgaaaaaatcgaacacaccggcctgggagatctgcttaggtcctgtacacgtccaaagattaatgagatacaggcgtgccagtcagtttaatcctgcaactgataagatttgtaaataatagatcaaacagccgatcggctgacaagccgatggagtagttccagccgatagtcgataatagccgatgccaataccagccgatagcgatagggtttaagcaatcggctatatgtccaatgtagataatgatataaaggcaatcggctgatgatgatgtaataaaataacaatataatccaatataaactaatcggctagcaatgatatgataaataagcatcgatacgaaggttaaagcacacatcggctagaggtccgatgtcatgaaatccacaagattagattaaacaatgaaacctttgttgtcatcggctaaatccaacttatatgtatatgcaatcctcatgagccgatgcaacgtccagataactcaccggctgaaaccccgataaaacccttattggcaatcaataagcaggctagagattatggttctaagcacgacttagtagatcaaaattaactgatgcagcactaagtataaaaagaaacataatatctagacaatcaagccgatgactgattttcagggtggtagatgcctaggctaatctaatctagcaacgcgatttagccgataccggcagaaaccctaaaacgagaagcagccgatagagctaaattgatatgctaagactagattaacagagacatatgataaataggtaggcaagtatatcatctaaaccagagcaatccaagaggtcgaatgtactgatgcagccttgaacgacgccgatgtagacgatacaattgcctgggccgacggaacattggacttatcccttcgccggagatcgaagacgatgcagccccgcgtcgggtgccaagtcctgccggaacgtaaaaacaaaagtagaaataaaaatggtggcgatgcgccgaattgtattgatcgtagagatcgattacatagaccccgggtgtacatatttatacccatgggttgatacaagtccttgtcggacaagaaagaaactacctaaagataaaaggaaaatatagagtccttatcggacactaaacaaacttttctaaagataaaagaaaactaacaaactattcctaattaatagataaactgccatgccgcatcctctttaaactcggtcacttaggaataagcttcctttagtagattgatttccttaaccgaatatagcaggaatccgactattggtgacttgataactcacatcggctgattccgagatgctgcagccgataatgattctaagccgatgacatctttgccgattaccaaatttcactgttaacacgaggccagcgagcatggcgcagacggcgatgcagccagggaggcgtgacggctggtcggatcggtgtcggtacggccggcgaccaacgttcgtcggcgtcttcttcccccttttcttttttccatttcttctcttctttgtttcttgttgctccggcaattcgctcgtcatggcgcaaccgtgcggcggcggcgcgtccaggccgagcggctagcgtcatgggcagccggtgctgcagtgcatcggcgtgtggagcggatgcatgaccggtttccatggcgccgatgctgccgcttttcctttctttcattttgcttttcttctttgtttcttgtcctctccggccgggcgttgtggcggagcgacggcgccgccaagatgcggacgcgaggtcgccgctgggcgtacaggcgcggggttcgctgccggtatgcaggtgcaggctcgctgctaggacggccacggcacgaccactccccgccgccgatgcccagctcctctccgtcagtctactccccgttcgtcgctagcgagcaccgctgctgcccatcgccggccgcgcccctaccccaccaaagtgaagagaaaggccgggggagagagagataagcgagagagagctacacactgacatgtgggtcccaccacgctgagtcagcctgtcaacgggtcaacaacgccacgtcagacgaagtcgccagcaaaaccaccaagggaggtgatttgctctggttttcagaaatgaaggaggcgttatacccggtttttcggttgagggatgttattcacgcaaacgcaagagatgagggaggcaaaatggacttattcctataagttttgggctttttcacagtcccactccgtgtctgagctctgaacttgtgggcttacactatctcttgctccttccagcccatctttttgagtttacccttcgattaacctactgaagttgcaggagtaatctgtacgacatttttaaccataccattatttaacaaattaataattatgtggttatatttagtttgttatcaaatattggcaatgtgtatagaattttggcaacattattaagccaatcctaccaaaattttagcaatgttgttaatttgtcaaatttttgatattgacaaattttagtaaggttaattttgacattaatcagaacagaccctaagactaaagagtctgtgatcgactgaagttgtgacttgtcgtgcttgttggcaggctggtggccttctctgcatcacgggaaagcctgccgcgaagaagagcctaaggatgaaagggaaaaggtgtaatgtctgcaactactgctactagctgaaacctgaatgttaaaattttgtgtacaaaatcatatacgagtaaacatctgaaaactgagggctgatttggtttgaagccaaaacttgccataccaaaatattggtattttgaacagtaattttggtaatgtttgttttgctaccaatacttaccaataccacacaaatgttgctaaaatattggcattggcaaaatcttgcccatgatttggcattgccaatagtttggcatggttgcaaaccaaacaatccctgaaatcgtcgtggtgtcgttacttcgtcagtggaccgcatgagattcggcgcgtgaagcgcaacttcctacgagagacgctggagaacgagctgccggagggcaccatcaggttctcttccaagatcgtctcgactggggaagatagcaacgtcaagctcctacatttggccgatggttcaacgataggtgtgtgagatcaacaatggctagcagatcacttgtacctctcttcttctcactaagagcagccatggcctgatgcattgatgtgcttttgttgaaggtgctgatcggatgcgacggcgtgaactcggtggtggcgaagtggcttggcctgccaaagccaatcctctcagggcgctcggccaccaggggcctcgccgagtacccggtacccctcccctgatggtgcgcaccgttgctagttacttctccttgacgagcagcaacaatggcggattaattcgctgatcaatctgtcacgtgtggtgtgcacagacggcgacgcggaggagagcgtggccaagatgcggagctacgtgctggcgaaggcggcgaggatcccggcgccgctgaggttccggtcgccgctcgcgctcgtccgcggcagcatcagcaggggcaacgtctgcgtcgccggcgacgccttccacccgacgacccccgagctcggccagggcggctgcgcggcgctcgaggacggcgtcgtcctcgcccggtgcctcagcgaggccttcctcgccgacggcgccgagcacgacccggggtacgaggccgtcacggtggcgctggagaagtacgccgaggagaggcggtggcgcggcatccggctgatcacggcggcctacgtcgtcggcttcatccagcagagcaccaacccggtgatcaagttcctcagggagaagttcttgtcaggattgctggcaaaaactatgatcgccatggctgattacgattgcggaaagctatgattctgttcacgagaaatcaagaacccaagaagagaagaaagaaattggcggtgagcgggaacagtcttaattagcacatggaacaatcttgtgatgttgttaaccaagcacgagggggcgagcttaaagtccaccgtacaatgtactagtaccacgtacacactcaccatggcagatgctcaaggcaaagtcttatgtacggttttctatgcctctgtatcaaagttgagttcagcatttgacttgtgggtatgtgtccgagacaagttttgttctagaaatttcgtggacaaaataagttcttggagtacaaggtaaacccaaccttggcataatttagacacaataacaaaattgattaaaaaaaaggtttatttagagtgcaaatagcacaaacagagttttttttaaccaaaacaagtagtcttgagatatttttttttcttttgattatatgattacatgaaaatacatttaccctcatttagcacattattaagacattgaggctagaaataattccacgaaactaactaaattaaccacattaggatttcaaacacagtgggtaaagtaatatgcccataaacttagcgtcaccgtttttcgctcacggtcaccagaatgtttagaatccgatactcaattcgcaagcctcataatatttgacacccaattcgtatatgtcttccagaaattaccaatttgtttggtgacattatctcccatttttctctttttccttcttttactctacgtttttttttcccttctcacatgattggagtagtggacagttttttgcactataacaggggtcaggccagttagcagttatcgagctaaaatcgtcattcccggtttcccaccgccaaaacccactggcgggtggcggctgcctgctggcccatcgttgagtgactcaaagaagccgatcaatctcagtggcgcagaggtagcaacagatcaagctgccataatcacatggcgtggttaatcgcccgaacatatgctgcaaatgggtaaaatattaacaaaccggtttgaccaagtggcttcatccgcatccaagaatcttatatggaacccatgatttaattaggagcaatttgcagtactgccaagtgtgaggaatccctgtctagtttgttatagtgcttatcatatagccgaccataagccagtgtacatgcatggttctgtggcatctttaatatgcgaaaaaaggttgtatactagctagataagcttgtagcccaaaaaatgaatcttgaagcatctgtagaaatcggaagcaaagtgtaacgtcccgccgccttcccccaggccgggcccgcttacatctgatagctttcataggtcacacatcttttctgcacactttgtcctcactcgtgtgcacccggaaagaatttcccggtcggtcccccatcccaaattgctccaggccaagcacgcttaaccctggaattctttggagattggcttccagaaaagaagttgcaacttgttgatatgagtattctattaatcctattaagccctagaccgggatgttacaccctcacccccttaagagagatcgacgcccccgtcgatcaaccctaggccaggaacgtcatctcttggccacgtccatgtgtgataccattttgtaacgtcccgccttcccccaggccgggcccgcttacaggccaagcacgcttaaccctggaattctttggagattggcttccagaaaagaagttgcaacttgttgatatgagtattaccctcacccccttaagagagatcgacgcccccgtcgatcaaccctaggccaggaacgtcatctcttggccacgtccatgtgtgataccattttgtaacgtcccgccttcccccaggccgggcccgcttacatctgatagctttcataggtcatagactgccctcacagaccaacacatatcttttctgcacactttgtcctcactcgtgtgcacccgggaagaatttcccggtcggtcacccatcccaaattgctccaggccaagcacgcttaaccctagagttctttggagattggcttccggaaaagaagttgcaacttgttgatatgagtattctattaatcctattaagctctagaccgggatgttacacaaagggctagcatcaaccctttaaacagaccaggttgccaatcatgtaagactgtgtattacgcacaccatagcctcagcaaaagaaaaggcttctcacggagtggattctaatctctcgagaggatatcctctcatgtatctttttctttcaaatttgatacaaatagttgtgaaaaattctaaaaaaatatttggcaatgtagagtatagtgatatctactaatccaaaaaaatcaaattcaaattcgatttacacattgagaaaccaaaagaaaaggcttctatcatcactgtcagtcaagtaacttaaccagaataaaacagagggaaatatgaatttgtcagctatttctgtcactgcagctctcaccattcaaatctagaggtttgaccatatgatctatcatggccaccaatagataaagtgaggtcttacaaactaattaaaaaatgcagtacatcactacatccacaaccagttgccctaatagtccaatggagggcctcggtgacagttgacttacaagcaagcaatagtttcttttcgtagatccccatcaaccaaacaaaaaacaacaaatctgagcactgggagagctccactacccccatcatctgaaacaaaaattaatcacctatttgcactgctaaattccctagcttccagacctagctaactgatacctaccagtggggaccacctgcaattccaagaatcaaactgtcatgggcgcaactagtggtggtgatttgtctgaggggagccgggggttggattaacgcgcgtcaaccgcctaaatccaagggggtgcaacatgattaccgacgcttctcgatccaatgaccctaggtaatcacgcgacctccccggccgtaatcccatgtgctccaggcagccgagtctcgtgacctcacgtgacgcttccgcctctagctctcgatcgatcgatcccaccactaattatccactcccaaatgattgtttagtggcccgtatcataagaccggccacgtcgtgcagctagtgtgacttgggagagacagtgtaccggccatttgccagatttgcttcctcagaaaaatagcagagtcggccgggtttgcagacttgcagagatcggaagaatctttctctttcgaaatgttgaggatttttggaaggaaaacaaaagggaaatggagatataggaatcgtggcatttaaggcggcacggtgcagcgtcgtctgtgggttgcaacatgcatcggcatgtgagtctgcctcgggaggcgcgcgctcgtcgatctcgtggccgccgcacttcctatttaagcaccgccgcgggtgacaccgtcccctcctcctcagtactcagatacattacccgcaccgcctaattaagcgctcgcatctgaagccatttcgagggacgtcatggcgcggagtgccttcttcttccactgcgtcgccgccgtcgcggcgtgcatcgccgcgacggccgcggcgctcagtggcacggccacgttctacggcgggagcgacgcctccggcacaatgggtatagtttagacatttgctaattaagcctgatcagttttacacacaccaatggactggtgctgacaatggcgtttgttgttgatcgacaggcggcgcgtgcgggtacggcaacctgtactcgacggggtacgggacgaacacggcggcgctgagctcggcgctgttcaacgacggcgcggcgtgcggcgagtgctaccagatcacgtgcgaccagtccaactcgaagtggtgcaaggcgggcacgtcggtgaccatcaccgcgaccaacctctgcccaccggactactccaagccgagcaacgacggcggctggtgcaacccgccgcgccagcacttcgacatggcgcaacccgcctgggaacagatcggcgtctaccgcggcggtatcgtccccgtcaatttccagaggtacgcacatactccggtcaccgtcgtttcgccggccggcggcgcacagaatcaagtagtgatcacgtacgtatacgtatgtgtgcagggtgtcgtgcacgaggaaaggaggggtgaggttcaccatcaacgggaacagctacttcgagctggtgctgatcaccaacgtgggcgggccggggtcgatcaagtcggtgcagatcaagggaacaaagacggggtgggtgaccatgtcccggaactggggcgccaactggcaagccaacaactacctcaacaaccaggccatctccttctcggtcacctccaccgccggcaagacgctcgtcttcgaggacgtcgcgccgtccaactggcagttcggccagacattcaccagcggcgtgcagttctactagctagcggctcgcgcgcgcgcgcggcggcgcatgagccgccgccgccgtcgcgcgcttgcccaacggcgagcggcgcatgccacctgccgccatttccgttcaatttttgcatttggaaaacttgtcaaaaagaccagcttatttagcatcattctgattggggaaaaaaatgtattcttagctaggggaacgccactgtggtttgcatggctgaggcgggttccaacggtgttcgtctggccgggcggcctgatcgatagcccgccatgcctaaccgcttttacgatgattgctgggaaggaaaactatttagacgactttgcttggacacgaggtaaggagtgcaggcactgatcgatccgtgtaatgctgaaatatggcgctcattggaaggcgcaaaccacatgcgagtttactgtttgacccgatgatgatctcaatgaaatgaattggccattggccctgtaaattgactgcagtatctttgtgctttcactgtgtattttgcgttgaaatttagctcatcctgcatgtggtgaaaccacgccgactcgtgtgcacgtcccgcgagtggaggtagagtacgggatgggggtgctaagaatcccgtcaaaaaaaattagttgtatctggatgttgattttcattcctcgaggggatattccctcattgtttgtatgtcatctaaatagttattaaatttttttaaaaaaaactgataacatagactaatatgaaatatatcacttcacaaacatgcaaaattaaattcaacttctacaagttgcaatgaaaataacaaattaaactgaaaatagttatcgcacattcacaactatagttgtctcaatacaaatttagacacccccaccaacttaagcttgatctaaagtagagtaaattaagcaagaagcaccctcctttattttgttcttattccgcccttgcgtgaggagcgttatggctatgaaagacctgctggtgagctggatgagagcatgtttgctactaacgtgcgggccaattttatagattcagattgagtgacatagcataggcatgtcacaaggtgacatagcgtagatctcagccctccaaaccaaatccaacggctgag

SEQ ID NO: 49609 - DNA, 17287 bp, Oryza sativa
  unsure (1)..(17287): unsure at all n locations
gatggtttgtgttagagggcgcggtcccagcctgaaggttatattatactggctttaccataggtctaatcgtagttataacttttggtaatacacctatacaactaaaaaaaatagtctaatggatgaggatcaactctatctttaagtcgtgcccctggtaacaattactatgtaggacttaggggctgtttggttgctagtcaaaatttgcctcaatttaccacaagtatggcaaataggtttgaccaagttagtatagtgtttggttctagccacaagttagtcatgccaaactttcctttaacttgaccccacatttcatagatacaataatgtgtggtaaggaggctaagatgtggcttcaattttcttggccacaactttggcaacttagccacaaatgtttggctggcttaggtagtgttacacaaccaatcaaacagcccctaaacccaacagtttcattcttcaaatcaaacagcatgaacgttcctttgtcagactttcgatgagtttgaatcttatacaacaatgctgatttcatgtatgaaaaaagagcgacggcccgctcttcttcccccaactatatacatagccaacatggagaggtcatgcgtcatggccggtcgcagagtgcgccatagcagtgtgtgtcgatgtcatgcgccaacgaggtgtcattggagaggcagctcaacgaccggcagtccggcacagggcatctttggaagggtaagtgcaggcagccgtcaatgggtgcgttcaacggtgcccattgccaataagcacgcccgtgggagttctatgttactagactagtcgagcgcttctcttcataatattgagtgcagatcggctatcatcgtactgtcgtcgccaccaccacctattactagttactggccaccaacagagccaaccgtactaaaaattttgggagatcaaggatagagaaagagaagaaaaatgtacgaagatgaaggataatgttatcatttcgatgcctttttttttttactaaatatgcccatttaacgtggtgatgaaaatggcataaaaaataatgaaaattttatcaagtagcatataagggaatagctactttttgacatcacagaatgaaaccattcaagttccatgctatctcgtgaacaatgcctcttttaagttccaagctatctcgtgatctctaaactagcgagttgctttggtgcgagtttttctgtgtagatttgggctgaaagcctgcctgagtgtctggcccgtgagagaagcccaaggctggaaatctgcagcataaccatgggccataaatcacatgtagcccatatgacactgcatgttaacaatagcacatgttaacatgcaaaaacgcccgttcaaaaaaaaaaaaacatgcaaaaacgtggtacatatgtacacgcagcataggtagcactacttgctaaacttggatatggacggcacaaacccaacgtcccaacctgccacatttccctagtggcgacgggtctatttttttcgagacaacatgcacaaaatataaaatagtacgacgtttttattgatatagcataaaaaatataagttagaaaacagaaaaggacagtcacactaagcgtttacgtctgatcctgatgctgaaaaataaaaacaagcactcaacatccggaatgggtattctaaatgacgccaagactatcgctgtttgcctatcctaaaatccacgatgtagttttcacttttttctaatatattgacgtgcaatcttttttgcgcgttcgaaaagaaaaatgtgattttcatccgaagaaaccattgggagaatagagaaaaacaaaacctcgctctaggcggaaagcggcgtccgcaggcgtcgtagttgccgggccgaagacgacgggtgtctactgtcctgtacacatacgcaacgacagtttgccggtgccggtgccggtgcggctgccgtatcgcgtggctgcctctggcaccggcgcggccatcgaccgttcaattcaagccgcgatgaggcccgtgagcaggtctcgtgtgtttctctcccaagttgggcaaaatttctcagaatcgcgtggtcaactgctgatagcctgataaccgacagagtgattaatagcaccctgtacgtaacagcagtcctctcctcttgtagtcttgtagagtagaagtatagagtaacagtacaggagaaatactccgatccatatataacttctagcatgttcacatttcttcagatttgtattagctgttgggtagccatgcatgttagctgctaatcaagagtcaagacactgctgagttcaaataattaatatatttgacgaattcaagatgtacatacatgtacaattaatccaaaaaaagtactaacaaattaatttcccagcttgagatcatgcagacgaacaaattcctctccctgctaataactgaactgctggttgctggtgaatgtcatgccgaagctccaccagctgggcacgacgttgtagatgtagagcgtctggccgccggtggatgtgacggcgaaggagagcgcctggccgacgagccccgagttgcactgccagttggcgccccagttccggttcagcgtgatccaccccgtgcttccccccttcaccgacaccgacctcaccgacccgctccccgccacgttcgacaccagcaccagctcgaagaagttgaaccctcccatcgtgaacctgatccctccctgcctccagcacttcaccctacacatcaattaggtataggtgtttaagatcgacgaagataaagttagtgcacacaaaatgagaaagttattagcgtatgattaattgattttttattattacaaactttagaaatagatttatttgatattttaaagcaaccgttcatccgtttgaaattaacatgttagaatgtacttaagagcagtaattacggattactactagttgtaatacactgtaagtacttactgttggtagaggacggggatgatgccggccttgtagatgccgatctggagccaggcgggctcggccatgtcgaagtgagggcggggcgggttgcaccagccgccgctgttgctggggagagcccagttgggcgggcacaggttggtggccgtgatggtcaccgcggcgcccgccctgcaccactgcggcgtcgcggcggcgtcgcacatgatcaggtagcactgcccgcacgaccacccgtcgttgaacagcaccgagctcagcgccgccgtgttcgtcccgtaccccgccgtgtacaggttcccgtacccgcacgcgccacctgaacacacagagtcacacagcagcaggtctccgtgagaaacactgacaacgcaatgacagattcgtagcactccgtagttgatagagcaccaaaggttttcttacgtacccatcgtgccggaggcgtcggcgccgccgtagaacgtcgccgtccctttgttccagccatgcgccggcgcgaagccggatgctgctagcacggtgatcaccaacgacgtggcgaataagatcgcgtactccatctccgtcgagacgatagagcagagaatcgaacactgatcaggaggttaccgaggttctgaattttctgatggttttgcagtgaacgtggagggggttatataagagcaggaatgagaattatggtcagatcagagcagggaattgcagagaacatgccggcgatatctcagtcagcagtgcaagctaggctcacatgcatgcaaggaaaatgtaagccgaaccctggagatggaattgcgcgttcaatcaggtgattgatacgctgtaaacctgcaagctgggcatcatcatcagcacggcttagcattttctcctgataatcatgacctggaaaataatacatttcatgcatgtaccttgcatgttcagtaatccgtacttgccggcataaaatggatctacttagatattagtctgataatctatggacaaaaatataatttggaatgaactgtgcatgcatgccatggcttatcagcatctatgtggaatttgcaaattcttggtaggaaagaaactctgagccacatgaggccatgagggggccagcactgtcagcacatggaagatagctaggaggtggataaacaactgatcagattgattattaactcagcgcctacttagatgtctaatcatttggaaaaagctgactaaaagagtcagcagatttaattagccaccggtaccgcgcgcggtacggcgttgaaattgattacatttttaagcaggaaaaatgctgtcaagttgtgcactattatactgacttctatttgctctccctttgaattaaaccatcaggcgtacgaaaaatgtttttctttctttgggcaaagacgcatcatatgctacgatagatgcctctgcaggaactagttgcaaacttgcatacggggtacttgtgtgtagttgtgttggcatgcatgagcttgtctgtgttcgtaggatttatcattcatatccagtaaattccactgccagttctcttagtggtagagtccttagactttccttcttcccttccccactgcaaaccactaaatgattcttaatgttccctgtttttgaattattgaaatgattcctcaaaaagtttttggtggcaggttgccggtcttgatgtcaagatcgtcagaaagagggttacaaggacatacaccgagttcagctagattacagaaaggcgctggagctagaagaaatcagcaccttttgctttggacactggcaattagcggatcaaagcattttgtggcatccaagtagacaataacagtgtcagtgtaagacaaagtggtgaggactaatcgccatttggtgtagccatgatcgtgtcttccgtgtaaacataaaagtttctcaggagtcagcaggaaaatttccgcattccaaatgagaccctgatttatatcacggtagaaatgactggtagccgccagtaagtagtaactcatgaaactcagcatataatttcatttcccggtgggaacaatgtacatcaagaatgtagttttaacatcatctacgtacagaacgaatgatagatcggtcacaaacctcgagtgagattactagttcgacctgccttgccatgaatggacctgcgtagtactactactactatacacattacataggctactagtcttcactagctctctcctggtgcatgctctttccccactatgtaagcttcttcaatctgcagccttattatactgatcttgctctgcatgccgttgtagtgtgcctgttagtaggaaaactggaggttggaggagaatgactggccgaacttccaccacgccggcacgatgttctggaagacgagggtctggccgccggtggaggtgacgccgaaggtgagcgtctggccgacgaggccggcgtgcgactgccagttcgcgccccagttcctgctcaggggcatcctgtcggtgttcggccccttcacccacaccgactggatcgacccgctcccggccacgttcgagatcagcaccagctcgaagtagttgaaccctcccatggtgaaccgaacccctccctgcttcacgcacggcaccctacatacgtccacaaagaatcacagatcgtacgtagtaatgatgattaattagtgaatagttaatggcattggtttgacttaattatcatggacatggagagtcaaaccgtccaatattattgtagtatacgtacctctggtacagcaccggcacgataccggccttgtagatgccgatctggagccaggcgggctcggccatgtcgaagtgcgtgcgaggcgggttgcaccagccgccgtcgttgctggagagggcgtagttgggcgggcacaggttggtcccggtgatggtcaccgtcctcccctgcaggcaccaccgcggctcggcctggtggtcgcacgcgatctggtagcactgcccgcacgacgcgccgtcgttgaacagcgccgagctcagcgccgccgtgttcgtcccgtaccccgaccagtacaggttcccgtacccacacgccccacctgtgcgtggtcacctcacctggcctctgttagctaacgacgactctgaaactgtacctacttactggtgcgccaatgcgtatacgtacccatcgtcccggaggcgtcgctgccgccgtagaacgtggccgtgccactggaccagcctgccgtcgtcggcgcgatgagcgacgccgcggcgatgacaacgacgagcggcagaatgctcggtgtcttcttcttcttccacatcgccatgaatcttgcaggtggactagctcgccgagttgctgcaatgtagttagtgacagtggtagtagtaactatgaagaaatgcgagtgatcttaaataggagcgggatcaccggcatggaatttttgcctgcgctgcagcgcgaatggcgcatgtacgtacactgcacacactcagctccaattaattgcgtcgtcagatcggtgatctccttgtttcttcgtagcttctttgcaggcacactaacatgcaaacgaagaagaagattctctcatttctctccaccagatcgatctgcagctacgcgtcttatattcgatccgtaattaagctgatcacgctgccacttccgcatgttctctgctgctgcatgctcagctcacccaagggcaaggggaatgattagctggaactatttacgcttcttaaaccggctatcttgtgaattgtttagttgacagagttgacacgccatggaaggatttggtgagatatgagaggcaagcaagcggcagctatggtacttgctcacatgagggagagcggcaagccgggcgcaggaagaatccaagtgcgctgtcacacggatatggcgagaagatggtgaattatcaattatcaactcaccggatttgcagaagtcgccggcagcgttcacatacagtaaccagattgatgtcatttttaactatactattttttgataaagttgctaaaaaaatggtacgtttagtttgttgccgaatttagtaaatacataagaaatcctaccaaaattttggtaatattgctatcttgccaaaatttggtaagatttattttggctataatctgaataggccgcagattttctatttactttttcctaactttttaacttttaattttaaaattatccatttcaaaaacttaaatatatatcgtttaattagctaacgacattgacacatggcaacatttgtcttgccaagtctccttaatcggtgtggcaggataaaactgtcacgttcgttatgggtgatgtgacagtgttgttttgtcatatcatgtgaattaccatggctaagagatttagatcttaaaataagtttctgatgatttatttttgaaattaaaaagttttaaaaaaaataataaaaagggtaaaatatctccgtcctcgccgggttaggcagccgaaaggcccagatgattacatcggccgtcacgtgaagcccaattcacatgggtcgcagtgtcttcccgtcccaactaatacggctcgttcgaacactgaaattccgttctgaccgaactgggccgtacgttggtgacagtcccgctcaggcccaacttcaacgggccgcagattggcagcaatcccgttcgggcccagtaagaacatggctcgggcctcaggggttcggagttgggaaaagtacactgaaggtcgctcaacttgtcatcgagttacaaaatcgtcctccaaccgtaaaaccggatatagcgcatcccccaacttacaaaaccagtacaaactaggtcactcagtggttttgacttcggttttgttcgatgtggctacacgtgtagtacctcaaggttctgagtttatatctccataggagcgaatttaagagattgggttatttgcggggcaaagttttctatttcaatggccgtatatatccagttggatgtagaggctggataaaaaatatcgttctctaaaaaaagaaaagagaaatggaagatttaggtggggaacctctctcctatgattattcaaaaaaaaaagcctcgacaaacatttctttttttttctctctgttttagtctccttaagtctatggtttacttgttatctgacttgactatcacaagctcagaacggttgtttgacggaggcctagtttagttcccaactttttctttaaatttttaacttttctatcacatcaaaactttcctacacacacaaatttttaacttttctgtcacatagttctaatttcaaagcaaacttccaattttagtgtgaactaaacacaccctgaaactgcacatcatcacctgtgtactgaattctatttgtctcaaaaaaagaaaaagagaaacgaactgtcagtcacctgcagttgctgtccaccactgacaagcatttcacttttagttcgtgtgccaaaattttgaaaaatgaaatggcatattggactcaaaaagctacttcagcctgccgctgacagaaaactctccaatccgacccatagggcgcgcttgccttttgtctcagattacaggaatagtgatgtccccttctgcagagcaatgtgaagcatgagtgcatgttcagtggagtgttaatagatggaactcaaggagggaggagactggagcaggagtgcaggacacgggcatgctatgccgtacctccggcacggccaatggcacaggtgccggcacgctttgctgctgacattagccgtcctcgccgcggctgttcatcgggccgttttgttttgatactaaaaatatgcactaccaatttataggcaaattgcaaattgaatagtatgcgttagttttgattgagccaaatatttaacagtgccccctatcttatttggtcatattttagaagcttcttccttatacaataagaatttggctttatatcggtaacaatctaaatgattgctaaataattttatcctaccaatattttggtagtgccaaagtttacctagactttgacactaccaatgaattagtagggtaatgaatcaaacaagcccatcatctgtcacccagctgcagtcactctgggcatatggagacgagctaaggcctatggtctatggcggtggctaagacaccatcagcagcgatgagggggacgaggatgctgaccgactcactccacgctggaatgctgcgtcggagctccggcgaagcacgacatgaagcggcggtgaagctgtggctgccaagaggggtcggtgtttaaaactccgactgggccgacccgttaattttgatgggaataagtccacttttggtcctcatctttatgtctagtttgaaactttgaattatatctaaccacaataccggatataaaacatccctcattgccgatgcagtgatgtacccattgtaatttacgtttggaatctgtatggagacgagtattttcctacagaatttacgtttgagttatccatgccttactgaacatctatctatctatctgccttgcgagccgtgacttcattatatcagcctacaccgccttctgtcaacccactttatatcagttcacccagttaattaatttcaagtttctgtaaaaaaaaactgtatggttaaacttgtaaattcagctgctatacttttaatagatctcctcttagttgtactctctcttaataattcgctggaaacggctggaaactaacctgttcggtctaaaaataacttgcacaaaataaactaatggagtctgttgcgtattcttaaatttttttaaaaaaatcaaatgaggtcaggacaaagtcgatagtgcctggagctaatcgttctgttccaggaatatgtgctcaacttccatatgaaaacgaactaaaatcgagatcgagaggaattgctgttatgcacatctgtccggaaaaacttgtactataatcgtctgagagaacataaacggtttgtcgttgcatgattatagttaattagagtagattcttcagttgatgataataaaaaacgacatggttacctactactacttgataatacttgtcattttggatgagactaatatcaaactttatttttttttaactaattctaaaatatgtcttttttttcacgaatgcgcaaaataattatatgtcaatatatcagaaaaaaaagtgtttatttacacagtgcaatcaaccagaccggcttatgccaagcgaagggagaaaagacaaaataaaaaaaaccaaggaaaaaggaagatactactacgatagtaaacacaactctaatcaacggaaagggggtagagccacactacctgtcacaccccaatctggcaccgccgtacaacggcacctgataggagcgtgtcgtaggaaaaacggcgcgaaccgctccctacgaaaccgcgatctcagtaccagtcccaggacatagcgctggtacccacggtgacaaatatgaatcattacaatccttaaaataaatagaggacttatttaccttaacttaggttgcagctcagacagcccgagaatgcaaccgacgacacggacgaggcaaacaccaacaacaacagcagcagcggaaccaacggtctaacacccaacaccacaggcgacggctgggaaccaggacaaaacccttaatcttcactttacttcatcttcaacttcaggacggaggaactatatatatttatatagagcaagggtgagtactttcgtacttagcaagtcacgggaatttaggtgtttaatgcaagcttggaagagaggcgaggttgttttgcaaatcctttgtttgaaatcattttgaaatcactaagtgatttacttcttgttaagtttgggctgaaaagagacttgcgtctcaaatcgacttaagagatgcttttcaacaactcaattggtaatgtaccgacctcccgggttagatcattacctctcggctcccagagccatttcacttgattaatcggctcccagagcctttctcattttctcggactcccagagtccagctgcccagcagcaccacattccgcttccactcgggaagcctagtctatgatgcccgtagacatcccgaatcacacagattcgtttctgaccactcaggtcatccatctgccacataggctgattctggttacgattcccatcccacaacttttcacaaagcacaggcaaacaaatctacgcaacggaaaccacctcacatccgcccatgaccgtgggcacggctgttcgaacagttagttaacctccgcagaggggtacactttacccacaagatacgaccttattccgaacacccgtcggtgtcggaggttcgcaacaaggcctttcctaagccggcccagggttacctcatgccacatagaaggatcaaatcctcacataaatataggccattttagttttcacaaatcaaactccaaccacctcgatcggtaattcagcaagcttctcttccttgcttaccaggaacccggtttggctccaaccgaccccgccccggcgttccccaactattggcatgcgaggtttccctgaaccgactaattacttagccagggtgtcccattccaccttgtggttgcactttgattatgctcgatgagtttcccacaggaatcggtccttatatgcgaatacaggacagtgccacgcaggcacaacccccgcatcgtgagttttcacaattcattttatgtttaaacacaccgacaccacatgtcgggttttcaaggcttctcaaacccatttcccaagttttcgacaatcaacggtgcatgtgagatatttggtatacgcgctcagagagcacgaataccaaagtaccacaagggtggagcgacaaggaatcatgatagtacagcctacaggaattagtgcgactactgggtaggtccgtcggtttggcacgcaaaccgaggccaagtaagttatgtgtgtgactctaataatgcaagttgtaaacaaaataataatgattttctaattataggagcaattgatcaaagggtgacttgccttgctcaaggtcttcacggagcttcacgaatcttcgagaaaacccgcgatcggcgaaaatccgataaccgcaactatacgcaaacaaacaaaaaccaaaacaaaagaccaagaaaaagaccctatttagactaaataatagtgcgattaaatagatctcaattttatggaaatactggaagttgaacggaatcaatcagagctacggattgagagatatgaattttggaagtttaattggaatttttgggcaaaggaagatatttgtggaacaaggggaaattgatttatgaaatttatagaaataatattctcaagaatattattgtcaatttatagaaataatattctcaagaatattattgacagtcacggacgtgcgggaccaagggaaatgattcatggaattttggaataaggaattgatttatggaaaaggaaatggacggggatgtatattagactttttcgggcggcaagggcgcggcctaagggttgaaggaggctcggccgaccatttaggccggcgcgggcgcgggaaaggcggtccattagggcgcgcggaagggagagggagcggtccggtggactgagtgcacctcgcgggttccaggtggggcccgcttgtcggtgacatggcccacggtgggatgggcgcacgcgaggtgcggcgctagggtttcgggtgcgagtggcttagagcggtgcaccgggtggatggatggcggcgggcccacgtgcagccacacggcttgccgtggaccgcgcgcacgggagggaagacggagggagggggcggctgactggcttggcccggtcaaagccgaggtggcgccgacgtggcgcctacgtggcagccacgcgggccggcgggaggaggaagaaggggaggccgagatggacggcggacggcggccaagttcaccggagctcgtcgcgacgattcgagagagagggagtacaccggaacaatgggaaggacgagagggagtgagccaccggatcggatttgccgaaggggattcgatggcgacggatttcgacggtggcggccggcggcgatcaagagggggaatcgcggcggggcgacgataggtcgattcaaggaggagggagcatctccggggcgcggggaactcatttccggcaccggatggggcggaggactgccgaggagggctggcgatggcggcggcctccgggagcgggcggcaacggcggcaagcctatggcgggcggcggcgagacctggggcggtgtccatgcgtgttcgggggggctggccgagctaccacgcgagctagggagggagagggcgagcgaaaagagagaacggagggtggcactaccaagccgggacgggcgcagttgtagcgcccgttccgtcgtggcgcctagcgggaaaatgtaatttctaaaaaccttaattgcgaaaattgtttcttcgcttgcagtcagtctccgtgccattccggatctcaaatccccgacctatcgtcacgttcaaatcccgaatacaaatccttcccaattcaaatccctccgcaaaagtctattttgcctccctcaggttcgatgggccgaattcctctcggcccatctctctccccctcannnntntntntntntntncctncctntntaccccgctctgcccgcccgccgcgcgcgcgtgcgcgtgagcccgccgagccgagcacccttcgcccgcgctgcccgttgcttcccgcgcgcgcacgccgtggtggccgaccgcctggttgccgccgctgtcagcctctgccacgcctgccgcccgtgtcgccgctccgctccacactgcccccgccgtcatcgccgtcgtcacaacccggccccgccactccgcgcgctagcctccaagggacggaggcagagctcctcctcctccctctgccgcgtcgccccctctccctcctccttttctcaaagtggcaaggggcaagccccctttccctcctcctttttcccttttctctcccgccggcgtcatcccccccctgtcgccgttttggccgcgaccgccgagcgctagccctctcccttgaccgccctaggtcggttcccaaaccgacatcgccatcctataaagcccaggcgccctccctcccttctcctcttgtttgtcccatcgcctccactccattggcgccgcctcccgtgctctgttcgccgccgcctttcgttgccacgcgtgccggaggagccggcgcgttcgtggacgcggaaggggactccgggagctcgtcttcttcctcttccccggcccgaggccggagagatcactcccgtgccgtcggcctcttgtcacagcgccccgcctcgtctcggtagtgcatccctccgttctccctcctcgctccatctcttccccttagctttgagtagccgctcgagtagtaccccagtactagttggcgccgccccagcgccgcgccgccgctcgcagtaggctcgccgctgtcgccgcccgagctcggaagcgcctctcgtcgccggcctccctcggtgcgtttcctcctaatccggcgcaagggacggattcccggagtcgcgtagatgctctagctcgcccgaatcgatctcccgtcgcgccgtcgccgtttcccccttccctcgccgccggttgccgccgccgcaatccaccgccgtcgagccccgtccgacgaatccgagccattggcttgtctctcctcgtctcgtgcaaccacccggtgtgctcgctttcgcctgtatcgccgtggttcgccccgccgttcgcagccaccgtccgccgtctgttccggccggcgccttcttcaacctcccgccggcccgcgtggcagccacgtaggcgccacgtcggagccacctcggcacgaccggatcggctgacccggtcagccgctcccttcgttccaccctcccccgtgcgcatggtccacggtgagccgcgaggctgcgcgtgggcccgccgcacccgagtcccccgcgagccgcgcgcgtgcgccgcgccccgcccaaaccctagcgccgcgtcgcgtgctccctccgtacggtgaaccatgccgccgacaagcgggtcccacccgggaccacgcaaggtggacccggcccaccggctccctctctcctctccgcccccgcgcgcgctttgggccgccttcacgggccggccggcccgtcaagttcgaccgagccgcctgcgaagtctaatttccctccctctttcttttcttttcctttttttttcaaaaaggatttaaataaatccttttcctttagacaaaaaatccaataatcttagaaattcaatatcttcccaaccgtaagcccgtttgactccgttcaacttccaaaattccttaaatctcgagatctatctaatggcacgcctagaggtcaatagtagggctttattttcgccgtttgttgtgttgtcccatttctcgtgtagtttcggagcccgaagacccgcagtgcgaggattttgaggatcaagctcaagatctcgagcaaggcaagtcacctttgatcatcttgcacctataatttaaatctaagtatttcttttccgcaaataatgcatgaataggatttacacaagtaattcggccgtggcttgcgagataacctgccggccccccaatcctaattgctgcaattaccctccttgaattattgaacacttaaaccccctttgtcgactgttgtgcttcgatgcacgggccttcaagcacgcgcatcgggacacctctcctcaaatttaaaaatatccaatgatgggtaaaacttgggttttacaaaagacttggaaaaacccgacacctgggtcggctcttgcgaactaaatgaattttcaaattcgcggaccggggaacgtaccgggagtacggtttcccgctcttgcacttaaggaccgtttccttggaattacatccgaacataagacaagtgcgaccacatgggtgaaatgggacacccctagctgagtaaattgctaatcgggggagccttgatgccaagagacatgtggattcaacggggtggtgtcggggagaacccccgggcttcctggcacagtatggtctgggacctaatctggtgttagtctgggacccctctcgttggcatacggtgaacctgtgtcggctttcgaaatgccttgtcgtgaaagccccaaagtcaccagacgtggctgttatgcacgggctgggtgaccaaggctagtaacgtcgtgtgggtaaggtgtaccccctctgcagaggttaacaaactgttcgaacagccgtgctcacagtcatgggcggatgtgaggtgattcctagcgtagttttgtttgactactgcttgtgaaattactgctgtggaatgggttcgatgtttggaaaatcggcggctgatgggatcagccaggcccgggtggccgtttgaaagctgttggccgggtgctaaccttgatcaattcaaagactgatacattgcacatactccgaccggacgagacgcactgtctcatccgtgtcatttgagaagcactcacctagtcgtttcaaaaaagagtttaaataaaatcaattgcaaaaacaatagcctttcctttgaagcctgcattaaacacttaattcccatggctagctgagtactcatgtactcacccttgctctatataaataaccccccccagttgctgaagaagatgatgtggcccccgctgacgaggagttcttctaggagcaagtcggctacgatgagttttagggtttcgacctagttcccaagtcgcgcctgtgatgtttggcccaagtcttggtttccgctttcccttttgtaatgcagttgtgagctcgggatctgtccgcagcccaacatgactgtactcctattctataataaagagacctctgttgctgtgatatactgtcttcctgtgataccagcactgtttcctgggactggtatcgattaacaggttaatttggagcgtcacgggctagtttcgttcggggctagttcggggcgtgacagcagtggcgagcggccgacggctcgggagcgagctctccggcctcgggccggggaatgggatgaagagggatggccggagtcctcatcttgcgtccacgcacgcaccggcctccgacgcgtgcgacggcgaagagacgaaggccagagctgggagcggcggcaaggcgtcaacaatggcgcggtg

SEQ ID NO: 49610 - DNA, 3550 bp, Oryza sativa
gtattataaaataagggtgtattatagtttgttacctcagccagcggaaacagtgtgaacatgacatgtaattagaaagactctatggctaacattcaattcagctatagcttgcgtgatggctagcagaaacgacattcgcgtgcgtaaatgatcaagagcatttctgctgttcggaacatttctgttattccccgcggacaagtcacaactacttctgttcagttttaactactcgattggaaacttcagtttcaaggtacgacttacagtttctgacgacagtagagcttagaccagcaaaccaatcatgcatcattacgcgttagtcaatctctcggcgtttgcagagccatgtgcatgcgatcgttggaacagtgttcgcatgcttcaataatgcataacgacaatcattccctagcttaattaattggtatgcaatccatgcctctctgcagagttcagacctcctagatcttattactactatttaagcaccaccaatgccgcacacatccctcacctccaaatccattcttcccaacaatatctagctgcacctgcgcaggagacctagctatagctacaggaaatcatggggaacattgtcctgcagctgctcgcgattcttgcactctgcattgcaccggcgaggtccggctggctccagggcaccgccacgttctacggcggcgccgacggctccggcaccatgggtacgtcgtcgtcgtctactccatttcctctcgcatcgcattgtgtcaaccattgcacggcaatgcatcatcatgcataatgcaagacacaatctgatggaatatatatgttggaacaagtgcatatgggatggtctcgatgggattaaccgctgatgtgcatatgtgtgcaaacaggtggtgcgtgcgggtacgggaatctgtacgaccagggctacggcatcaacaacgcggcgctgagcacgccactgttcaacaacggggcgtcgtgcgggcaatgctacctcatcatctgcaactacgacaaggcgcccagcgggtgcaggatgggcacggcgatcaccgtgacgggcaccaacttctgcccgcccaactatgacctcccctacggcggctggtgcaacacgacccgccctcacttcgacatgtcccagcccgcctgggagaacattggcatctacagcgctggcatcgtcccgattctctaccaacagtaagaataatactatcagtagagaccaccgtaaaagcactctaaaacgaagaagttgtgtgtgtgtgtgtgtgtgtgtatatatatatatatatatatatatatatgcatgatatcatgaaatagttaacacgttgtggtgtgatggattatattgaagggtgaagtgctggagaagtgggggagtgagattcaccatcaccgggttgaactacttcgagctggtgttggtgacgaacatggccgggagcgggtcgatcgcgagcatgtcggtgaagggctcaagcacggggtggattcagatgtcgaggaattggggcgccaattggcagtgtctcgccggactggctggtcaggcgctcagtttcaccgtcacctccaccggcggccagaccatcgtcttcgacagcgtcgtgccggcggggtggtcgttcgggcaaaccttcagcacctaccagcagttcgactactaagctatatatgttcagacatcaggaacatcaagatcgtcgtctgaaatgtgaatgtctgatcgatcgagcattcatacttcgttttcatttgtaattaagctagagcgctctaagatcgagcattgtttattgggatcattaattcatttgattgttcagttgctaattgatggatgtaaattaagttgcaatatatccaaggcaatcattattaaatgatatgaaattgctactgaagattgcattccacgagtattcccgtatatcatgaaatgtgtacgtgctagctagtagtagtttcttcatcatggatactatacaaatatatctctttgtactatgcattgttgatgcgtcttaatatacatttaattaatgtactctctttcatctagacaccaccctttgactgttggaattatatgggcaagcccatgtagttagacaataatttctgaaaaaaaatctcaaaggcccaaaaaaatgcacgtaaaatttagtaccatcttactgattctagaagtatgagatcgctttaaaagcgtggtgctctctatatgctactctctctccgtcgccatggttttccgcgtccaactttaaccgtttgtcttatttgaaaaattttgaaaaaaattaaaaatataagtcacaagtaaagtattatttatgttttatcatctcatagcaataaaaatactaattataaacaaattttaaataagacggacgattaaaattaggcgcggaaacttatggttgcccttaaaatgagacggagggagtactagagcaatatgcatggaagaaaactaaatccggacctgttacgctaccttactgtttgtgtgtgtgtgtctgattgagctgcaaattttcatctgtttgtgtgtgtgttttcttttcttttcaaaaaaaaaatgtttgtgtgtgcgtctgattgagctgcaaattttcatcctttgggcttgctcacgcaactacgcatgtaggccttcgggcttcggtggttcaacccaaaaccaaatttccatccttgggcttgctcacccaactacgcatgtaggccttcggtggttcaacccaaacccgtgtgacactcaaacaagccaattaaaccatttcattttcaagaaatctcttcggcctttctttgacaacttgtttttgcgaacatttctttgacaacttgcataacatgtgtgatctgtgtgtgttttccggtgcctcgtttcagtgttttcgcggatgcgaccctctaccggctggtctccagtttcacttcctatcaattccaagctttatatggttaaaccggtaattccagctgctacaattttaataagttgaattactaaaccacattcgacattcgataggaaaaaaaggaggtaaaatcttacaaacttctaaccttcatatctgcttcgccatccgtgctccagttagccaactctaacgaccttgttgaactctagcggacaacaacgacgatcctaactgtttaggatccggattggggttggggtgataggggtgggaagagggggaagagggggagtccgccagctttacagagatggccgtgatcggcggaagactggtagtaggtggtggaattgggcgggcaacaaagtagcgcccccgaaaccgtggggatgaaggagggcggtgggctggcattggctgcggggccaaaacaaagcgactagttaagaggtagtgggctagtggctaatggtggtggatccagtggtagggagtcgatagaaacaaggaagatcaccttgttgtcaccgacttcaggaggagtggacagagaggggggagggggggcgaagccagtcggagggccaagggagaggggg

SEQ ID NO: 49611 - DNA, 7455 bp, Oryza sativa
gggagaggggaggaaaatgacaagataattgttgcgtacaaatcttaaagtatatctaacggtccaaaatttaaaagatataagctggatttcatgtcacaaaatatatagactttgatagatcctctcttagatatatcaggtctcttacaataattcgttgggcctaactaagccattttgtctaaaaaaacctgcaaaaattaaatcaaaccaaggcatgtcaaagtcgataatgcttgaagttaatcattctgttccaggaatatgtgctcaacttccatacgaaatggaacttaaatatatacagggtgaattgctgttctgaacatgtctgaaaaaaaacttgcactataatcggtttgccgttgcatgattatcgttagagcagctgcttcagttgaaacttgatactaaacgacttacatggtggtgtactatattaattaatctattactataatctatcgatcgggcaaacaatgagtattactcaattaattatgactgcaatagagcaatggcggatacagatgtgaattgaatatgccccctgaatgaacagaacggttagttatgtgttcaaagaagcaaggtataaaattattgctattgtacgtgcaatgaagagtgcagaccttgcgctcccactaatcgtagtggaattcatcagcaaaataaataaatcatatagaaatagagtttttttactattttcatcatacgattcttgttggttgacctcaagcactgaacaagataatgcaaattatttggctatttcaatgtctggctcgccagtagttggaacttgggagagaaaaaaataagcagcggctgcaaagggttcaagggagttgagcctgttgtagttaggtggtactgaaaggataattgattcagaaaagtgaaatactccaacgtcctttccattccaacttctcgcttgtccaattaagaactttgaaaaattccgtactaattaagaatttcacggaacgaatttaggtagccaataaatgagcagatgcatatttttttattacaaattaaaactgattgagaatttctcgttgagaaatctgtgtgtgaaatatttctgatttagaatttcatctctggctggtaaaactgatatattacagtttggcacatcaggaagtatatttaattttttttaagatgatggatagaaatccgatcctatattcacacacatacttaaagattacatgggtacttaaggcacattctaaagagataattgagcttaactactactcgttttctattagcatgttttttaaactattaaacgatgtatttcgtgcaaaactttctatattaaaaatactaccttttcaaaataaaataatttgatttatattttttaataattaatacttaattaattatatgctaataaagtttttattttgcgtgtcgctaaataagacaaaacgttaagctggaaagaacgtgtcctaacactccaaatcccataactgacacaaaagaggaaaaacaacaataagaaagataaattttacagttcctaagatgtactgtatcaaaacttttaatgcaaacttagctcctctcggtacctacttaactactataaaatcactaaaagaaaaggtaaacacgatatgtagttagaaagattgtatggctaacattcagtttagctatgcatgcttgactagcatagaaacattcgcaagcatgcatgttcagagcatttctgttcttgctgcgaaaacgcaacgacttgtgttcagattgaactgaataatgctaatatacgacttatcatttctgatggaggaaacggtacgtagagcttagaccagcaaaccaattaatcatcatttcgcataagtcaatttctggacgttgcagagccatcagccatgtgcaacgatcgttggaacagtgatcgcatttttcaataatgcctacgacaatcattcccttgcaatatgtaatccacgcctctgcatgcaggcctcctagatcatagtactatataagcaccaccattgccgcatacatccctcacctccaaatccattcatcacaacaatatctagctagctagttatctagcttaattactctcgatcgactgcacaggctcaacctagctaagaggaaatggggaacattttcctgcagctgctcgccgttgttgcactctgcattgcaccggcgaggtcggactggctcccgggcaccgccacgttctacggcggcgccgacggctccggcaccatgggtacgtatacgtcgtctactccacatacggcccaaatgtccgactcacgtacgactgaatttgatttatttgattgccatggattaaccggatgcatgtgcgtatgtgtgcatacaggtggtgcgtgcgggtacgggaacctgtacgaccaggggtacggcatcaacaacgcagcgctgagcacgccgctgttcaacgacggcgcgtcgtgcgggcagtgctacctcatcatctgcgactacagcaaggcgcccgactggtgcaagctcggcaaggcgatcaccgtgacgggcaccaactactgtccgcccaactatgacctcccatacggcggctggtgcaacgctacccgccctcacttcgacatgtcccaacctgcctgggagaacattggcatctacaacgccggcatcatccccatcctctaccaacagtaataagcacatttaccgacctgacatctcctgaatttgtatgtgtgaattctgaagcgaagcagtacgtgtgttgtgctaaaccgttatgctatgaattgcagggtgaagtgctggaggtacgggggcgtgaggttcaccatcaacgggttcaactacttcgagctggtgctggtgaccaacatggccgggagcgggtcgatcgcgagcatgtcggtgaaggggtcatgcacggggtggatccagatgacgaggaattggggcgccaattggcagtgtctcgctggactggccggacaggcgctcagcttcaatgtcacctccaccggcggccagaccatcgtcttcgacgatgccgtgccggcggggtggtcgttcggccaaacattcagcacctaccaccaattcgactactaagcagggttcagacgtcgacaacatcgagatcgtcatctgaaatctgaatgtctacgatcgatcattcttgtttgggatcatttattcgattgttcagttgggatcattcattgatttctaactgatggatgtaatttgagttgcaattcaaggaaatcattattaaattatgtgaaattgctactgaaaatcacatttcatcggtctgtatgcatcataaaatgtgtatgtgctagtggtttcttcggccccgtttggcacagctctagctcccaactccaacttacctagagttagagctgtgccaaacggtacagatcctccattttttgagtggagctagttgagctactcatagaaaatgaactacgggggttaggggtggacagaaaaagaccgaaccgaaaagaccgaaaccgaaaaattcggtcctaggtagtgaaagaccgaattttgttcggtcaatttggttagtctcctcggttaaccgaatagaccgaaatatcaaaaaattctaaatgcaacctacaatccactatatttaataggattaaactctaattttcacatccctacttcttctaggcatgcaacctaataaaagtctttactcataagtgcttaacgaatttttttgtgatttttgtgttgaaaatttccattttttctttgcatatatgaaaatattgttgaatttcggtcaggagcgagaccgagaccgaatttatcggtcctgactttttgcgctgaaattcggttttcatttttcaaagaccgaaaagaacgaaagaccgaagaccaagaccgaaattttcggttagaccgaatgcccacccctaacggggatggagctggatttttgctgctccacagctccactctaccccaaaagacccactaccctttaattttttagtctatttatacaaaaatgccactcaactgctctttcagtcctcctctcctcccccatcttcctcccgatccaaaccgagctgcatgcggggagcggtggcgtcggtgggtagcggcgacaggccgaaggcgcgcggaagacgacatgcggccggcggcggccggcgcgcctggggacggcgcacggccggcgggccggcggcggatgcggaggaggatgacagagcggcggtcttcttcaacccaggcatgggctctgggcgcaagggtggccggttgtttgtgcctgggtgtcacgccccgaactagtcccgaccggaactagcccgtgacgctccaaattaacctgttaatcgataccagtcccaggaaacagtgttggtatcacagggagacagaatatcacagcaacagaggtctctttattatagagtaggagtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcaggatccgcttcatcttcttcagcaactgggggggaattatttatatagagcaagggtgagtacgggggtactcagcaagccaggggaaataagtgtttaatgcaggcttcaaggagaggctgttgtttttgcaattgattttatttgaactccttttttctaaaaacgactaagtgagtgcttctcaaacgacacggatgagacagtgcgtctcgtccggtcggagtatgtgcaatgtatcaatctttagatcttgaaacaaggttggctcccggccaacagcttttcaaacggccacccgggccaacaacttttcaaacggccacccgggccaacaacatttcaaacggccacccgggcctagctgatcccgtcagctgctgatttttcaaacatcgaacccattttctcaacagcaatttcacaagcggtagtcaaacaaaactacgctaggaatcacctcacatccgcccatgaccgtgggcatggctgttcgaatagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaacggtccttaagtgcaagagcgggaaaccgtacacctggtacgttccccggtccgcggttttggaaattcatttagttcacaagcaccgacccaggtgtcgggttttccaagtcttttgtaaaactcccgttttacccaaattgttactcagattttaagtttgaaggcgaccgtcgatactcgcacagagtgcacgaatatcgaggcgcaactgggtggttacaaggggacatggtatggcaattaacaatcgaaggatcaaatgcaacaagtcaggtaggtccaccaatctgccttgcagatgggacaaaagattaagtgcggtcctatcaatacataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacggcgaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttaattaaatcctttttggaaaagaaaaagaaaagaagggagaggggggaatatagacttttctcgggcggctagggtgcggcccaagagatttggggcggctcggccgagcttaacgggccggccggcccaagacggcccaagcgcgcgcgcgcgggagggaggagagagagtccggtggaccgggctcaccacgcgtggccccgggtgggacccgcttgtcagcggctcggctcaccgtgcggagggagcacgcggcgcacgcgcgcgggcggggaggaacgcggtgcacgcgcgcggtccgcggcggacgcaggtgcggcgggcccacgcgcagcctcacggcttgcggtggaatgcgcgcacgcggagggaccgaccggggtcggcccgacccggtctgggctgagctggcgccgacgtggcgcctacgtggccgccacgcggaccggcgggaggtagacgacgatccggccgcgaatggacggcgggcggcggcggcgagcggcggagcgaaccacggtgatacgggcaaaagcgagcacaccgggcggttacacgagacgaggggagacgaaccaacggctcggatttgccgggggttgctcgacggcggcggattgcggcgtcggcaaccggcggcgggagaagagggaaacggcgacgaggccacgagaggtcgattcccggcggtgagagcatctatgcggcttcgggaactcgacgctagcgtcggattgggcggaactacgccgagcgaggccggcgacgagcgggtgctacggagctcgggcggcgacggcggcgagcacacggcgagcgacggcaacggtcggggcggcgccggctaactacgggaaggctactcaagctactaccgaaagctaggggaaggagatggagcgaggaggaagaacggagagagacatcaccgagaagaggaggggcgctgtgatgagaggccgacggcgcgggagtaatctctccggcctcgggccggggaagaggaaggagagggtgcggccggagtcctcttccgcgtccttgctcgtgccggctcctccgacacgcgcaacgacgatcggcgacggcgaaacagagggcggcaatggcgcggaggcgaaaaatgagggagtttggagggggagggcttgggcttaaatggacggcaatgtcggtttgggagaggggaaccggcattgaacggtcaaggcgcgagctggcgctcggcgcttgcagccaaagcggcggcaggaggatgacgccggcgaggagaaagaaaaggggaaaaaa

SEQ ID NO: 49612 - DNA, 7423 bp, Oryza sativa
cgggggagagatgggccgagctggattcggcccatcgaacccgggggaggcaaactagacttttgcggaggaaattgatttggagggatttggattcggaattgaactcgacgatagatcggggattgagatcttgagatggcacggacactagacaacaagcaaagaaacaaatttcgcaattagggtttttaagagataattttcccgctaggcgccacgacggaacgggcgctacactgggatgacaagctgcgaccgctccggcgccttgtgctgtggcggcgacggccggcagccggcggcgtgcctggggccgccggctaggtctctttttttcattttttttcattttttttccagatctagagctgaaaggtagcaaaaaacttttcaacttttcaacgagtcttcaactctaacaggagctagctctcactggagttggagtttggagccctaccaaacgaggccttcatcacgggctcctacacaaatttaatatggtggcccgatgtaaatatatctctttcgtcttcgtggaaaccgtatggacatattatgcgtcgtgcaaacttggtttagcttgtgagcggcatgcaaaacaagataagctattagcacatagataattaagtattaatcattataaactttaaaaattaacttaattgtttttttgaaaaagaaacatttatataaaacatttagaaaaaaaaaacacatcatttaacagtttaaaatgtatgctaatggaaaacgagaaagttgtagtttagatttgaaaaaactagacctaataagttgacattaatgtactctctttcatctagacattagcctttaaggccccctttgattcaaaggaaattcataggaattttaaaggatttcattccaatttttcctatatagccctttgaatcaaaggaatgaatactatggaattctatgaaattcctatggaatgcattttcccatgtaagttttggaggaaatttagcatgaggtagaacctcatgttaaaaatcctttgagtttttatctctcctcaaattcctgtgtttttcctatggctcaatcaaacgaccatttctacgtttttcctgtgttttgtaattctctcttttacacttgtattcctgtgagaatcctatgtttttcctattccttcgtttttttcattcctatgatttaaagggggctaagtgttggaattatatgtgctaaatccatgtagttagacaatagtttctaaaagaaaaaaaatcaaggcccatcacatgaaaggatgcacgtgaactttagtatcagcttactaattctatgaatatgagatcactttttttaaagtgcggtgctctctatgttactagagcaatatggatgagagataactttaagaaaagcgcaccttaaccactcacttcacggagttttgtcatgttgtcttagagtggctagaaattcaaaccgggtatgctaccttattcttttctgcttaatggatagattgattaacgatacgtttgctaaactgctaaacgatacaatgtttgtccctttttgcatgttaacatgtgagggaggatgttcatatggaccagaggatccaattgcctacgtacatgtccttttattgggcaattgactatatgtgatttatggactatgagtccatgattaacgacacgttcggcttaactctcgggcccaggcatgctggtaggccttcgatggttcggcccaaatccgtgcgacactcaaacaagttaagccatttcattttcaagaaatctcttcggtctttctgacagtttttttttcttttgcgaacatttctttgacaatttgctaacgtgtgtgatctgtatgtgttttccagtgcctcgttgcagtgttttcgcggatgcggctccatgagatgctaccggctggtctccgatctccactccttatcatttcactcagtcaatttcaagtttctgtacgaaacctttatatggttaaactggtaaatctaacagctacaattttcataaatcttttcttagatgtatcaggtactcttttataattcgatcggcctaaccaagctattctgtctaaagaaacttgcaaaaattaaaacaaaccaaaaacatgtcaaacgatataatgcttgaggttaatcattctgttccaggaatattgtgctcaacttccatacgaaaaggaacttaaatatataaaggctgaattgctgttctgcacatctgtctgaaaaaacctgcactataatcggtttgctgttgcatgattatcgttagagtagcttcttcagttgaaacttggtactaattaaacgaatatacatatttgggcatattaataaataaagtatactctatagtaattattgatcggtgaaaaagtgattaataatattctatactacttaattaattatgactataataatgcaatggtgacgcatgtgtggatcgagtgcccccgaatgaacaaaacggctagcatgttgtcaaagaagcaagatatgacactattgctaatggaatggttttttaaactcttgaagatgtttattgtatgttatccaagtaattatgaaataatttgataagatatataatatgtgttatatcacttcacaaaaattaatctctataagtttaaaaaataacaaatttaactatagtagttaacgtatatttatagtcaagtttgtcttttaacttgtagaagttgaattctaacttacatatttgtgaagtgatatattaatctatcttgacaaatttttttaaaaaaaattcgtagatggcgtgtgaagaacaaggggacattcccttgagagtttagaattgtttcccttattactggtgtcgatcgacaaaccggtattttgtatatgtgcagaattagttactccctctgttacaaaatataagcgatctccaatattcaaaattagtactacaatataagcatttctatgacactatgacactgattctattataaggaaattcataggttttcaacaagtcaagtgtttgggagaggaatataagcgattcaaaatttaaccattatggtgacagaaagggaatattttcccttaaccttagtgtttgtaaataatctatataaatgcttatattttgtaacggagggaatcctaattacgctgtaacacatcagaacaagaaattcataaagatatgcagtattctactagttgatcatacggttctggtggttgacctaaagtactgaacaagataatgcaaattatttgactatttcttcaatgcgtcgccagtggttggaatagaaaaagagaagaagttgtggctgcaaagggtttaagggagttgagcctttagttagacacttagacagtactgaaaggacaattaattaagaagtgaaatactcctactactcgcttgtccaattaagaaatttgaaatatcccttacaaattaagaatttcatggaacgaaattaggtggccaataaatgagcataggcatattttcggtgtggattatttctgatcgatatataaaattgacatgttacagcttggtacgtcaactagcagaggatatgctagtagcaataattttattttttgagagagaagcggaggatataatttcgttagccaaacagagtaaaacaaaatgccctagtcgactggaagaatggtactccagttcagctatagcagaaacattcccgtgcatgcgtgatcttcggagcatttctgttcttccctttcacaacgatcgacttctgttcggttttaactactcgacttgaagaatgctaacatacgacttatagtttctgatgcagcaaacagtgatcatcacgcgtaagtcaatctctggacgttgcagagccatgtgcaagattcaataatgcatatgcgacaatcattcattgttatgcaatccatatccattcctctttgcaggcctcctagatcactatataagcagttaagcaccaccattgccgcagacatccttcacccccaaatccagtaatcacaacagtatttagctgcaaggaatcaagctagctgtagcaaacagaggagatcatggggaacattctcctgcagctgctcgccgttgttgcactctgcattgcaccggcgaggtcggactggctcccgggcaccgccacgttctacggcggcgccgacggctccggcaccatgggtacgtcgtcgtctgctccaccctctggaatagcattgtcaattatgattgacaaatgacaatgttgcatgcatgcatacgtgtactttctctattctaaaataaatcaaactaaggcgaaccttactccccagcacgcaaaataaagtagcgtttagcacatcattaattaagtattagctaaaataaatttaaaaatagattaatatgacttttgaaagtaactttcgtatacaaaatttttgcaaaatctataccgtttagtagcttgaaaaacgtgcgagcggaaaacgagagaggtgagttaggaaagtagagataagaactcagccctaatgtgggatgtaacatctaagctcctagtactaagggtgtgtttagttcacgccaaaattgaaagtttggttaaaattggaatgatgtgatggaaaagttggaagtttacgtgtgtaggaaagttttgatgtgatggaaaagttggaagtttgaagagaaaatttgaaactaaacacgacgtaagatattattcaaatttgtagtattaagatatgtaacattttataataataatagattgatttattttgaaacgaaggaagtacgtcatatgcaacctgaacttgtgacagaatatttgggtgcatctgtacttgcaggtggcgcgtgcgggtacggcaacctgtacgaccagcgctacggcatcaacaacgcagcgctgagcacgccgctgttcaacgacggcgcgtcgtgcgggcagtgctacctcatcatctgcgactacggcaaggcgcccgactggtgcaagctcggcaaggcgatcaccgtgacgggcaccaactacggcggctggtgcaacgcgacccgcccttacttcgacatgtcccagcctgcctgggagaacattggcatctacagcgctggcatcgtccccatcctctaccaacagtaataagcattaaccaacctgacatcttctctgcatttctatatatatgtctgaactctgaaacgaatcaagtgtgtagtgctgtttgtattgaaaaatttgcagggtgaagtgctggaggtatgggggagtgaggttcatcatcaacgggttcaactacttcgagctggtgctggtgaccaacatgcccgggagcgggtcgatcgtgagcatgtcggtgaaggggtcatgcacggggtggatccagatgacgaggaattggggcgccaattggcagtgtctcgctggactggccggacaggcgctcagcttcaatgtcacctccaccggcggccagaccatcgtcttcgacgacgccgtgccggcggggtggtcgttcggccaaaccttcagcacctaccaccaattcgactactgattgagctatatatgttcagacatcaggaatatcagatcctcgtctgaaatctgaatgtctatctgatcgatccagcattggtaatctgtttcattgtaagatcgagcattatttgggagtaccattcatttgatcgttttaattgctagtcggtggatgtaaatcaagttgaatccactgctatctttaatcgatgtgaaactgtagtagtaccactgaagatcacattccatcagacttcgattacatcataaaacgtgtaccacatgctgatgacagccgacgagtcatattcctcgatggaagcagagtggcaattaaaggctacgactagagaggctcacgagaaaaatacatgtacaagtacgcaataatatcaacaccaaagccatcaaataattcgagactcgtacacaagaaaactgacaggaagacagcggttgagctgattctgaacgaagcctttcgtgtggaggtgattaccaaacgagacgagctacgcaggacagacagcgtcagccgctgtctggtgatgcatgacagcagagacagctctggggatcgcaacaagagcttttacttgtggacggacgcttgcaaaatccatcgacgatcgtgggacgtggctagctcggcgatcaatccaaaggagtaccaggagactactagctaggagtgtggaaccttatccaacaacacaacaagacaggagaagataaaggccccggattctcacgtaacagcgtgtgttttgcgcttgcgttttttttttttttgacttttttgcgcttgcattcgaatcacgttcctgtatcttcatgtttatgtcttctcatcagtcatccctgcatgcgttcgagagatcaccttttccttttctgggttccaaaagatccgttaaaatttggggcttatttggtttaataccctatcaatatatgttggtagtgccaaactctaggcaagttttggcactacaatattttagtagggtagaattgtaaatgagtgcatttgaatttataccaattgagagccaaattttaaattgtggtgaagaatattctaaaattatgccaaattgagtattggcattaccaaacatttggcttcaaaccaaatcatcacatttgctatttaaaccaccaaaaaattggtatggcaatattttggtatcaaaccaaaacgccccttaatataggcaaaatactgtagagatgcatttgatagtacagtgataaggagcgtattcaatcttcaacacgaaatattgcaccaatagtaacacgctagaagcatatctgaaaattcttggttgaaaaggcagaacaaagaatatatgctgattcactattgttttcaaaaacaaggagctggggcagtgagcgatgaggttgggcggcgaagggatgaggtcgtcggaatccagtaggccagtagtcgtaggccggagagacaaaacaaagatgggcggttgcccctccctcctcgaccaccgctggattttctcatcccagacgtcgcaattatttcactttcccatgacgtggatcctccgcggcatcccccgccgtcgatccggcatcggacgggccgcaccccgcggggccgcgtggatcccacacgaatacctaccggtgccacggccaggtcgggcccacgtgccagcttcccctccgcgggacgccagcgcgagcggctttagagcggcgcgggggggtgggccccacaccgggatagcaatcgtggccgtccgtgtcgatcggacggtggaggcggtgtgaacaggtggtcgctgcgcgacttgtctcctctctctct

SEQ ID NO: 49613 - DNA, 4179 bp, Oryza sativa
ggacaagcgtgccctggccagagccatccccagtctacaccccaagccaggagcaatggaggcggtgatcaccaccagaatggtcgatatggttcccatccccaagccgaggtagtggctggtggtggggggaacagaggggcaatggtggaggtggaggtggaggtcgccgtggacaggagcaccatggtggttttgatgggcaacgccgtggcggtggccgcagggacggccatgggcctggacaccagcagcgcggccaccatccatcttacataagggctcctctggctgttgtgactgcggcgcctcctccaccaccaccatttgttaaccctgctactccacaaacaccaccttatggagctcccataggcttccctggtatgccatgcatgtggtttatgagatcatagagttgttctattgttatgtcaccttaatttgcttcgtttcaaatagcagagatagcacctcatgtctactattttacgtctcccctggaaggtgttcaagcactgccttttgtgcctcacccagcaagccctccagctatgttaattcctcaatttgatcctcttcgagcggagctgctgaagcagatagagtactactttgggtacttttttgtctacatttacgtgaaatatttgttccatatcattgccgaggtaaatttactgagccacttgttcaacttttgcagtgatgacaatttgtgcaaagacatattcttgaggcggcatatggatgaccagggttgggtgccattacccctgattgcaggatttaatcaggtgagtttgcaggttctacatgatgttttttttaactaaaaatattgtcaatgaacctttacttcgttgctattgttcagcagattaatgacaaatttaccaactgccttgtaaggttctgctcactgtcaccatcgagtgagggacatagaaaactttttttttcttattagtattagatatcttcttgcctggttgcctgattgtgtgagaaactgcatgcacatttagatattattcaaaacttctgataagtgataacttatatcctgtgtaattcactacataaatgacaacaaacatgcaattgtctctattttttaagctgaatacatacaattgctcatgcattgttaattgtgtcgacaaatatgatggaagagacctcaatctattactgttgtataggcatatttctttatggattttccgaatcatatccttcacagttagttagtttggtgagtaccatttaccattgcatcatgggaatgaggtttgtattcccctcaggttgctttaaccatgccaagactcttttttggggttatttcttcctctttcaactacatatttcctaactttggtcttgtattatgttctttataatgtttctgtgccttccgatgcactatgtacaaaagtcttataggtttgcatactgtatttatgctttttttttttgtcttggtctgttacttcttattccttgtgtgtgctggggagggggggggggtttctgcaacaataagactgaagcatccaaaatacaattcatttttctatatgaacaaactttctgcaccttggtaattaagcatttaagttccaagagaatgactacgtctgaggactgaatctttcccatgaattgttacaagtgttaatgtttttctaaaagaacaaccaggagttataattgcactcaaatgtcagatatgttggctggtcataagcagggcaaagagagaaactagccactggaatgcaaaaagaactgtagaaaagagacaacaaaggtagaggctgactaaacagtgaaaaggttcttaaaagtgctaatgttgttgtaagacaattacacaataggaatgttttgtgatgcagatagttagaataatggaaataaagtgaatttgaagatgctctgagttgtttttgctttgcaccggcacatgggacattccacaatatggaatcatggacacatatttcacatgactatacatggatgattaaaaaaagagagagaaaacttattctatgccataacatcatgcatgtcctgccaaaaaatatatatcaatattcattggccaggaattaaaatagatattttgcttcttttacaactctgactgattctgacttatattgtttcgtgtaggtaaaaaagctgactaataacgtgcagtttatcttggaaacagttctgcaatctaccgtggttgaagtacaggtgatctttaattctcataatttacctttgaagtaatttcatattttgagtttcaaacagacttatctgccatatacaagtgctgtaatttataaatatgcaagtaatattcatgttctgctatgtgcggactgcggaatgtactgctggtttagagcatgtactataaggatttaggtgttgcctccaaaagtgccacataggattaggtgatgaggtgtagagagaggatgagccacccttcatgcaagggacaacctccgcacaatctccaagagaaaaagagagaatgagatagtgtgggagtgaaccaacacaaaaaaaaatgatgtttgtgtattagaggtaatatgttgtacatgttgcctcttaattaatggatagatgacatggctaaaattagaggtagtagccaactctactataagatttgttcttagtgagcagttttttttaagtatttaaacttgatttagtgagcagcttaccattacaaatcttctcttcactagatatttcagaaagggtaaacatgacattcaaatgggctgtaaatggcgtggcatgctgtataaaaggaacattctagggaaatatttttggtttctgatcttcaaactgacattatttagtttcagtttgtaagggatgctgtactttactgatgatctttagagcagcattatttagttccaatactttacattcaaaagcttgttcaccttttattacaaccaattgggtagctctttatgctatatctgcatgacatattagtttgcgtgtctacctaggtaactcggcctatatctgcatagcgtcttagcttgtatgcgcacctttggcgtaacgttagtagtaggaatattggagtactcagactgttgtgcatgcccaacttaagtccagttgcatccttgtagaatcttagtccaatcttgtgtgtacattggatctggatccacatgttgaaatgtgcgcacgacgaacattgccatggcgcaaaggaatgcaccattgatttttaaatagtatattttttagcaccctagatgatctcacatgccaggaagcaggccttctctattttttcttccttcttaacgcaggacttcaaaaatgaattgagagctgtttcattactaagttttacttgccaagttcctttggttaaaacttaatgtatatcacttacaggtacactcttaactgattagccactaggaaaaactgaatgtctctgaacgtaatgctagaacatattacgaggagaatcttatctagtgatagcaaacaagttgtcaataggtgtattcaataatgatcttaaggttttcctatagattggaattgtgatagcttgacaacactgttatttatcattctacttacccgcatattcacttaagttaaaaatatctaaatagtaaccaccaactcatctagaaatcactcatctatcctccttgattagaaatcactgtaataaacttctacagtagtagccttttcttttgtcaatcttctgaaacaatatgacttgaaggaaaatttcgtttagcctgtgacaccccaattgactccccaagacgttagaaacatcatgtacttttggtttcctatcatggcttcttgcttgaaatgagaatgacatgaatatgttttttttttaattctaattcacattttctccatacatctgagttctcgctgtgtttcttgcatacttactttacagggtgacaaattgcggaagcgtgaaagatgggagatctggttgcttccaaaacaaggttattctgctggaaattcttctggttcgctgtcccctgtgacatccaacattgtattcactggcatctcagtttcaatctgttggacttgagggggcaggctaccatgcaagtcaaggaatgcccggtg

SEQ ID NO: 49614 - DNA, 1569 bp, Oryza sativa
caagaagtttactccggagcgataccttttgaggttttacacaagaaagattacaacggcatgccgagttttctctggttacggcacgcgtacctcatctactggggtgaggagtgaggactaaaatccagttgatttggaagaaaacaaccaaaaaaaggaaataaaacatacaaaaaagagagatagaaatacccaaaaaaatataaaaatataaaaaccaaaaaaatcgaaaaacttaaaaacaagaggaaaaaacatagtaggtagtattatgtgcaggacttatgtattttgtggttgtgctcttgctgggacgtgagtacgtgacattacctgttaagtactcgtttgattgttgctcttttgcagactgagttgttatggatgttgtcagtcggaagctgttaaagacgagacaaacttatttcaaaaaactgatgacattattatcagttgtgcatcttctgctgcccaaattgtgcatatgcattgtatttcttttgaaaatcgtattcatgttatgtatactttatgctgatttggtcgaacgtggacatcgatctgccgctatgaaacatctgccttcttcggcaaaattgctgttatgtgcttctggcacagagatccttcctatttacttgggggaaaaaatcttattcatctctatagttgtgctcaagagtataacaaagttgtgggcaggccattgtatggtctgcaattggtattatctgtgaatgatacgttttattagtaataatgtcccttacgaaactttggtgatatcaaattatgtcattatcaaattttaggaaagtaagacggacatgtgtggtgttaggtttgagacattctggtaaggtttcaacagtagaaactactgaaaatgccacaacttgataagattgtgttgacttggtattgatctagtgaactagtggtagtatgtgttaccttgccaaattttaaatgtcaaaatttaaaattaacatgaaagagaacaagcccgaagatagatcacttctaaccattctatcagtagcaatttattttttaaaaaaaagaaggctaaagttttgcctcgtatatattgatagagcaggaggaaaaaccaaacaaccaaataagttatttacatgtccctgccgtaaaaaaaactgagtccgcaaaaagggaaactacgtaggttcttccaacggggttaactcagcgagttttgcggatcccgtcttgatccaagctaacgcctcctcttagattttagcgatgatggtggttggggtggtggccacgtggcagaatatcctagcgtcaatggcttcaatctaacactaaagctacatggtactccttctgtcccaaattatagggcgcttctttttttttttaaagaaaaatcaaactcggtagtttttactaataatcatactaactatatatatatatatatatatatatatatatatatatatatatatatatatatatatatatatatactaagtattatacatgttatatcactagattcatatttttgaagtactttttatatgatactccatc

SEQ ID NO: 49615 - DNA, 3960 bp, Oryza sativa
ctctcacaatgcctttctttcacaggagggtttaccggtttataggctttccaaacgaagggtatctgatgatcgatgatgccacctttcccaggtacttataccgatagagatggctgtgaaaaggataaacttgagacgcttcttgtgcttctgacgaaaaaacagtgtactgaaaatacaagcagaatgggctgagcgcacgcatctcgcgagtgtaccgtggtagagaatagtaacatggatggacgagtctggattgctctgcatgcttcccaaatcccaactcattagttggaaatggagctctgtccggttgcttctatttggatgtttccacgcgtgataggctttcttttgtgaatcaccttttcgcgaaccttctacgctcctttgctgttttggtcgggccgtgctgtgcatcttttttgtgagatttcattcagttccaccaagcattgtctagacagagagaagaaaaagatctctgttgtgaatcttcctgcatgaagaagccttatacgattcaggctgtgatatatacactacactcgccttcaatgtactatagcacgtctgaaatagctgaatgattttgcgaacaatatagagaaattcacatatataaagttttttgcgaaaatcgcactgttaattcaccattttattcactggagaagaacacttccttactcagttaatcaggtacttcaacaacaatagaagagattttttacctttgagcttttttacctgcttctggtttgatcatgctaccgatagaagagattgaaatgttacagtgatggaagccaaatacagcacaaaaccacttcctttttttctggaggaaaaaaatcggtgtaaagtctgtgtctaccagtatacaatttgcagtcatacaaataaaatcctctgttaccaatctaattgccaacaatattaaggaaacaatgtcgtattgcgaatacattagtataggctgaaaccgaagaactgcccaactagaagagctattcccatgcatattgctacaagtgaagccgcccaggtcagtttctctgttatcctagggaccttttctttcaaggcctcactacaagaacctacaaaagcagtgtaactccccatcgaaaatacagtccccatcaaaaacatgccaagaaatgctgcaccagcgaagcgtgagggaagggccaatgaaggcaacaccatcagtagagcatctggttggagaccatgaacaactccagtggcaaatgttgcaaaaccaactttcttcttcctgggagcagcaggggtttgtaaaggctcactgctggttatgttgcagtccacgccttccagggcgagcgacgattcctgaacctctgtagcttctcggatgcccatacctcctatgattagaagggtcagaccaaccactcttgttccccatgtccggagaatctcaatgtgcaatcgatccttgagtaataagaatagcaggccaaaaataacttgtcctgcatcatgaccacaaccccaaagggcaccgaccagtccactttccagtcttgatcttccaatcgacagtggtgccaaagcaacgagatggtcaggcccagacaaggtatgcaagcatccagcaatgaaaccagcccaaccactgcttagtatctctgatgtaaatagtccaccagttttggttattgattgcactgatgcatgggcaggataaggaatgctagattgcagggtgccggtaacaagcgccaccaataggaaaagagcagctctggaagcctgtgatatagcaaaatgttgactaaatcagaataatgatggggaaatacgattttaaaaaaccaaagcatatatgcacaaaaccaaaccagaaaacaagcataatgcccttgcttctgatgaaaaataatgtagtcacctccacaacaccttagctatatttgaagagctttagtaaaatctcaaaaacattacacatgtaaatcagtaaatgcaatcccatctagcatcagatactcacaaatgctactagacaaggtccatttcgtatacgcatatctcataatccatccgaagccacattccatacctaactagatcaactactacacttttaaacatgtgctgcatagcaagttatctaaagtaccataaaaacatgtcagttaagaaaacattaaaatagcaacgcattcttccaataaatcatgaagagaacattgggctagggaatgatgaatgcaactgattatcatggcattttcacagttgacggttgacacacagtcgaacatttttatgacctgagttaaataacataatagccatgatgttgcgagagaaaatgatgcaaatatgttataaaacagtgcaaaaattaaagacactaattcatgatatcatctctcactttgttcacagttgcaagaactatcacatagtgagcctgacacatttatgattaaaaattgtgtccgcaatggaaccccaatatggtacagtgctcactacaaaaatgataaaaacaaggtctacttttcaatttggctaaggctatgagatacagtttctttgggaacggaagaactgtgaggagtgagatctaatcagatgttaccaatttagcatcaatattaactaccaaatgtatcactcaaaaactaaagaccgcatggacattaaacgatcttacaacacaccttgttagttgcccaaaaccctaactacgatcacaggtatcttggagttctcacaacattctgggttagttttgataatgaagcactaaaatcatctctccccaaaacataccaaatcatcacttagtttcaagtgaaatactatacttcagatgtttacctacaacaaaattccgttttgtaacttgctatatacaggcagtggcgaagctatatagtgtttggggggtgcacatgaacccccgaaattcctaatttctcacttaaaaagactagaatatacaatgttgtactgaaattttctagattctcaatggtagtgcaccccccttgttttgatgctagcttcgcccctgtatacaggtctcacaattccacaaagaccgcatatcggttctttttcatacccatctagtatacagtatcttaaatcataaacatgattgtacataatggagcacaaattaagagtgctcacatgttcccctctgttctgctaaaataaagattttcttgtgcattggctttgtatttttccatatgaagtatatggaagcgccagaaaacaccagcttaatcatttatagaggtagagccaacacaaaaacagcatttcatttggagatctctttcatttgctacaaagcatactactcttctcatcccatacacagccgtggcattgtcaaagcccagtcgaggcatgtgtcatgctattcgatctcaaacagaaggttgtcatttgtcaagctgaacgaactttctcaaggggcataattaccacaattaagtactacgactagcactagttgagaacctaccatggcaattctaccgcgcgcatcattttcgagccaaacattgcaattccagtagatgaaaaaaaagaaaacccaaaattggggcagtcaccttggggagcagactccacagcaacttccacggaggtccaaccgccgccgccggagcggcctcccgcggcggggccgacacaccatcgtgcggccgcgccgcgatcggcccgagacgcggctgcgcccgtagcctccccgcccacggctcgacgccgccgccgccgccgagacccgcgacggcgaggcggcgggatggggatccgccccccggcagagggatccgggcggcgacggacttggagatcagccgctccatgcgcgccgccgcgaggaggagacggagaagaaagaaggcaaactaaactagaactagaagagtccaaggcagcgagagatcgtgc

SEQ ID NO: 49616 - DNA, 5843 bp, Oryza sativa
gtcacgataagctatcattgacgatatctttagcccaatctttttttttcttatactacctctatattatgacgccctcgactttttatccaacgtttgatcattcgtcttattcaaaaaatttatataattataatttattttattatgacttgattcgtcatcaaatgttctttaagcatgatataaatattttcatatttgcataaattttttgaataaaacgaatggtcaaacgttaatcaaaaagtcaacaatgtcatacattaaaatacggagggagtacttacgtttatcagccaaaatttaaattttcaaccttaaattcaaaattaattttaaagttttcccatcaaaatttattttgcagtctttgtttgtagatagttaataacacatatataaaaaaattataaattatttttcgtttacaaatataccgcgtttagcgtattccctggataaacgaaacaatcgctttcttggatggatctgcgtctgctccatgagatgtggggtacgttacgtgccggatagaaatcacgtgtttaattgtgttatttgtttatttatttgcttgatgaggcattgtttgactcaatacaaaataaccgagagttgacaataagggcatgtaaaaataattatcgtgtcatgagtttgtgactgttgatactccattagtcacgagactcgtttttggtttgtttgaagcattatatggctgcttctctgatccgttttttatttaagtaaattttatagaactatttctacttttatcaaactattataaaactatagatttaaagaggtagtattacaaaccacatattaacactatatttttcacgaaactctatattcaaggtatgatatcataaaatttagtgatgaatttgtcaaaaacctaccgtactctctaccattggtcatttttagccgttagattaaatgcggccggatgtgatcgatcgctacggtaatcaacagtaaaccgataccgtatgagtgaacagtactccgacactgttcgcacagcgtttttactgtgtttatggcaagatattgtagctcctggcacattttactgtgcgtctcaggctctcagccattctctccgtaatatcagacgatgcaaatcctgaaatccgacactcgacagtcgacacccgccgagcaggtgaaccagtatcagccttagcgacaccttccacaattataccttagcctgtcgccaacagatcattccagaattatttccagttgcggcgagcagatcccattcccatcccagagatcatcgaggacctctgatctctcaaactcgtgccactcccgcgtatgtgggactacctccaatccctcgagcacccgctccttgtcttcaacgacatgcccatcgagcaagtgcacccgtctcatcctcggcgacgccttcatgacatgcctgacaaagccgatttgccaccctactgcattgaagccgacgacaacgagctccttcaggcaatggtactgacgatcttgagcttgcacgtctagccaagaagccatattttccgacctgttgtcaatctgcactaaggtttgagaattctcgtgtgaattcacagatatattccaaaaaaattgaagaggatatttaaggaaaagagacttgtagagtgcatacatgaacatggcatgactccaaaaccggcgcagcatcaagcagggtgacaatccagaatatatcccaattaattggtacgtttgcaatgaatagcttcttgagatgaagcaacgggtcgggtacagctattggctcaatccacacctgcacacatgaaaatgcaacgcaatttcacttagagacaagaggccactacactattactattagttcatacactagtgactagtctgttagttcatttcaggagtatgtatgatcgctcacctcaggtcctttgaactgcagaacaaggctctcaattggcgggatcctcttcaagaatttgctcagtggatatgttgtgttgctaacacttggatcgactttgctgtcgccttcggtttttagatagtccaaacctacatgccaagtccaggcacctcgccatagtatatcttggaaggcagtaggccccggcaagcaaaagtttcaagacagggcagtgaatgcagatagattttcccaaatttgcagttgtccaccagcagattctttaaccttgatgttgggacattgatacggagaccaccagcacagtaacccggacaatatccgatactaaagtccaatagatgcacacaatgtgtcaaaatccgattagccaatccaaagtacgaagttttacacaaggagagtctcgtgagcctctgaaacgtcaaggaattaaatgaacccaagggagggcagttgaacagaacgagccgcttcagctgcaaattctgacatccatcaagtatcttgaagtcataggcgatgcaacggccttcaacgttaagctcaaaatcctcaactccccacctggcaatcgctgcagtaacccatcgctgaatgaattggttccacttcctgccaaaggtttgaagccttagcttttggatagttcggtgcacaccatcggggggcagaaggaatgcatccacccgcttgacatagtgccgcatggcccagcgttcatagcgttccagggcagccgtgagtggacggatcctcctcgtccactgatccatcttgtccttcatggcataaaagtcgctcaggttcacagcatccctgtttgttgtcacatatggtgacttctctgcctcatacgctgccttggcttccatccacagtcgcttcaacctgtggtagcgtggagggaggaggtcatcaacggcgaagtcgtaacatgtgtgggagcgccgaggaagattaagccatcgctttgaaaggatagtggtggttattgttgtgcgtgcatctagcttgtcgagaatcaggatgagtatctcatcaggtaagctgctgagcctgtcctcgttagtattgcgctccttactcagacgcacctagtaaatttgatcagaaaggagatggaacaacagtaagctaactaaagccactataagtaattgtcaaggctgctagtgaaaaattttcagactaacagactacgttgcgacatgaacaatggaaaggtttaagtgaccaaattattaaaccaaactaaaacttcttgcagtgaaaggaacatattgagctgcgtgggtaccaataaggcaataacaacgggtattgttccactttcttgatggcgcaattcggactaaaaggggaaaagctcgtttctactgttaaactagtcaacgattattcaacactaatctgtaacactacgccaccgcgaaactcgccgccgacaagagagagagatatttagacgagatcggagttggggacgaagagaaacagagctgaggcagaggagagacagagtttggagagagataaattcgatttctttttgccaagttggccacagccattctctctctcgagtatttatctcctgattacatggaccgttggcccaaacgatttaaggcacgcaggccgcattctatttgataaagtctagcccaaaacacacacactatcattcacagttaaacctctttctcagtgtcaccattgccggtcatgacagtgccgcccgcaggagtttcagcttgtccccaagctggagcatctggaaagcgagtcttcacaacatgatagtcctcccaagtagcatgatctgctggtaataaagaccatttcagcaacacctggacatgagctgcattaccgcgcttcactagtcaatgctccaaaatcgcctcaggaacaacgtcagcagcatcaagaaccactggggatggcaaagaagtataaacaggagtatgatctggcacctgagctttgagttgagaaacatgaaacaccggatgcacagtgctgctggcaggtagatccaaacgataagccgccactccaatgcgctccaaaacagtaaaagagccaaagaacttataagccaacttaggatatggtctattaactactgaggactgagcataaggctgtaacttcaagaaaacagcatcacccatagcaaaaacacggtcagaacgacctttatcagccttgttcttcatacgcagctgggctcgagttaactgctgctgtaaaaattcagacaagtgctgcctttcagtctgaacatccaccacatcaggcagagtagccaatgtcagatcaggaacttgagaataatgaggatccaccccaaaaagagccttatgaggagaacagccaagagatgtatgataatttgtattgtaccaaaattctgccaaatgaattcaatggctccacttcttagggttagcctgagtcatgcatcgtaaatacatttccaaacactgattgacacgctctgtttggccatctgtttgcgggtgatatgctgtgctcatctgtaattgagtgtcccaagtagcaaaaagagttgtccagaacttgctagtaaagagacgatcacgatcagacacaatagaacgagggatgccctgagttttaaatacagttttgtccaccagatgagccacttgtgatgcagtgaatggatgacgcaaaggaatgaaatccgcatacttagtaaaacgatccaccaccaccaaaattgcattataaccatcagagcgcggtaaaccttcaataaaatccatggagatgtcctgccaggcctcttttggaattgggagaggagctaacagtccaggaagccgacagtgttcatgtttggcctgttggcaaacctgacattgcttcacaaaattttcaacatccaacttgagaccaggccaagcaaataatttcttaaaccgatgataagtagcagcaatcccagaatggccaccaagtgcagaagcatgaaaagcttgaatcaacttagtatgcagtcctgcattggatccaatccaaatcttattctggaatctaataatcccttgtgtcaatgaatacccttgagaattaggagaatgcacagccaactcagctagtagctgctgagcttgaggatccactgtataagaattgatcacctcctgaatccagatcggttggaccacagaaagagcacaaaattgagaggaggaaggcattctagataaagcatcagcaacaatattatcaacccctctcttgtattggaaagaatattgcaaacccatcaatttagtcattgccttttgctgtaattcagtccccaatatttgatcatccaaatgacacaagcttttgtgatctgttttaatgataaatggacctctctgcagataacatctccacttatccacagccatcataatagctagaaactctttttcgtaaatggacaatttctgattaacaggacccaaagttttgctataataagcaatagggtgactctgctgacttaaaacagcaccaagaccataagcacatgcatcattctccaaagtaaaaggaagctgaaaattgggcaaagctaacactggagtgttactcatagctgtcttcaactgatcaaaagcaagctgagcagcatcagtccaaagaaaggccttcttcttcaacaagagtgtcaatggtcgtgctatgatactataaccctgaacaaattttctgtaatagcctgtcagtcccaaaaatcccctcaattcagtaacagaagtaggcacaggccaagccagcattgctgctgtcttctcaagatcagtatgtagcgcccgttccgtcgtggcgcctagcgggaaaattatctcctaaaaaccctaat

SEQ ID NO: 49617 - DNA, 7224 bp, Oryza sativa
ttcccctctcgccggcgtcacctcctgtcgtcgctttggccgctagccggagcgccagctcgccggcttgaccgcccaatgtcggttcctctctcccaaaccgaccttcccgcctccaataaacccaagcccccccccctcccttccttcctctcccattcgcctcctcgccattgccgccgctcccgtgctctgtctcgcctccgccgtccatcgccaagcgccgggagagccggtgcgttcgtggacgcggaaggggactccgggcgcgccctcttcttcctcttcctcggcccgaggccggagagatcactcccacgccgtcggcctctcgtcaccgcgcccgtcccgcacggtagtgcctccctccgttcttcctcctcgctccatctcccccccttagctttcagtagtagctcgagtagcctcctggaagatagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgttaccgcgtagatgctctcgccgccgggaattagcccctagtgacctcgtcgccgtttcccccttctcccgccgccggttgccgccgccgcaatccgccgccgtcgagcaacccccggcaaatccgagccgttggttcgtctcccctcgtcacgtgcaaccgcccggtgtgctcgcttttgcccgtatcgccgtggttcgctccgtcgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtccctccccgtgcgcgcgttccaccgcgagctgtgaggctgcgcgtggacccgccgcacccacgtccaccgcgaaccgcgcgcgtgcatcacgtccatcctccaccctagcgccgcgccgcgtgcttcctccgcacggtgagccgagccgctgacaagcgggtcccacccgggaccgcgcgaggtgagcccggcccaccggctctctctctccttcctccgcgcgcgcgcatcttgggccgctctgggccgccttcttgggccggccggcccgttaagctcggccgagccgctctttctctcgggccgcgccctagccgcccaagaaaagtctgttttctctccctcctttcttttcttttcttttcttttccaaaaaggatttaattaaatccttttcctttagaccaaaaatccaataatcttagaaattcaatatcttcccaaccgtaaatccgattgactccgttcaactcccaaaattcctcaaatcccgagatctatctaatggcacgcttagaggtcatcaatagggctttattttcgccgtttgttgagttgtcccgttttgcgtgtagtttcggagcccgaagacccgcagtgcgaggatttcgaggatcaagctccagatctcgagcaaggcaagccacctttgaacatcttgatcctatatttgaatttaattatgttgctcgaaaaatattatgcattgataggatcgcacttaatctgcttgttccgtccgcatgacagtttggcggacctacctaacttgttgcatctgatccctccattgctaattgttataccatgtccccttgtaaccatccagttgcgcctcgatactcgagcactctgtgcgagtatcgacggtcgccctcaaacttaaaatatgataaacatcttgggtaaaacttgggttttacaaaagatttggaaaacccgacacctgggttggtgtttgtgaactaaatgaaatttctaaaaccgcggaccggggaacgtaccgggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcactgtatggtctgggacctaacctgttgttggtctgggacccctctcgtcggcatatggtaaacctgtgtcggctttcgaaatgccttgtcatgaaagcttggaggtcccccgacgtggctgatttccacgggctgggtgatccgggttagtaatgtcgtgtgggtaaagtgtaccccctctaaagaggttaacaaactgttcaaatagccgtgcccacggtcatgggcggatgtgaggtgattcctagcgtagttttgttttactactgcttatgaaattgctgttgagaaaaggggttcgatgtttgaaaaatctgtagctgatgggatcagctaggcccgggtggccgtttgaaaagttgttggcccgggtggccgttgaaaagctgttggccgggtgccaaccttgtttcaattctaaagactgatacattgcacatactccgaccggacgagacgcactgtctcatccgtgtcgtttgagaagcactcacttagttgtttcagaaaagagttcgaataaaatcaattgcaaaaacaccagcctttctttgaagcctgcattaaacacttatttcccctggcttgctgagtactcccgtactcacccttgctctatataaataatctccccccccccctcagttgctgaagaagatgaagcggatcccgctgatgaggagttcttccaggagcaagccggcttcgatgagttttagggtttcggcctagttcccaagtcgcgcctgtgatgtttggtccaagtcctggcttccgtttcccttttgtaatgcagttgtgagctcgggatctgtccgcagcccaacatgactgtacttctactctataataaagagacctctgttgttgtgatattctgtctccctatgataccagcactgtttcctgggactggtatcgattaacaggttaatttggagcgtcacgggctagttccggtcggtactagttcggggcgtgacacagtactaactcctttgtcagaaatgatatgtcctaagtattccagttgagtgcaagcaaaagagcatttagacctcttagcaaataactggtgttgcctcaaaatagcaaaaacttgctgaagatgatgcaaatgactatcaaggtcagggctataaactaagatatcatccataaacaccaacacaaacttcctgataaatggtgcaaagactgagttcataaggcactgaaaggtggagggtgcattcgtgagaccaaatggcataaccctaaactgaaattgcccatgatgtgtcttaaaggttgtcttggcttcatcagtttccaccattcgaatttgatgatacccagctttcaagtccagtttagagaagaatttagtgcctgagagctcatccaataattcatcaacaaccggcataggaaacttacttttaatggtgagagcatttaatcttctgtaatccacacaaaaacgccaactaccatcctttttcttgacaagtaaaacaggtgatgcatagggactcatactaggtgtaattaaaccagcatcaatcatttctttcacctgtttctcaatctcgtctttttgtaacggagaatagcgataaggtctgtagttgacaggagtagcatcaggtactagagaaatagcatgatcaaaaaccctatgtgggggaagacacttaggatcgtgaaagacatcgtcaaagtcagttaacaattgttgcaccgaagaaggaatcacatgctggacatcatcctgggaatgttccaacaaagcagcagcccatatttcacaacccttatgccatttcaaaagttgtggcagagtgacagcagcaatttcagaagggactgcagcatcttgtactccttgaagagaaatccaagacccttgatactgaaacttgagtgttttattagcccaatgacaagacatttccccccattgctcaagccagtccatacccaagatggcatcgtgaccccccaaagtgaccaccctcatgtcataagtaaatgtgtgcccctgaatccaccaaaaaaaaccaggaaccacatactgacaaggtaagcaatcaccattagcaactttcaccagagtagaaggaattggttttagaggtaaacccagcatctgtgcaaagttgtaatcaataaagttgtgagagctgccagaatccaccaaaagtaacaagactttactatgaaccaatgctctcaaacgaatagcagtaagaaggtaagctcctgtcaatgcattcagagaaatatgacagtcctcctcatcatcagattgttctgcagcaataacaacatccaatatgtcatcagtgagcacctcttccaactgcatagctttgatttggcctccaacagcacaacgatgttcaggagtatatttgtcaccacacttaaaacaaagaccctgagcacgtcgatagtctttcaactgcttagccttccatagatcccctttatctactcgacctggagtagtatcagaactgacatcactcttgtactgaggaagtttcacaaatttccctttgagagctttggtagctctactagccaagacagattcctacataagagcaatagcagatgcttgctgtacagtgtcaggcaattgaacaacaacagcagctcgaatttcttcagtaagaccattcataaaacgagtcactaacattttaccccccacagatggatcaaacactctgatctgatagacaagagaatcaaattgttgtttatactcagtcactgtactagtttgagtcagagtatctagtgcagacattttcttacgttccacaacaccctcaaattctgttgcgactgccattctaaattgatcccaagagttaacctcattcactaacttataagaatgataccattgagccgcatttcccgacatatgcaacacagcagcagagactttgaaattttgagtgatttggtacatgtcaaaataagtctcacacatatccaaccaaatccgcatatcagaaccatcgaaacgaggaaaatccattttaggaagtggctgatgacgccaataaatcccatcaccaaaaccacgacccaaatcaaccccatccaacataggaggaacaggtggattcaacggcggaggagtcgcagaaccacttgtactaacctgcgagatcccggaaggcgaacccaaaatcccggcctgatcagagcagctggccacccgcttcatcgaacgggccaactcagcacactcttgctgcaccttgccgacggaatccatggcgagatccaccttggtagtcaccttctcaagactgccaccttgggaatccagccgctgatcaatctcgtgcatccactttgtgatgccttccaacttctccaagagtttggactccatggagtccatagcttgcttcaaaggggctgaaagttttgcgggcgccgtggcgaatcaggaagaatccaacgcacggcgacacccacaacctgtctctgataccactgtaacactacgccaccgcgaaactcgccgccgacgagagagagagatatttagacgagatcggagttggggacgaagagaaacagagctgaggcagaggagagacagagtttggagagagatagatttgatttctttttgccaggttggccacagccattctctctctcgagtatttatctcctgattacatggaccgtttgcccaaacgatttaaagcacgcaggccgcattctatttgataaagtctagcccaaaacacacacactatcattcacagttaaacctctttctcagtgtcaccattgccggtcatgacataatcctacagagtacagatcggaaaaaaaggtgtagtttttctgtacaacacaactgcaggagctttgaatcaaaggatataacagtagaacgggcatatgtgatacccgcttggagggcggggaggcaacgacggcggtggcggtggagacatcgatggccttcctcaaccgacggtagcgtcgtggagccgcctcctccgtagccatcggatcttgattgtcgccggctggatgaccgatcggcggcgagggattggagagagggctggacggattcgagaaggatggaggcgcaagcggcggcagagcgattggagaggacgggccgcgagcggcgccgggggattggagggggaaaagctccggggcgtccgtacagttttatggtttgcatctcagcccgtttgtgttcggctcaacgtgtcctttccgatacgaaaaagctccgattttggccccctttttctgcatctgaagtttggacgcaactcgggatcggcgcccgatgggattcagcttgggtgactttgtgttggcatgtcacaacgtgacattgtgaggatctctgccatcaaaaacacatccaacggctcgtttggttgggcccgcctgcaggtcggaaatttagccgccgatccatccgtcccgcgggagatggcgcccgccgatccaacccatcccgtttcgcctcgcccgagtccagccgtcgccatcgccgtgagccagctgggaggcttgctgtcaccgcgcgaggccgtcgggctcgccgcgagtggggaggggaccgggcggccgccgcgcaaggccggggtcggggccctgccctgctgccacgaccgaggagagaagccaagccgccgcgcgaggccaactccatgccctgtcggcctgtcctgccgtgacctgtggagaggcgccagggcgtcgaggccctaccctgccgccgcgaccgggggaccgggaaagctaccaacagtacgatagaacatttttctctgaaactcagtcagtcaacacaagggagatagctatatccaattcactcacaaatgcagtgaaatcattgcatttccctccatttgaatggcacaaccatacatctcctttgaagtcatatatatcaagcatcagcgcgcgaacaccattctgcaaaaaaaaaaagaagctatttctatgagaatcaattgtggctagatgtatcgtcagacatgtagaacaatggctagaacagatgatgcatatagcaggtgcgacatttaattgatcagtgactgtatctcttgg

SEQ ID NO: 49618 - DNA, 5267 bp, Oryza sativa
agctgcagattacagaagaaaaatgaggccggttcaccacggctgcagatcaccacgactgcctggactggctcggcggcctccaaccgcaaccaccaccgcacgagggcaggcctggtggccgaccgctgctcgcgccggcagggccaccgcggcgatctcgacgctcgcgcgcggcggccccaccggagtcccgcggcgacaacccccttccgagcggtggcaccggcccccttccaagtggcggcggtggtggttctgggggattcgcgagcagcgtgctccggcaggaaacggagcaatgcggggtgaaagctgaggcctgcaggtgggccagcgcagtggacccttggatttattttcaacggcccagatcgctgcaatgtcacaccgtgccataccatggcaatgtcacagaatctgagtcccgcccgatgggagggggaaaatcggaagctgacatcagtataacacatgcgcgcaaaatcactttaaactattttttctcttaaattatttatccaagtcattgaaaaccgcatgtcgtaatattgagtcgatggttatgcagttgttcgctaactttggatggagattcataaataggattcaataatttttgtgatctttttatgctgtgagttttcattaatctgtatgcttttgtttattcaggtgtgagtttttattgagttggagtaataattggctatagctttttgagcaaaggcaaggattatattccattatctaaaaaattagatctatacatagtaaaacattatgagtacactaacatttttttttaaaaaaaatgaaacgaatttccttaacagaggatttccaaaatacgcgggcaatttgttgcaacggagtatgtggtggggccacgtggctggtgggggcaggaacatgtggtgggcccacagagcacgtgcgcgtatcgtgggggggagagcgaccgatttttcccctcctcgagcgaccgatcagcagcaattctgctgaagttctaaacgtatgagaaacttttggtgacagctcaaacaacgttggctagatgtaagttagtaaaatttattgttagaacttttgatttttttaatcctaatttgtttttagcttggcttttaaattttaagattgttttacctggaatagctctaatttacaccacctttagaataggacatgactatatagcgcacgatcgctggtttgattaaggccctgtttagatctcaccctaaaattttttgacctgtcaaatataatgtttgaacacctgtatgaaatattaaatgattatacactgtaattataattgttaaatttttagaaaaaaaattgtcgacagatatgtagccaaaagtgaactggcaataccaacgccgaacgcatacgcaacggcgtcatagcacgagtagcaccttttctcatggccctatgtatcgtggagtctgtgtgatatttgttgtaagtattgggaagtggaggaccagactttgcctaagctgtgcgtcgtcaagtttcaaccaggtcaggtgtgtgcctctcgctgtagtagtctctaccattcccagcgcatgaaaccgaccgtaatgaagaaagcccacgacgcaccccaactacccaagtgacactcgtcactcgtgccgtcggtcatgtgcatgcaccacgcacgcatggaatccacggcaacagcggcgacgcacgcccaccacctctagactctagtagttgtagtacaccccaatgccacatgcaaaagcgaggggttgtttggttggcatactcacattactaaaacgtgccatactttatttagctaaagctgtttggatgctatattaagtttgccaccattcaccatactttttatgctacacttgtctaagttgtgacttacaaaaagtgagccacaccttagctagcaaaattgaattatgccacactttattgagttgatgatatgtgggacccaaatagataagaagtaatactgccacaagtgtggctataaaccaaacaatatactaacttggtcaaacttatctaacataagttgtgataacctttggcaaactttgggagcaaaccaaacaacccctaacatgcctaacatgtggctaacaaaattgaagccacacttcaactataggagagcaaacttgccacacttttatgtgtcaatgatatgtgggacccacgtcatggtgaagaaatcttatcataagtgtggcacgaaccaaacgaatgcctaacttaattaaacctggctaatttgagttgtgtcacagtgaagcaaattgtggcattgagcctcacagcccctcaattctgctgcgggtcgcgactttgcgaattgcgagtagttggcgcacgtactactcctactacacgtccactgcgtgtgtctgcgttcccggacaaaattgccagccagtgcacaagtgcaggcgtgcggccacttcccaaagaaacccaagtagtggaatttccggaaattaaaacagcataaagtgctcctaccactcctactagtagtactactacttctacccaacaatcattccaaccagtctccaaacaaaaataaaactattgcaaccagcctccaaaaaaaaaaaaaaaccttaccccaaccgccaactcacgggctttggcccctggcacggcagccttaacaccctgtttaattccatctccatgcctcatacctacccactaggctagcacccacgacacacataaaccgagcaacctgtgagcagatggccccatttgtcactggcaaatcgtggaggcgacaccggtgtgaaacaacaagccgcacgaccccccagaaatctcctcctttgcctcggcccctcccacggcgagagagcgtccacccgacgctcagcaactggagcaagcacgggcaacgagtcgcagtaaaacagcagtgcggactcggagacagtacggggaaaacgcacatcgaacggtggagagtggagtggagtcgaatgcagcgcgagtgagtccagaacgactcgtctcgtaacaccgaagcgaccgagagcgcctactgccgcctactgcgcctgcgctgccgccgcgcaagcccaagcgcaacgcatccgcctctgcctcatcctctcctccacttgctggtcgctgccattgcctgcgcctccactccacttctcgcggctcgagaggctgacggcggggcgcctcgaatttcgccctctccgacgagcggaggcggaggagggagcccaggaagaggatgcgaaagcagtgaagtttgtagaattttcagttgcattttgctgtttctgcttgggagttgctttggggcgataagaattctcttgttgatttgttcctcgcaggagaggaggagaagaggggggaacggaaatctcagctgctgcgtcagtctcgcagatctgctccgttgagctgctgtttcacggaatcaccatgggtggaaatcatcgccatgggtggtaggattggttgggtgtcgccgatcttctcgcttcacgccaactaatcgagtgaattgtgggaagaagaagaagaagaagaagccgagtagacgacggcaatggcgtcgtgggagaacctcggggatgtggcgaccgtcgtgcagctgacggggctcgacgcggtgcggctcatctccatgatcgtgaaggcggcgtcgacggcgcggctgcacaagcgcaactgccgccggttcgcgcagcatctgaagctcatcggcggcctgctggagcagctgcgggtgtcggagctcaagaagtacccggagacgcgggagccgctggagcagctcgaggacgcgctccgccgcgcctacctgctcgtccactcctgccaggaccgctcctacctctacctcctcgccatgggctggaacatcgtgtaccagttccgcaaggcgcagaacgagatcgacaactacctccgcctcgtcccgctcatcaccctcgtcgacaacgcccgcgtcagggtcggtaaaaccatatccctttcagcttctctcatcagtgttcatttgtttaatcgtgtagttgagtgttagactagtagcctgggcatgtaggcttttaagaaatgttggttgcatcattctttgattctaaagtatggtatatggaatgtttgcttttgaaattggatggaaaatgatttgtcttggattcttggtggttttcctgtatggtctcatgggttctttgttttctgttggttggtgtgacccaaaggattctattttagaatctatcttctgaatataaccgacgctgcaaccttttggtgctccatcattttcatcgtctatataatctgatttttttgttggtgtgaatgtgacccaaaggattgtgaaggtatatgtatatgctaggaaactgattttttttttagctccagcacagtgagctcaatcactaatcatgccacttgggactagtgatctgcatcggatatcatgtttatttactcctatacttgtcatctttgcttcacaatccttttttttcaggagcggatggaatacattgaaagggatcaatgtgaatattcttttgatgatgaagacaaggaggttcaagatgctctgttaaaccctgatccaagtacaaatcctacggtagtgctcaagaagactctgtcatgctcttatccaaacttgccatttaacgaagcgcttcgaaaggaaagtgagaagctccaagtagaacttcaaagatcacaaagcaacatggatatgggccaatgtgaggttattcaacacctcctaggagtgactaaaactgtggcaagttcgattccagagaaatgtgccactcctaaggtttctgaaaaagctgactctaatcacacaaaagtcagtgaagatagtgcaaaaacatatcatgatgactctccaaagaagcaaaaggatgcctgcactgcaccacggttagtaagtttaactagtttctttcggtgactatcttcttatgatgtgggttgcagtggtaaaaaaggcagtgtataaaaccttttctcattaagtaacattaacctgaacaattactatggccatttctgggtaaatcatgaaaaatgtgcgcattcttccttattttagaggtgtaagtcttgtatactcaactgtgtgatccaacaaaagagaacttcactatgttctgttctagacttgaaatagaaattttgttatgtgcttatgcccctcaaaatgcgtatgcacattataaaaa

SEQ ID NO: 49619 - DNA, 8263 bp, Oryza sativa
ttactgaagaagtagtaatgctatgatagcagctagcagggtcaaagatgatcagttctactaaaaaattatatagaaattagtcttgttttgtctttcctcggtacttgtcaattatatggaaatatttgtgacatatttttttttgccatttatttacatactgtgatagcacaggtttgagaacattagtgcttattaattatatggaaatatctgttacatattttgcttgctatttattacttgttgtgataacacaggtttgagaacattctttttcccctgtggaacattctcaaagattgcttcaattgcgaagaacaggcccatgtgtaagaatatttccctgacaataatcatcatgttgagagttgataatttttgttcctcctagcatttttcttcatttccctgaaaatagtcatcatgtattatttgcctccacttgttttactatggtgctgacttttctgcatttggatagtaatttccaagggtgtgcagtatcttgtttatgttagctagtgttagaccaaacagattggccttgcatgttctctgcatcttgagttctaaagtttgttgtcaacaaaattctccatcaaaatgcttccaaataggattctatgccacattttctgtggactgaattacttatgtaatctgaaaggctggttgacactgataaaaaaaaatttcagcatcgtcggaagcatgcaatgatattatggcatattccctgatattatcctgctgttgttacacttgctgtgtgaggagaaagcttcgtcaaaagctaaatattgcggtaaattttcctgtcccttcatatctgttgtcaattgattttttttcctgcttctctaaagtagaagtgcttcattctgaccctacaatgtgaaactgagctacctctggaattgttacagctccatgttatacactatgggtcatttcagaactgattaactgaactagactataactggggctatgggtcattttggctaaaggattataaatgaaactaacttaacaaaatgtctgtctgtccattgctaatgcagaggtttgttaaaagattgggtagagttttatctgaaagaattaccatgcacactatggagcgttcgtatatcctaagagccttttatgttacttaaaactctgtttatgttatgccgctgacagggaggttgcattgatgatttcctatcacatttgatgtgttgttgctgtgcgcttgttcaagaatggcgggaagttgagattcgtggagcttatggtgagtttcctacttccatgttatccaattaaccagttgagcacgtggatattatagggaatatacatggatgatggagtatatataacagtccacatttcctccttaacagtatcctaaatactagtatatggcactgttgacttttatttggtcaatcttttgaaactttgaccattaatagctctgaaaacattaaaaaaaacaagtggatatatttttctttataagtacatttacaatattacaattttgttagaaatgatcttaaattctaattgataaacagtgatcagcgttgctcactgaacacggaatgaattcaacagtgttatatatttaaaaacagatgtagtaaatgggaaggaagattgtattatagtgatatggtctcgaatcttctacggttgaaacattgctctgaaacatttcatgtcatcataaccctgccgatctcaaagacaagcacaacatgatttaaattgcacaagcaatattaatcagtatgcctcatttcctgcaggagagaggactaagattagcccaccctcatttcagtacatggaacactaagcagcgatgcaaggcttgagcttctgtgaagataatgacctaaaggctagagcaacccggtatcgtactacaatagtaatgatgacacagctacaacattgttgtatttatgcttaccctgcattgtttgtgttggtactctgtttatagtaacatcagttggtgttgggcacagtatgttgtatgtagtactttgtaagaaaaaacacaagttacatgccctcgttgtgctcgtctctgttgaatcccccatgcataatttaacctttagcttcatttgcactataaaacagtaacaatattaaaaaagtctcaaattgcaaaggcaatggggtccagaaactcggaggaagaaaactgttaacaggtttctcaaaaaaaaaaaaaaactgttactagtagagataaacaatgcgatgctgggccatgcgaacatgatgcaacaattcaaacaaagaccatcaactaaaaaacattagactttcaccatgagcttccgtttaccacgacgtacataagcttccaaggctcaaggcaggatgtatattttggcaatttaagcaggtacgtcactggccgccatcttatttatcagtatcttggcgaaatccatttcataatcgtcatgtgaagaattgttaagcatgtgaacagtttcacgatgacgcgatccacgggacacgcagacatacatcaacgaaggtcgttgagttgagatgaccgtcctaccagagttcctccaggcttcctgtcgaaactcaaacaacaccggcagatcgatggcctcaccgggcgtagcagcctagggtgagtgcaccggatgcaatctggccgcacgctactgctttcagcgaatcgaacggaacaaggagttcggataataaaactccgaaccccttttcaggctgcagtagaaccaaagcaagggttcgggaacaaaactcctaacccgcgtagcgcaggtgaccgtcgtctttgtgcccaactatctctgtagattgccatctcttgctctcgcaggctgcagcagaagctcttgataatgaatcaatgctggatgaatacaaagttcagcacattattggacgggatcgcaatgcaaaatcaccgcgctcggaggcagcgttcagcgtggccgtgagactgcattgggcaaaaagcgaaatccaacaactccagcgtctcatgctctcagccctgtcaaactcaaaaaccggaaaatcgatcgatggcctcaccgagccacgtctccgccttcctccagaccacgcagctgaaacaccgaatacgaggcccgcgaccaatgtaccttaccgaagtgagtattagtgtgggccatagtaactgggtagtagtagttgttcatagcatccacagtgtttatgtaggggatgggaagtaaggtggggcccgctttgaaaaaaaacgcaagttcgctatagacattggcttgatgtgtcagaaggtgcttatacctggtggtagcactactatccggtattagttcttcaccacctccatagtggttattacccgataataaggtaatatttaatgcttactactccctccatttaacaatataagttattttagcattttccacatttatattgaagttaatgaatctagacatatatacctatctagattcattaacatcaatatgaatgtgagaaatgctagaatgaattatattgtgaaacagaggaagtacctgctattttgctacactgtagatgccctggggatcagagaataaaactccgaaccccctgcaggcagcaagagaacctactcagcacaggtcacaggtgatcgttctgtgtgttgcgctgcgcccaactatcggctcgccttcgccgccgtggcgtctctgtagactatcatcccttgctctcgcaggctgcagcacaagttctttagtggaaatggacaattctgggctaataatgcagttatgtgtttggttgacttgtcgatttcttgataatagataggatcttgcttccgaatcgagctcttagtcatcgtcttgaaggcgtcgatcgtcgacggacaagaagtttgtcaagttagaattcctgcctttcaaatttcgaaggagattagtcattttggtatgaattgctgaggtgcgtcctcttagtaaaactgtaatggcatggacgtacaaataacagaaaccaccattgagttttgatgcaaagttaagaagaaaatcgtaacaaattttgggacttatactcgttattgttgcccacaattgacctatgaggcaagtaggaacagatatgtcgcgctctgaacaagtagcagaaagacagaacagttaaaaaagatctatcttttcgtggcgcaatttatatatatatagttacaaacttctctatgtccaatcatctggtaagaacgggtgccatcctagcagaaatccagactcctgttagtgcactcgacgaccgattcgctagctggctgaagtcttcgttcttctcagagacatgtacgctagaaccctgtagccgatgatcatcgcgaccagagctacaacttctgtcacgccgttgtcaagaggtatggcattgatcagaatgtccgggacaggatgatattgcaccttcagcagtagcctgtacgtgtggtagttgaatgacaggtagcggagccaggatatgaatggtggaactctctgcatatcatgatggagaagagggcaatgcgtaagacggagtaaagacttgttcattcagtatgttcttcagcattgcatcagtaacacagggaagtgcttgctctcacctttacaaagaaccctcctgctagcatgaatgtcatgactgtaactgaagctagagttgttgccttcttgatatccaagaggctagctccaattgccaatcctaatccctgcatgattacttttttcttgagtaacagatttctaatcactgctaatatccttttgaaatatctaagatatatgatggatcaaccaaaatgttccctaacttatgaataaacacaggtgatgactacaacttcatgggaaaattccttggattttgttcccatctcaccatctatttagatagttttgatgttcatcatacattctttttctcatgtaattggtgtgtatatagacagtacaagttcaactaacagaataaacttttagaaaaataaaaaatgctataattcatttcttatataggtttcctcctttagaaaagattaagggccagtttggttcatggcctatgttgggcttaccaatttatgggtcaagtaaacagtacaaacaaaagtttggtttggatccaaatatcggccagcctgaggagaaagaatcggccacgccgtcgacaggagccgaatcgcgggcgtgaaatttgaactcccgcgcgcgcggccacacatcgaccatatgtattctacgctgcacacaaaaatataagaagataagctctagagttcccagttcccatttgtcctctgttttttgacgcccttcatcttctccatccaataaccacatctcctccaaatcttgaccaagaaaacccaagaagatcctcatctggtcatacacactcatcttctaaaccaaccgaaacaaataatagctcaaatggggtagagatttggggctacatctaggagggatgggggcgagttgaaacttgaaaggggagtgactgctcaggagaagaacaggacgagtacgtgtgttgtgattccagcagtagctgtactgactccggcgtgctcagttgctgtgaaaaacaccatcgattgctacaggaaaaggtaatcaactgatgctccatccgtacaatgcttgttcatttgtgctactaatgtagttatttatagtctgccattaccatcttaactagtagcaataaaaaacagtaggttgaataaatcttactgtcttagtgttgatttctttgctcaaaaaaatatacaggtgtccatttacacctcagtaatgttatttttagtcgacaaatctacatgttggctgggcacaatatttattcagtaaattaatttgtttttcactgaaccgacacatttccttaagtaatttgaagctgcgtatgtaatctcatccagatggagaacactcgacaacaatatatgcatcacttcttgctaacgaagaaggctgtagtggtactttgtcttttgatcatcatatggttgaggaacaaatatcgtaggaggagtagtcgcaaaggggtaaaatatgggcccctagtccacagggatgtatggagaacaagtgaactaatcaggctgatcaacatttcagataggacgtgcactcaacaattaagaatgtcccgtgcagtattctacaagctttgtgctcgtcttaggaacaagggactactagttgacacctttcatgtttcagtagaggagcaagtggcaatgtttctgaaaaaggttggacaacaccattctgtttcatgtgttggattctcattttggcgatccggtgagactgtgagtaggtattttcgtattgtgctgcgagccatgtgcgagatagctcgagaactcatttacatcaggtctaccaatacacatagtaagatcaccagcaagaaaaacaaattttatccatatttcaaggtaattctaaacaccaagccataacaatgcatattacaatacattttgtttattttaactctaatgtttcactttgatatgtacataggactgtataggagcactagatggtacacacatcagggcaagtgtgccagccaagaaggtggataggtttagaggccgcaaaccataccccacacagaatgtattagctgctgttgactttgaccttaggttcatatatatcctagcaggttgggaggggtcagctcatgattcccttgtgttgcaagatgcactgtctcgaccaaatggccttaaaatacttgaaggtaattaaacatttcaaagaattcatgattagccttgctataagttgacgttaggctctatgacatgtttgtagggaagttctttttggctgatgctgggtatgctgctaggccgggtatattgccgtcttatcgtcgtgttcggtaccacctaaaagagttccgtggccctcaagggccacatggacctcaaggcccaaaatgccctaaagagcttttcaactatcgtcattcttcacttcggactacgattgaacgagcttttggtgctttgaagaatcgtttcaagattcttatgaataagccattcataccactgaaagcccaatcaatggtggttattgcttgttgtgctcttcataattggatacttgagaatgggtctgatgaatttgtcaacgatgagaagacgtggtacgctcgcctaccaaggagcagcaaccgtgtctctgaccaaggggatgatgtacgtgagtgggcagccaagcgtgataacatcgctcagcagatgtggaatgacagacacaatgcggatgttcatgatgttttgactagtgaatgaattactagtcccatggactattaatgatattatattttgtaatagttgtgaggattgtatgttgtattaatactattgtatcagacattatcatattaatatatttatgtttcttccaatcatcttattacttcattaactgactatcatctgttcatatgcaatattaacttataattttttcactgtatgtagtatgggaaagcgtacagaaggtactagcgaggaaggtggctctcgtgagaagtatatcagttggagtgatgatgctactcagttcatgcttgagtggtatatagagctccgcaaagacaaacctagtaccttcaagtggaagaaacaacaccaccagcaatgtgctatagctttaaaagacaagtttgggattagagtcaccaaaagccaagtccacaggcacttaaggctatgcaaggaaaaatggagttggatttgtgtagctttagggaaaagtggctatggttttgatgcagcatcatgcaaatttaacattgacccatctgagaaggattcaaacaaacttggtgtaagctatattattgtgcaataatttctgagttataattcatacaagaatgtgctaaatttgtttatttctaactatgtttcttctcatggcagacaactaaatataactacttgactaagcctatcaaattctttcacctctttgaagaattatttgttggttgttcaaaagctgatggttcactagcaattgaccagttcaatgcaaatggtagcagtgatagtgatggcagtggtagcatcaaggagttggaagaatacatatttgcattggaagatggtggccatgattctgacacgatagctcgcaatagtcctactactgatggc

SEQ ID NO: 49620 - DNA, 9327 bp, Oryza sativa
  unsure (1)..(9327): unsure at all n locations
catgctaagaaagaaatgtgcggcagttgctttgaggcctgccatgaagtagacaatcaccataaatatgactggaaggaaaaggtccagtggcagatcacttgtcgttctggccaagaagtatgcactgagcttgtacatgtcagctgcacgctccttgttcaacattgccctttcttgtgggaatgtgaagatggcagtaaacacaggaaagaaaccccaaaacacagctatgaaaaacagtaagccggcctgcatacgcaagataaaattgtgttatgatactaatcttcctgcatacccgagctgacatatcattaataagctctctgagtaaccaactccgccatttcacatgaatcacattttctttggcgtaaaatgaatcgcatgattattgctatctatgtacctgatcttgtagaccttttggtgtcgagggatcagagtgccaccatagtagacctaagataactgatgttgctatgacctgggtgattctcatccagctcaaataatcatgtcgccgttctttgatccctctacagaagaggatggaatattgctgccaccagctagtgccccattctcgctttgatgatgttatagttgtcttcatatcgtcactgattggaagtggatctagaagctgcttcttcgccttgtatgccactcgattctcataggcgtctacaagatactgcatgaaatcacatataaattattcagacatctaaaccaaccctcaactcataacaccagcacattgctttcatgtcgtcacctcatgaacatcttgtgctgatggcttgtagtcattcttggtattagtttgcaggttttgattttccatgtgcaccttgtcatctaactcggaaggaacagaaacatcagtagtgtttccgttggcgagatccagtagaaattctgctgggttcattgcgatgagcggggtgcacccaatggactgaaagtagggcatggcttcagatgccttcccaaaatagagcaaacttcctcttcccaggaggataagcttgtcaaacttatgaaataatctgctagatggttgatggattgttgttattactgtcttcccatcctgcaacatgtcaaaaggttaaagatgaattgaactagttgccagctaatgtgtaatactctcatgtcacctcagctatatcatgtagaagttgaattatcctgagagctgtagttgaatccaatccagatgttggttcatcgagaaagagtaaagatggatttattatgatctcatttccaatgcaaactcttttcctttcaccccctgaaaccccacggacgaaagatccaccaatcatcgtgtcctggcaccttcaaacatcatcagataattaattaagctaatttctagaataggtgcatgctaccatacaggaagtggagcgtttttcaaactacctttcaaggccaagttcatatatgatgtctattgttcgttcttccttttcttgcctcgtcattgttcttgggagacgaagcagtgctgcataagtcaatgtctcctttacagtaagatgagtaaaaagaacatcatcttgagtcacaaatccaatcctgaaaaacgagtataaaaccaatcattcactatactcttggacaaactttgaattagtttgccatacaggctcaagctcaactttggtgctctgacgatccaaaccattggtacaagcagatgttttgcatataaaaccttgtagaatgttgagggtagttagtctagtcagacagtgcgaaaattgctaacaataaggaaccaggatatctctcagttcgaattgtttgccgaattggaagcggaaaaaggagaatactacatggtttttaattggcgattctactaaagtggtgttatgtttgagtgtctaaccaacttagtagctaggttacaccaacacaatttaaaggactaagcagaagaacaggtggaggtagaggcagaagcagaggcaatcctggtgacaaagacaagcatccaaaggaattgcgggacagagaccctggtgcagtggtgttcaagacgaagtggacctctaaacaccggagacctgtaagctcagactactgtaggcctcaggtgatgcaagtgttcactgacgtgaaacgtgtgcttactaatactacctccagcatcggtcaggagatacatcgaacagcttatcggcaggaagggcatgactggaacctcacctcaccagagcacgctacgacatggcgcagacatgcgatcgagaacaacgggcaggcgactccctgaacgtcccgaccgtgctccgccgcacaagccgccggagtttccatgagacgacgacgacgacgaggcgtcgccgcgcggcgcgcccaagcagacgagaccgtgagagacacaggtgaccaggcgacagccatagccgcgggcaagagccgaccaaaggcatcacggcccatgcgccgggacgcacgattgggccacccaattcggcccaaaaagaacatgtcggctgctcggcgtcggcaaggcccaattctggcgccgcccattagacagaataataatgacaggtgcgcggtacgtgccagaatcggcacgtcagatgtgcagttcccctgcggccaaggcagagggaagctggaagaagaagacagtagacagtacaactgtagcagcgatgaacaggtagccagatttagcgagataaccgtgagccttgccttgctaatctctcctttattatagccagccacacagcctatgcatgcagtatggtactatgctgtgctctgtagctgcaagcaacagctgatcgatctcatctcattcttatcactttcgttccccagctagtgacccatcgaccaatgagaaatttacaattagtggctccatcagttgggctaataacccaaagaaaaaaaccaaaatttaaattttaaaaattaattttgaagttaattttaagatattttcaacatattttctttttcagcattagcttttaaatcactaagaatatatataaaaaaattatctacaaattaacttttattttctaataaaccgttttaacttattgggaatatgagcaaacggtgaggttttagggctcgcaaataactaattgtaaataatttagttaattgattaattaataatcctggccccggaggaattaattggtgatgccacatcgtgtacgaacaagtgcatgctacggagtaactaattaataattaattaagacgctgcatgcatctattgcacgcgatcagagaggtcagaggatgaaccttcctttgtgttgtgttacctgcggttgagggacttgcagtatggctcgtcgttgtaggagacgcagccttcgacgtcgccggggccggcgaccctcccgccgaggatgctgagcagcgtcgtcttgccgctccccgacgggcccatcagcgccagcacctcgccgggcgccgccgacccggatatcccgctcaggatctccctcggcgtacccttcaccgccaccttgtacttcacctccgcaaactgcacgaacgaaacgagtctcatctcatgtagcattagctcactgaacctctcgcatgccggcggcgtacgtccatggagcttgggataatcgatgcgtttggtcgatttaccttgagatatatcggcaacgtcggctcggtcatcagcttcttgcgcggcgtcccggcctcgatgtccatcgctgcatacgcacagcggcacagagaatgagaatatatatattagggaagtgatttcatctctcaaggagatcggatatccctcgtttcgtctatattatctaaatatctataaaaaaattaaaaaaattagtaacataaattaatataaaatatatcactccacgaaaatacaaatttaaattcaatttttataagttgtaataaaaatgacaaatataactacgaaaggtacgataaccatatgtgcatgcagttaggatcagtaggagtgattggatgcatactgttgtcgtcgtcgctgaagggatggagctcggcggaggacatggtgtcctggggaggaggggtgaagccggtgaaggtgaaggagaagccgaggctggcgctggaggcgcggctgagggcggcgccgctggagacgaggtcctccatttcgagcttcagctgcgcgctgcgggacttgcggatgtggctgttgttgttgttgctgctgctgtagccgtggctgttcccaccggcgccggcgccgccggacgccgagcgcttcccgaagctggacttgcgcgacaggctcgtcgtcgtcgtcacgtcggccgtgctcagcaccgtctccgccgacgccgtcctgctcagcgactgcgccgacgacggcggcggcggcggcgccagctggtccgacttggtccgctcaatcatcccccctcccgtgtccatcatcggcttctccattatcgactccatgaacgaacacgaacaaactacctagctaacaccgtcacgttcctagcaagcacatttagagcagtagcttttacacgagacgagccgttatatacacagacacagagtgatgggaaggcaacacacgcagctaaggcatttggcaagcgagcgatggaggtcacgcgtgtgaggtggattgtggcgagggcgacgtgggggggaggcagcggaggggcagggggcgcgccagcgaagcgcgatgcgggacgcggggcattaatggagcgggaaagcgcgggtgtggctgggcgcgctcaggcagccagcttccacacatgccggcctcacgacgacgtatcgcgcagggcacccgcgcgagcccccgcctgcggctagcttagcccgcgacagggacgtccccggccacctcgccttcctcgctctctcgctcgcggaggcctcaggcgcgcgcgcgtcccttgcagatcgatccagcgcgcgtgcgtgtgcgttcggtttaggcgtacgtgcgcgcgggcggcagcggcggcaccgatccttttaagtcagcttattggcttatataatttataagccggtggatttaatgtcctaagtttagtggtttagttatacatctaccttacataagccaaaaaaaacttctccaacctagcttttggcttaatagtgttagagtggcttatggcttccaaaaagccaaacggaaaagctgcttgtttgtttaggtttagacttttcgacttataagttggcttataagcctaaacaaagagggccttagcccctccgcacaaattgaggcgctgggtgtgaaacacaaaatgatgacctatttagcaaatgctaacgtaaaataagtgtttagttcacgccaaaattgaaagtttggttgaaattggaacgatgtgacagaaaagttgaaagtttatgtgtgtaggaaagttttaatgtgatggaaaagtgaaaaaaaaagtttggaactaaactcgtcctaagtaaagttcctttaggcgatacatccatatctttacttgatgccatattatttactccatccgtcccaaaataagcacaactatgagtttccgtgtccaactttgatcgttcatcttaattaatttttttttaaaaaaaaataaaaaacataatttacacataaagtactattcatgttttataatcttacaacaacaaaaatactaataaaaaaattaaataagatgtacgatcaaaattggatactgaaactaatggctgtacttattttggaactgggaagtacaattcattgcagggttgctctatctcccgatcgatgctttaatttttctcgatccaaatcactgtcggactgccggtggtcgtttatccacattccatgttagcataaccacgatcaagcatggtcggatggtcctgttcatcggtttacctatgccttctatcaaacaagcagtaattttgcgcgaccaataacagctaactcatcaccacctaattaaaaacagtatagtggccatatgcctagataggatctaggaagaagacttgtgtgcgtcatgatgtagtgatttaatttttcttactaatgttgtgtttagttccacgttaaaattggaagtttgactaaaattagaagaaaaaatattgaaaatttatgtatgtagaaaaaatttgatgtgatggaaaagttgaaagtttgaagaaatagttaggaactaaataaggtctaagcaagatcttcaatatttggaacgcacattcacatcatgatcatgaactatctttgaggtggccattattgtttccaaacacttgtgagggctgagaaaaacaagcatctaattaaattaatgaaggataaagagattttttattaaaataataatatgaacgcgaaaacatgcttagaatgtactaacggcttaggagtgaaatataaaattttcgagccctaggcaatgtacagcccctatatacgatcttctagccataacacaggaaaattcggagcaggcaaaagtcgtcgatcgcagctgcgcaggagtcaggatggacatgcttggcatgatgcctctttctgttttccgtgctcacactgtcgtcacacagtgcaacgattaccatatatcattcgtgaagagaaacacgagtacacgagcggtcgagcatcctaatctcctttttaattttttttttatttttgaaaacaagcatcctaatcttgacgaggatgaaagtatcagcaacggccccaatgctattgttgacaagagatgtgatgtggctgtggnnnnnnnnnnnnnnnnnnnnctgcatgtagatgtactccactccagtaggcagtacgcctgcacagtcttttcctgactgttacggacgcggaaatgtttgtccggagaggagaatggtctctgctaaccggaagaccggaaccaccgaccaatcgggaaacggcgtggcgttgccagtactgattggtactactgggtagtatctttgacctcttggttaatgcactctaatgctccatttattacgaaatattgacgagatatttaaaaaaaacatactctcttcattctaaaatataactacacctataattatttcaaaatataacaatttatataccaacattttcttttcaaccaatcacaacccttcactattaatttttctcgccaaccaccacttcttaatcaataataatatatttatatttaattttatctatttttttaaataattatgtgcaactctaaaacttttatattctaacggatatagtaattaacgaaagttagctcgaaccttaagcgataaacatgcagccttcccattttatccgtgaggatttctttccggttcattcttgtttcctacccgcagtttagattggccttttatctcctgttacggttatttttttgggatacatggcgtcataattctagcaatccccttcctttttatcctcgtgttgcctgcgcgttaactttcatgaaatttgtttccaatttaaatttgtagcctgagattgcaatcttacaacataacaatttttaaaattcacattgcatcttttgaaatttatcgtgtaaatatggaacatataatgtcaaatacatattaaaaaattaaatattttttatgaaaaatatgacactaaacatattttttttttattttccaattggcgagcccgctcgtgtatttattactttgtcttgttcttgcatgctaccgcaatgcaatgcttgctttctccgtgtgttcttgcatgtataaacagttcggtctgtctatgcctattgtcaatggttaatatggatatactgtttatctttcatttcaatttaaatacatgcaacgggcaggtatgtagagttctagcgtgaggtcaatcacacgtgggtgcggtgcgtctcctcctcgcttcttagggcacctacatgggtttcaaacgaattaagaaatataagtttgaaaaactattttaaaaaactaaccaaaggaaaacaaattctaatcaaagtatttgtgtgtataatattcgtgcgtataaaccttttatatataaatgtatacattgaaatatataaatgtatatatatacattgaaactttatagcacatataaactttgtatgcaaaaacttttaatatagcaacattatgtataaaacatttgatccaaatctgaatcaagcaaataaactttcaatgtataaaattttttatatacaaaaggaaaaaaagtgtggtgtgaaaaaggaaggaggtggtgcacaggtgcatgatcatccacgcgaaagccgtttcgggtagacattaaccaaaagcgagtgaacagtgagtttttatatcactttgagtacagctttttcagaaaaaaaaactattaggagatgcctaactttgaattaaggtgtggccaaaatacccacgacgaaacactacatgcctttaccttcaaattgatattgccatagtcaagcattacatataggaaaaggaaataataaaattcaacaggttacattcgtataagtgcacggaagaaatagtaggttctttctttcgccacgtataagctttttcacgaaacatatcgtttagtagtttaaaaaatatgctcgcaataagttatcagcaagtagctgaaaagaattgaacctaagagttgtttctgtacgcaaatgattaggtcatacataccagctccaagaagtcaagaagaggcataggcgaaggacacacaagatattttggagcaggcaaagtcgcatgaattatctgaaaaagcaaaatcggacaacagctgcgaacacagctcttatctgttttctctactccacacggtgcaaacaattactgataactcgtgcaaaatcatcaacacatgcatatcctaattatcttgactaggaccatcatctctaaaaatataagaccccggccccgtgcgaaatgtaaaataggtctctagctagattcatgccaccaaacatactttcactgtttcctcaagcctcatcgaatcttgcatgtcttctgggcttagcgagattaaaaaaaaagaaaataaagcaagattgaagtgaaaccttgaattgagtaagacaactgatattgaattgaggagggaaaaaaatcaccagtttgtgttctgcattcactagacgaaccgaagaaagagtgggctaaattgtgctttctattggttaacatatgggctattttttttttctctctgaagcatggtacttaagcaagtgcattagaattcagggcctcaatttgtagggtgtcctatacagctggggctgcagg

SEQ ID NO: 49621 - DNA, 3203 bp, Oryza sativa
  unsure (1)..(3203): unsure at all n locations
tggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaacgcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagtcgccgccggagtcctcctcctcctccccggtcctcctcaacatcggttcgctccccttctccctttcgcaaaaactcgctccccatccccaccgctcgcgtgaatttagaggctgatggtgatggtggtggctatggcgcagggggcaagaggtacgcgaccaccgtcgagacgctcacgcagcgggagcccagctccatgctcgccgccatgttcagcgggaggcacacgctcccccggcacccggacacggtacgccgcgtactcaccagtggagctctcttctcgggagctgtagcctcagaggatgaatggtgggtgcagggcatggtgttcgtggacagggacgggaagcacttcaggcatgtcctcaactggctcagggacggcgccgtcccagacatgtcggagtctgagtaccagcagctcctgcgagaagcggagtactaccagttgctcgtaattggaattctcgatcgtttcttcgattcatcaggttgcagcttcccaattaaccagccgttgtgaaaacatgatggtttgttttccagggcttggctgattgcataaatgatagattgggttggaaaaatgatgagaatttctcggaggccgaattgacacgcaaagatgtgatcaagtgcatccaagctccgagagtcagatttcgtggtgtaaatctatctggccttgatctatccaaacttgtaaggtctttattgttgttctctattggagttgctcattttttgttatggttattaccactccattctagttgctcttagcaactctgatttcgtgtgtgttcaacagaaatcaataaagcattttattttttttctttagtttcttgtaattttgtgacttttacggtctacaggatttatcagaggtggacttcagctatgcatgcataaagaatgccaatttttcctctgcttatcttcgtaaagcaaagttcagggtatgccattcacacctaagttcttcgttgtttaactgcttttgatgaagtagtagcccttaggaactatgctagttatcataatattttaaggcattttagttctgtcacaaaaaaatatctaagtctttgttttttgtatgactgtcaaatgttgtatcagtaataccttaccttgtatgttcatgacagctgacagaagctacttgttcttcattccaaagtgcaaatttacatgagtaagatggtccaaccagtttcttttagcttatagataggctctaagatgaaacacggtctctccttttttacttttgtgttttttttttgtgttggatgcataagcaagcagctaaccatctatttcctcctttttgtgttatttttgtttcgctgtgttattgtaattgcttgatttggaataacaggtgtgagcttattggagcaaatcttgaaggatctgttctagataaagcaaaccttcaaagtgcaaacctacagggtatgtaatccctttctttacctgtcttccgttttatgttatatgtttccaaaaaatactattatgctcaggattatcctgtttcttcattttcttggcttttgacatccttttcaccagggaagatcatcgtccctgtagtattagacaatgtagctatgcctattttgctttcactctctcctattcagggtgtgcttatattcttgtaaaaactaagtaggaaatgattgagttgctaggcttattttgcagatgcatgcttaaagcaatgttgcttcattgaaacggatcttcgttctgctcatctacaggtttgaaagtttattgtacatggtgtgtttcatgaatgttcccagattctcgcgctgctattctgctaacatattgcattcctggtcagtatacaagaaaaagtgaaaatcatgatgaacattagcataaagcaaagcatttctgtttttttttagaagttagttttctgctgctagaggtgatcgaatatctagtttccatccttgcaatattttgtatcatccaaacttccaaagtttggctgcaaaattttgtccttgcccaaagtattatctgcaacacatagacatatattttgtccgtacaggcttgtatcgtctcttcctgaacatttgaatataaggcataaaggctccctattccaaatggttttcagtaacttaaaatacgttgatatttgggttcttattactcatttcctcagtgtcttattgtcagtccaactggattttcagggtgctaatcttatgggcgccaacttgagtggagctaatcttgaaggggccaatctcaaggtaacaaaaatggccccattcaacctgcactttcatcctgcctgtcatatgtaacttaaggaaagctacttgagggggttaaccacagagctcttacacaaagacagaaaaaatgattctaatgtatccaactcttcttttacngcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 49622 - DNA, 51043 bp, Oryza sativa
  unsure (1)..(51043): unsure at all n locations
gtctcttgtattggtgatgcggtggagggatagatggcgattttactctctccgtctcaaaaattgaggaattttggttagagggtggcatattctatgagcatgttcagattctaggatgtgtgtcattcaaccaaatcttttatattttaggataggacgaagggagtatgttagtacctgtcattgtatgtctatgtcaggtcctgaaggcacggcatattgaggctcgaaaagggccaacctgtgccttcgaagctgtgcaacaagaatctgaatccagcacaaaatttctcaccaggaggaaacaaggtagtagtacatgtttctgacgatcctttcgaggaatctcatctcttcgctgtcatgtgtcgtagtagaatcgctgtgtgaagcacaggaaattaagctgtttgctgccaacggaatgaagctgcgtattacagtacttacatacaaactctggtgcgcatatgctagctgcagaacagcaatggcagttctttttttctgaacttggttaatttttatttccaaataacttattccatttccaagtgaaggaactaagctagatggatgaacgagtttccatcaagttacagcacagttgacaggatcgatcgagttatacattgttttgaacagcaggtaaaaactcgtgttgctttgcctataaccttaagcatgtggacttgcgaagcactagtaattaaaccgatgtccaatggattagtgagtagagagtatatgggcctggctaagtagcataggtagatttagaacatgggccggcgagcgcatctgatggatgatggatggggaattccatggatgctcgctagcgatctaggctgggactctatacgtgcatgcctaattgggagtaagctagtaataaatactatctccgtccgacaatataatgaatggttatatagagaaaatctcttatattctcggatagaggttgtagcggattaattttcatatgaaattaaaaaataatcataaatttagattgtatcactaaaaatctataaattcgaagcataaaaatttctctaatccatacatgaaaaatgccatttaagcactgtagtggccaaaaaaaatcagtagcaatcattaagcgctatagcgaccgctaagtttctatatatcatgtttaatctgtcgcctctataatattgttattgtgattgctatgaacactatttattgggagcaatgagaaaccgtgagaaataaaccacttgacataaaaattaaagcgggttgctgcatcgtctgttcgccgcaccctagctaagctaaaccattgatgccacgaccgatgtagccttcaattcaggcgcgggcagcatcgatcgtgtgatgtccaccgcaaacacgaaagaaattaagagatctatagcaatgttgggagtgatatataggcagcatgcacgccattgacctgctgatcgatcagatcccatatccgtgcaatgcaacaacttgcaaaagtggccgtggttcacactttcacacaccacaaggccggccggccgtccgtcggttcacatccccgtgtgcctttgcacgcgcctactcgtttcgttccataaaagtccaaatgtaaaactgaagaagatactataatataatacaaatatacaacaaatctaaacttcatcttaattttaagttggtttttcttttacggaaaaaagaaccagacgagacatgctcgctcagctgtaattacaggtcgcttttgcgtgacctcaccactgacgttaccgctgtatagtaccagcaacaggtagccgcgttaaagcaaggataataataaagccaactgcttactatctatcagctcactcatatagtggttaactcttcactataaatatatggtccacctgtctatctcacatattttcttggttcctgtgcctaagccggctgtaaacttacagcccgcttctcatctctcccctctcctctctcatccaattcagcattcagtcttcttatagccctctattatacttgacctcaccactgacgttaccgcttcaccagcaacaggtagccgcgttagagcaaggataataataaagccaactgcttacttatagcctatctatcaactcactcatatagtggttaactcttcactataaatatatggtccacctatctgtctcacatattttcttggttcctgtgcctaagccggctgtaaacttacagcccgtttctcatctctcccctcttctctctcatccaccttagcattcactcttcttatagctctttattatacttgctcttacacggtacaaatcgcgcgcctcctggctagtagctacgactccatagctgcagcctgcagccttgctgtaatagccagcagcagagcaactattctacacaaaatcgaagctcgttataagaaaaaacggttaataacgaatgaaaaacaatttactttctccatcctaaaatataaatatttttagcattgtgtcgagtcaaacatttttaactttaactattaatagcaaaatataaaaaaagatcaatcatgtaaaattgatgttactagatttatcattcaacaaactatcataatatgtaattctttttatttaaaatatcttatttttatagatgttgttggttaaagtaacgtctcgaagactgtatagaagtccaaaaatatattttaggatggaaggagtatgatacagtgtgtcttaacgagccgtaacgatttaaaaaccaacactacgagataaacttataattaaaaacatcaaaaatcaactcttcaaaacttaagttttagaaattaaatcttagttgcgagtgaataagctgaagaatctggcaaagctaccaatgcccatcaagctggacaccacacactgttcaactccaacacgaaaacgccggccttttcatctcctgctctgcttgcacaccgctgtactcagcacgcgaatgaaccgtgtggaggaaccaagacgccgaaaatgtcgatctccgtgtgtacttatatggattatttgtcaggcaaatgaaagtgatcgatcgtcagatcgcgatggtttttcacgtactttaattgctccctgaaaacgatcgggagattaattgatagctgcagcgcgctaattaaccctgctctgaaaacgaacgatttggactagactatatcctctgtgatcgatcgattatcccacccaattcagcatttacaatgctcttcttttggcacatttttcccctcaaaattaagacgatactactcttaataattaaaacatcacaaaaagagaaaaaagttggactcactttctaggtccttccttggatgactcgctggttcctccaattgatactaaaaatattacgtatacaattactaatttgaaacacttcctgtttcatcacaacttttgtctctacgtgtcccgtcaatctgtcatgatgcgctgccctcaatttttggagtattagctcaaacaagacgacgaaattgatcgttgtttagtcaattgtcttgtagcactacaggtttctttgtttgttcagcatacaaattattgggtttcaaaaaaaagcatacaaagtggagtattgctaggtatggaccagtattttgagaggttgagacaaacacgtggagaaatcaagcgccggagaatttctattcacattttttttttcatctccatactctttatgttcaaacatcaactcaaatctatcaccaacaaaattcctactactaattcttcgagaggtaattactagtaatttgcagtgctaatcaatttcctcatcgatcggcagcatctcagccgatgatatcctcgtccgtccgatcgggatccgacggccgagcagcgccgggcccaccagcagcatcagaggttttccactgttcgcgtccttgctggctgttcccatcggagtggttcgacatattttatcgaatccagctcgcatttggagatcgaattgggggatttgaatccccaaatttggtttcgatcgattcagttcaattgtgtcgtcgtctcgctcactcggtgatcatgtcgagttcgggaatggcggtgagatcggtagcgaactgcctccccttcccgccgccgcggcgcgccgccaccggccgccgcttccccgccgccgccgccgccgccgacgcattgctcttgcagtaatcagacgcgtcgtactcgtactcctcctccggcggagcgaacacgagcggcgccacggacccgcgccgccgccggccgccgccgcatccggatgtggtgctgctgctgctggcggcagcgagcgcggcggatgccttgacggcgagcgccgcgacctcctcgcggcgcatcccgcgcctccgcacctcgcccgggagcacgaagtagatctgcccggggcggagctccgcggcggcggcgacggccgcgacgggtccctcgaagcccatcttgtcggcgtcgcagaggaagaagcgccgccccacatcctcctcctccccctccgccgccgcgacatcctccagcacccgcgccgccgtcgcggggcgcgggtactcgcgcagctcgcccgtcggcagcagcaccatcgccgtcgacgccgccatccccgcctcggccatcgccgccgccacgccgctcgacaagcagagccccatgccgatgcgttggtagtacaagtagtgtgaggaggttgaggaagaaagaggagagagcaatggagattgatgggtgagatgagatggcgatggagaggtggaggtggaggggcgcggctttatatacacgggggaggaggaagacgagggggttttgtcgtgttgcttggagaaggggagcatgacagcctggcggtttgctggtggggccagcgcgcgcgaggaatcggggatttttttttcttttccttttttccttttttgttttttttaccgttttactgctactgctccggtgtgtaaatacgtggtggatacgaaggttgcgtgggcggcacgtagcgtagatggcggcgtggcagcaaagggtgccaaacatagagagctttaaattacactgaaaataagtaaattcattatacttaattttatatatgcgtcgagaataaccgaggtagattagttagcgaataataactgaggtggttaacttaggtgaataaaggtaaatatagcggcagtactaattatcctccaaattaagcagctgataattaagatagcgtgcagtaaaaagagtgatgcatttggcacaagacactaccaacttttatgctttgaagatggctatacgtatgaaacgtgtgtatgcaggagcggatccatgcctcggatcatccggcccatgcatggtccgagtcctaggattgaatgcacattatgcaatataaaattttaccatgttcattcaagtttatcctaaactgtaatgggttggccgagaccttgggtcaagctaggctggatccgttcccaaatctatgtccgactcaacaagtatatagatatggctgttgttttcgtaaactcatatgaagagaaattgaacgcatgaattggtggattagacgaggtcggatactaaatatataaggtatagttgtatgtgtagtaggactctttatgttcgaattatggccctgtttagatttcaacttttttttctttaaactttcaacttttccgtcacgtcgaattttcctacacaacaaactttcaacttttccgtcacattatttcaatttttttaaactttaaattttagcatgaaactaaacacagtctatatgtgttaaatagagtaatgggagataaagccgcgctagctagctagcttttgtaaaaacgaaggcgccagtatattgcggtggtgctatacatgctacgtactgctacttcctccgtttaatattataagactttttaggattgtcaatatttatatatatgttaataaatctagacatgtatgtgcctagattaattaacatctatatgaacgtagacaatgctagaaagttttataacctgaaacggagttagcagctagctactcagctactcgtccggctttacaaaagaaacgtggaaataccatggcacttgctttgctactccgtagctagttgactcgtaaaggatcagcagatctcaaatcgtatcacgatcgatttttattggggcaagcaaggttcgtcgatgtcgtcatagtacgtagcagtacgtactactacaagtatgtgtatgcacagttgcacactctataactataactagctagggatagtagttgataaaaaatggtgtcgacatatatacatactccctccatcctaaaatgtttaacgtcgttgactttttttaaaaatatttgaccgttagccttattcaaaaaatttaagtaattattaattcttttcctatcgcttgatttattgttaaatatatttttatgcatacatatagttttacacatttcataaaagtttttgaataagatgaacggtcaaacatgttttaaaaagtcaacaacgtcaaacatttagggaaggagggagtatatatatatatatatatagtgggaaatggaaaaaaaagaaaaacagtgggcacaacaaattgcgcgatacaaaagtataaacacgaaagccgtacgtgtgtcaatagagcctaacgagctagtaccaaaattaatggggagagctaaggtagcagatagatagccaaattggaggccagtcaggacattcatcaatgtcgatcgatcatatcgtacatggttttgcagaaaatcgttggcgttgaagctagctataagctagctacgtactgtacgtacataccctagccaaaaggtgacctgaaagcaccataggtatacgtagttcgtgcttgcagctggtgtggtttgtttcctcgggagcagaagtcactagacgatgcagctagctagttgagaaaaccaggtcaatctatctctatcggttcatggttctttggttcaaccacggtcgaagcgatgaaccagacaaatcaataatattatattttactagtttttatgagttttaaaaggtgcaaatcaaatgtattttattttttagcagaagaaataaacctatatgaatatctttgagtgcacatgtactgccttgtcttttttaataaatgacaccattaactttttgacacatatttaacaattagctttattaaaaaaaatgtaaatttggtttattttattatgagtttttctagtatgatttatatcttatacatttgcacaacatttcatataatacatataataaaatatgtgtttaaaagttaattaataacattatctattgaaatacagagagagtatttaaatctggtccagttttttcaaccatatatggatccgagtggggacgagacaacgacggtgaagcaaattgtgtgcatgcatctaaatatgatatggcgcaccaatataatccatgcatgcaccaaagtgggtactcctatcaaacacgtcccaagggtgcatgccgcatgcacgagatctaactatgcgatggagccatggaggggacgacggccctgagacggacgcgtggcggtgtgcatgtggaccttgagatgcagggtcacgtggctgcccccgtggcccccgccctccacgctggcacctgatcgatatatcagtgtctctgtgctttcaatgcttttgtatatattggtcctgcgcccacaaaaattcggtgcattcgaatattgtggttacataacatggatatgtgcgatgcattcagctaggtctctgctgctgcatatgcatatgcatatgcttctttcttttcttcgaggtgcgctgcattcggcgtgctatagctggcacgtacttacgttagttcggtcactgtggcctaccactactcctgctgtgccacgtatcagcatgcaattgcactagctcatctgaaaacaatgttatgttcaattgagctattcatttaatcatgggaaaagaatacttagaatctgtttaggatagataagattctaaaaacaactgattgatatatatgccaacttttaagaatttggattctgacttcttgttttctttttattctaccactacagttaacctaataactactccagcatgtacgctaataccctgcgacactgcgtgtatagttaggtcgcagatcgatcgatcttcaaagttgaaacttcagtcaacaaaaaaaaaaggaaaaatcgccggtcacatggtgaggctccaaaaatgaagggcatccatacaaatgtacaatgctatgctagctatagctaccttatccatgttagtcctacatactaacatccatgtgaccgtgcctttgttattttacattgcaatcggcaatagctcgcgtgtctctgctcgcgtcgcacgaagccgatatgttttatataatctgtctatcactaatccaactactaccacccaacgactttatcgatcccatcaaacagtgtcccaattagtagcagtaataacatactcaatataatgttcaattgtggatgacgagacctgatgtacagtacaattcatcatcatcgatccggaatatattaaaaattctaaaaagggagttcgagagctccggattggaggaatgaaaaacatgtgccaataattgtaaccctgctgacccactgtagcacgcagtacgcgcgctggaggaccactgttgatctgtcggcccctgcctgcaaggccaagagaggccaccaataattccaccaccatacaatgatacaaatgcatgtactattatattgtgtatatatacgcgtgtccaggtgaatgaacacaataatattctgaaaacgaattaaatatcccctccagacacgcgcacattttaaaatttaattttcaaaacattaggctaacaattattataatataaattaatttttgtttgttgaaataatatcatcggattaatatttaaatttacttttgtatggttataatattattaaaaaaccttatatagtatacagttaaatattagttttagagattgtattaaatttaatcatatcttatattatactatttcttttttaaatgtacgatgttattatttttaataatatctaaccattcgtcttattaaaatctaatataaatactccctccgttttaaaatgtttgacatcgttgactttttaacacttgtttgaccattcatcttattaaatttttttttgaaatatgtaaacctatatgtgtacatgaaagtatgtttaacaataaatcaaatgatatgaaaagaataaataattacttaaattttttgaataagacgaatggtcaaacatatattaaaaagtcaacggtgtcaaacattttgaaacggagggagtatataaaaagtataagttaagattatattttgtttgaggataaaacaagttacaataaaataaatgatatttataaaattttttagtaagataaatagttaaaacatatattttggaatggagtaagtattatataggagtacgatccaaaaaatacacgcagaaaagcagatcgatcgatcgatcaataatttcattcgcaggtaaagcggcgtgacacgtcgacgagcagcctgcaaagcaggcgacgtccgtggcggcgtgcatgcagctacgccaattaacgccaccacccaatgcgcgccaattccagattccccgagtggggcccacatgcagtagggggggtctagctagggggacgcggggggcgtctcgaccatgttcggccacgtcgtcgctgggtcacatggaccggacgcgaacgcatgggtccgatccggtcacgtctcgtcccgggagtgtgggactcgggcctgggtccgacccagggtggcagtgcatcgtgccaacaacaataattgtgggttggatggatggatatgtccaaaggacatgcgtgcatgcaaacgttaggcaaaaaaagaaaaaaaatagaaacaaaagaaagaaatatatatgtgatcgagcgtgtaattggactgtcatgtcgaattggtacgggtacaacaattcgtataccttttgtatacgtacataacaaaaaataaacgattttgctaacgatcactcgcgtgattttttttctgacatttcaccttttttttcaggctcgtcagccggcgcgtcggacaccagcacgtcggccaccgtgtcggagaagcacgatgacacggtggcctttgaccgccagccgccggtagcacggccaacactgatcggtgagagacatcgtttctctcagaaatataaaattacagtcctatataactaaatttatatttgtaaattcagttaatttgacgtgtaagtgcactgtaattttgataaaaataatatgtaagtaaatatgtatttattattttctttaaaatataaaattacagtcctatataactaaaattacatttataaatttagctgagttgacatgtaagtgcactgtaattttgataaaaataatgcgtaagtaaatatgtatttattattttatttaaaatataaaattacagtcttatataactaaaaattacatatgtaaatttagttgatatgacatgtaagtgcactgtaattttgataaaaatattgtgtaagtaaatttgcattagttattttatttcaaatataaaattacattactatataactaaaattacatatgtaaatttagttgatataacatgtaagtgcactgtaattttgataaaaatattgtgtaagtaaatttgtattaattattttattttgtagtccgttggatgtaaatccaaggaaagaaaaaaatctgggcacccgagtgatgcataggcggtcccaaaaataaatcgtaatgtggatgattaactgtagcaacaaccgaccaatatatatcaatcagtcaccctaatcatgtattgcctcatgcattttggctacgcgtggctggctgtctgaccattcaaagatactgtgactgtgtgcaagcgtgcgcatgtacatacgtgcagcttccgtgaacgtacatacagtagtacgtatatatacgcgtatcaatgtatgccattttgtatttactagtatggagtagcattctagcaagatccagtcgatttggttcagggaaatctccgacaatatatcgatttggtcctagctcgttcaacagctgctaataataataataataataataataataataataataataataataataataataataataataataataataataataataataataataataataataataataatttttaattgttttaattttgatttgcggggagatgctcatgttatgacttagatgatcattcgtgtttatattgtttggaatatttgtggctagctagctgttggatctcccgggaataactttttttttaaaaaaaaatgttcgggagcagtaagtgagagaatcaacactagttagtaggagtgtgtgtgtatatatatatatattactctctccgtcttataatataagggattttgattttttgtttggaacgtttggccactcgtcttattctattttttttgaaatgattatttattttatttgtgacttactttattatctacagtactttaagcacaacttttcgttttttatatttgtaaaaaaaaattgaataagacgagtggtcaaacgttgcaattaaaaactcaaaatctcttatattttaggacggagggagtaatatgattaatctagagctagccagctacccgatcgaatccaacattatgttgtcctaccacctgtacgtactccctccgtccaaaaaaaaggcaaactctgggtttctgtgtttaactttgaccgtccgtcttatataaattttttttataattcgtattttcattgttgttagatgataaaatatgatcaatattttatgcttgacttgtctttttaatttttttcataatttttttaaataagacggacggtcaaacgttggacacggaaactagggttttcctttttttggatggagggagtacgttctgtacatgcgtgcatggataattaagcaagaacaaacaaggaaccttaagaattaatcagcctagatttattttaggaataggttagttaacacatgatggttgtttaatccttgtgcatgatatgggtatcccagtcgatcactaatggtttagattagttgcatgcttcctgttgttagtggcatcatctggtagctaccagttgttagcaatggttggttcatcatcatatcagatcgacagagtgagcagcaaagtcgatctagctggtagtagtgctaatcatctagcaaagcaaaagatagcatacatacgtgatctaaatctgtcaccagaagatagtagtactactctagtatcaaacagagcaggatctaaaacaaaaatcatactgtatgcattattatgctgattaatttggcctggttatttggatgcatcgaagagtccacgagagcgggagacgggcctggcccattgggccccaaagtggtcgggcccataggagggtcgtggcgtggcgtgcccaggtgtagcgcaacttgcagttcggcaggtagctgcatcgggccgcgggcgccaccacaaccagcctggaaagcgcatacacacgcgagtacgcaaaacgctgtactactatgcagctacagtgcaaatgcaaccagaaacagacgggttctttttttaaaaaaaaaaagaaaaaaaaagcagaaacagacggagatgctcatctactctacggagtatagtgtactcctacttgccactagtgtggtacgtagttttatactttattgttgaggggaataccacgtgtggtatttgcaatatgctgccaaacgacaacggaagtctgtggactgtgtggcatgtatgctgaccttttgttttgcttcactacactcgcaacaaaaaaatgtcatatttgtttggctggaccgccgtataaaagtaaacgagacagcaaaaaaggattttatatttctactctataagcgtcatgaaagtaaaggccgaaaagaaagataaaatatctactggttaacgaggatcattcttttgcggtgaatgcttaattaagtatttaataactactggcaaaaataacttcttatatatcgcagaatcactcacatcagtgtcagtaatttgccctatgtttttagatcaagatttgagctccatatgttcctgtaaaatactaaaattacgcgaagatatcagcttcgctacactcggccttcgttcaaatttcagcccgttaggcttcgtatgatgcccattaggcccacaagatcgtatgcgaagccatggcccaaaaggcccacttatattaatctcaaagtattctaaaaaaaaaaggaatagtattcgacgaatccccagcgacatgagcaaccattgcgtcggcggcggcgccgccggagtcgatgacttgacggacgacctcatcgccgagatcctcctccgcctccggccgtccgagccggcgtgcctcgtccgcgcctcggccgtctgcaagccctggcgccgtctcctcaccgaccaggccttcctccgccgctaccgcgatttccacggcgcgcctcccctgctggggttcctccacaacgtcgccggcggcggcgaagaccggtacgtccccttcaccgcctccccggtctccccgccggacatcgcgtgcccttgctgggtcgccctcgactgccgccacggccgcgccctcctcgacgagttccccttcagcgccgacttcaccgtgtggcaccccatggcgggacgacggcgccggctcccccggccggacctcccctacttcatgtcctacgccgccgcggtgctctgctccgccgtcggatgtaaccacctcgactgccgcggcggcggccccttcctcgtcgtcgtcgtgggcatcgacgagccggagcagcagaactcgcggccgtgggcgaccgtctactcgtcggattccgattcgtggagcccaacgacctccgattacctcaacctaaccctaacccccaattgcgacgtcgacaggaagcccgccgccctcgtcggagatgcgctccacttcgcccttgcggaaggttctggaatcatcaagtacaacatgggagagtgctcgctttctcggatccatccacctgttgtgtacaagggaggcattgtggtgatggcaatggggggcaatctgctcgggctcggcggcatcgagggttccatcctctcaatgtggtctagtgatgtgagcctggatggtggtgtcagatgggagaagaacagggttatcaagttagagagcttgctaccaagtatcgattgcgtagaggcagtagcatgtgagcttgcacaaccagcaccgattggctttgtggatggtgctgatatcgttttcgttagaacagatgctggcatcttcatgattgagctcaaatcaatgtgtgttaggaaggtttgcgagagaggatacttcaaagccgtcttcccctatacgagcttctgcactccaggtacttgactctatcttgatgtaaaatttcgacttctacatgtttcttaggcacgattcaggaatagtttgtttgtttgctttcaaattggccgagtaataaaggaatatatttcaccagaattggcttggcctaaaaatgtgttcatcctaagtggcagaccaatcccatcacatcgatgaggcgcagctcattgtaccaatttccatttgaatgaataatctgttgagcaagcttttattgcagtgaatatgtgaataacaaactaatgagtgacatgggtgatgcacacttgaatggtttgatttgctacgttcattctgcactagtttttctacaagttggtcacaatgatgtgatcagcctattttaaggtgtgaaggatcgccatattgaattgtgacatttccctaacatatattgatgatttcggttgacagcatttattttttgtcactttgaacttccttattatagtttgaacttttttttagatgtgtaacctaagttcgcacctttatcactcaaatctgggctctgccactgcttgcaggcgtccatctccagcaaaacagagttcagttcagtaggaagcggttgctggaactaagagaaggcgatgtggcaacaggtatgcaatccaacggcaagagccacaaggggcgacagccgtgacggccaaagaccacctacaaggatggtgctggcaatgggcagcgagctctgcagcattttgttgtctgcgtcagagtaaaaatggcagggaaatgtttggacatgggagagagccgattgcttcttcccatgtgagtgaaaaatttcatttcaaatatgcacggtttgcttgcatttcaactaaaatgtgaggtacttcctccgtttcacaatgtaagactttctagcattactcacattcatttagatgttaatgaatttagatgttaacaattagcccaaaagcctggtacaaggattgaaagctgaaactgaaaggtgtgtaactgtgtaacgataagcctagaagtaaacatgaaccatagctctgaaagtcatggcttggcacaaatggatggagggaagaaacacggttggtaaggctaaataactgcttccttagaataactgttggtaaggccaaccgtaaacaaaatactattgttttttttcctctctgtatctgagagaacttagaattctacatttgtagtatcataaaccatcttttcaatttttattcgaaattgtcccttctttattcctacaggccctgtgccttgatgaggggaacctcatcgttgttacgaggctgtgtttatatccagtggagaaaagttttggcgtgtcacattggatatacagacacacatttgaagtattaaacgtagactaataacaaaacgaattatagattccgcctgtaaactgcgagacgaatttattaagcctaattaatctatcattagaaaatgtttattgtagcatcactttgttaaatcattgggcaattagacttaaaaaattatctcgcaatatacacgtaatctgtgtaattagttttttttctatatttaatactccatgcatgtgtccaaacattgtgacatggtgaaaattttttgcgtgggaactaaacagggcctgaactccttaatggaatgacacaccatgcttttgtgtgtctgtgtctgaactccttaatggaatgacacaccacacagacacacagtacacacacaccaaaaataagaaatcgtctcttcatttagcagtgtaataaagcactcacagcaacaccaaaagaaatttctgaagaatcctctcaacctatcaaatttcttatgactactaaccaagcagcaaagaagggatgcatcagcttcagtcaacagttttgcacatcactagcttcaagtaatcaaccaagaggccaacagctagaggctcgatctgacgtattagcataatttggacccattttgtttgctaaattgatgctataattgttggagatggcaatttgtttctatcacgacctgaaaaagatgcagaaaagttataatcgttttacaaccaatattcacaaagtattttgagagagcattcctactactgacaaaaggtaccaaaaacaagcattgtcaacagacagaaaatgataacagaacaaaatatcttgcccattctagttgatcctcgacaagttaaagtacccagtgtcacatatacttttccccaagcacattatcatcaccgttttgttaatgttgctgaattagtattacttatgaaccaaccatatcccatcagttttagcaaacagccagaacgtcttacattcttcgacatcctgaagacattgtgctagttttgcaaattattacagcttgacagcaagattgacatgaaataaagtgaaaacaaccaacttgaactaaggccaagatcagcaaagatgggatgcatcaccttcagtccagagttttccatatcactagcttcaagtaaataaacaagacctcctaggataccaacaacaagacgcttaattgaacccaacagattagcaaaatttggacacattgtttgctactagtttactgctgcaattgctggcgatggcaatttgtcctatcacgacctgaaaagggtgcagacaagttataatcgttattgtcaacacacaaaaaaggtttatcagaataatatatctgcccattctagtggatccttaacaagttaaagttccaagtgtcacatatacttctctcaatccattatcgtcgcccattctagtattacttgtgaaccaaccaaatatccaaaaaaatgttttcatgtcactctctgaattctgaagcatactgaatctagtactgaatatcaatgaatctctcttttatcagtgttatcaattattttcagaactttttataactatctgattgatgctaattatgagccaaacaagtatattcaacattgttttcatgtcaccgtcagaaacatactgaacattcttttttcctttcggaaggtctgagacacacagaaaagatatccctgaatcacgattggtgaattgagcaagaggcatgctccattctgaaactttgaactgaacgatccccaaatcctaatgctagcaaattggtaaaggatgtacctggaacgaagaagctcatgtaggggaagatattgaagcatctgtccttctcccacagcttgctgatctgcagtgacttgagctccatcctgtagtcgccatgaatggtgtggaggaagatgatgtcggtgccctccgcgaagccaaccagggacagcgagtgtacaggatcaaagaaggggagaacagcgtagaggtcgatcacattgcgccgcacccaccctgcacccgccaccctcgcccagaggtggatggaggcctcgccgtcgaagagggcgagccccagctcgccgtcctccgccgtcatgaggagagcgtcgccgtccccgtacgccaccggcgggaggatcaccgagagttccagcttggtgaggtcgtagcgcaggatggctttgccgaagtaggtgaggaagtggaccgcgtctccggcgaggacgctgggcttgctttcgagttcgagggaatcgtcatggtggacggtggaagcggcggtccatgtcccggtctcggacgagtaagaggatgccgacgcgatctcctccccgtcgtcgtcctcgtcgttgccgacgaagaccaagacgaaggggcctccgtggcagtcgtggtggtcgcagccgggcacggcgcagagcacggcggcggtggcgaacgtgcagagggtgccgtagggctcgcgctgccgccgcacgtcgccggtcatggggtcccagatggtgagctcgacgttgctggactggaagagggcgcggccgtggcggcagtcgagtggccaacaattcttgtgctccagttcggcggggcggaacgcggtggtcgggacgaactgcgcgaagctggggacgcggcgggcgggttcgtcggagacgtggtggatgaagcccagcaacggaggtgctcgtcggcggtggaacgcgcggtggcggcggaggaagacggggtcggagaggagacggcgccagggcttgcagacggcggaggcgcgggcggagcacgagggatcgtccggcgggaggcggagcaggatctcctccacgacgtcatccgtcaactccggcggcgccatgccgccgcgcggcgaggtcaggcgttggattccagatgatttggggaagagaagggttgtatgtttcagcttagaccctataaaactcgatatttacgactacggctgtgtttagattcaaaaaatttttttgaccaaaaacgttacatcaaatgtttggacacatgcacgaagtattaaatgtggacaaaaaaaatcaattgcacagtttacatgtaaattgcgagacgaatcttttgagtctaattacgccatgatttgacaatgtgttgctacagtaaatatttgctaatgacggattaattaggcttaataaattcgtctcgcagtttacaggtagaatctataatttgttttgatattagtctatatttaatacttcaaatatgtgtccgtatacgtaaaaaaaaaattgtccaataaactaaacacggcgtacatacaccaacacaggcaattcttacagcatcaccagccatgcccttattcatccctaatcttattcttttgggattttggtgaaaaaagaaatccaacagctatcctattttgatgctaatattttgaaaaccatatcatcacatccatcgctctcttcatttgagggggagcgatgtggcacgcgcgtcccggtggtgtggaaagaaaatcaagggggagcgatgtggcgcaagcgtccgggtggtgtggaaagaaaatcacaatcagggatgaggaggaataagggggtgtttagatctaggggtgtaaaattttagcgtgtcacatgttgtattacatagggtatcgcatgggatgttcgggcactaataaaaaacatattacagaatccgttagtaaaccacgagacgaatttatttagcctaattaatttgtcattagcaaatgtttagtgtagcaccatattgtcaaatcatgtagcaattaggcttcaaagatttgtctcacaaattagtcgcaatctgtaattagttattttttagcctatatttatactttatgtatgtgtttaaatgttcgatgtgacatggtgaaaaattttagggttgaatctaaacaggcctaacttttagttggtagtttactatgggtttcactttctgggttagagattcaattttataagatcttttggaaggatcacttttttgacatactaccttcgttttttaatatatgacgtcattggttttttttgacaaacgtttgactatttgttataaaaatatttaaatcatgcttaaagaatacttgatgataaatcaaattacaataaataaatgataagcatataaaattttttgaataaaacgaatagttaaacgtataaaaaaaatcagcgatgtcatataaacgtattaaaaaaatcagcgatgtcatataccctattaaaaaaacggtgggagtatcaaattctgattagcattatcaaattcagatttttggagattgatgttacctattccgttggtgatgctcaaatattagtattaagaagccatttggaaaatacgccaggcagtgaagatcacccagcaaacaaaatagaaaaaaggaaaacgagaactaaacttcataatgtttaacgagaactaaactattgtatatactacaccaaaaaatttagttcactagctatagtttaatttgcttttttcgttgcgagacgtagaatttgaaatttgaacttatatgtttacgaagtgatatatcacatattaatacatcttttcaaattttttcataaccatttaaatgacatgtaaataacaagaaaatatcccttcgaggatcaaaatccactcccataaaatagagggagtagtaaattttcaattataaaattaatttagtactcttaatatatatctcaaatagttggagctagcaaatttagttatacctcctgatgcctctcaaaggagtcaaggacgtacagtaaaaatactaaaatgacttatcaaagaatagagaagtttgagaagaatagggactgaaaacttctccattggtcattgcattaaccaagagtattgcattttcctcatatcaccaatacatccaagcagaaaacataaacagctgaagcctcaaaacatccgctcttgaggatatattccctcctttttcacacattgtctatcggcgcgtgagtgacattgtttgccagccagattaatcaattacagtgtaattgctgaaggtggcaacttgcctttttgacgacctgataataaaaaagaaaaagaaaaaaaatacagtgacaatacttaaccaaaatcactaaaaaagaaacctacttactccgtttcatattataaattaaactttctagtattgtacacattcatatatatattaataaatctagatatatatgtgcctagattcgttaacatctatatgaatataaacaatgctaaaaaattttataacaatatttaataaaatcattgaatcgaacatatgagtcgatcgatcatgtacctgggagaaagaagctcatgtaaggaagaacacaagaggcgtagcactcgtccaacaccttcgtcaccttgagtgtgctgagctcaatctgctggacaacctgggcaccatcatacgtagtgtccacgaacaccatgtcggtgccctctgcgaagcccaacagacgaggtcgcatggcgtcgccgggaatcacgaggtcgaggtcgatcaccctgagctgcacccacgccgccgccgccgacaccggcttccacgaccagagttggagggagtgacctgagaccaagcgggcgagccccatcccgccgtcctccgtcgtcatgaggagatgattctcaaagtcgtcgtcgtctatctccggcgaggcgatcaccgtcaggtccagcttgcgcaggtcgtagcgcaggatgttcctaccgtgccaggtgaggaagtagacggcgccgtcgccggcgaggacgctgggcttggggaagggttcggcgttgtggtggcgaacggtggaaggcgcgctccatgttccggtctccgacgagtacagccatgccgacgtcggcgacgtgatctcctcctcctccccctccatgacatagttggcgacgaaggccacggcgaaggggccgccatggcagccgccgtggtcgcagccggacacggcgcacagcaccgcactggcttcgatgttggtgcgcaaggcaagggtgtcagcaggcgagcgcagccgctgcacgtcgcccgacatgggatcccagacggtgagctcgtcgtcgccggagtcggagacgcaccagatgtgcggaagagggcgcggccgtggcggcagtccatgggcttccagccatcgtggtcgagatcggcagggcggaatgcggtggtcggggcgaaccgggccaagggggagccggcgtcgtagatgaagcccagccgcggaggtgctcggcggcggtggaacgcgcggtagcggcggaggaagccggcgtcggcgaggaggtggctccagtgcttgcagacggcggacgcgcgggcggcgcacgagggatcgtccagcgggagacggaggaggatctcttccacgacgtcgtccattagctccggcgccggcgccgccatgtcgcagcgaggagatccgatcagtataccgaggaacggaacctattgacaaattttggactttcaggctttcacagatctcatcttttttttaagcagttttttttatatgcaatattttctcgatccattcaggtggatcaatcggaactagagtagagataagatttatctcctcctagaacccctatacatataaggacagagtgagacatctaaagttgtcatgtactccagacgagatatataatgaagacatagctcttctctatatatattttcattgtctacttctgcaatgttcttgagggcaaaaagaagggcacgggtgttttacatcatctcacgtctctactactatagaagggatagggaacggatccggtgatccgctaatagacgcgtggtttacaacatgttatcactttaatttgactagaaaaaatacccgtgcgttgcaacggctgaagtctattttaattttattattgttatatggtttagttaagatgaaattcactgtgggagttcgcttggatatataattttttagaaaatcatcagctgcagttaggagtccgatcgtctcaagttagcatgcgagttttttttaaacatatttcttatatgattctttctatattaccaaaagtaaacgatcttagaaactgtcacaccccaatctggcatcgccgtacaacggcacctgacaggagcgtgtcgtaggaaaaacggtatgaaccgcttcctacgaaaccgcgatctcagtaccagtcccaggacatagcgctggtacccacggtgacaaatatgaatcattgcaatccttaaaataaatagaggacttatttaccttaacttaggttgcagctcagaacagcccgagaatgcaaccgacgacgcagacgaggaaacaccaacaacagcagcagcagcggaaccaacggactaacacccaacactacaggcgacggctgggaactaggacgaaaccctaatcttcacttcacttcatcttcacttaaaggcagaggaactatatatatatttatatagagtaagggtgagtactttcgtactcagcaagtcacaagaatttaggtgtttaatgcaagcttggaagagaggcaaggttgttttgcaaatcctttgtttgaaatcatttttgaaatcactaagtgatttatttctttttaactttgggtcgaaaggagactttcatctcgattcgacttaagagatgcttttcaacaactcaattgataatgtaccgacctcctgggtcagatcattacttctcggctctcggagccatttcacttgattaagcggctcccagagcctttttcattttctcggactcccagagtccagctgcccagtagcacaacaatctgcttccactcaggaagcctagtctatgatgcccgcagacatcccgaatcacacagatttgtttccgaccactcaggtcatccatctgccacataggctgattctggtaacgattcccacaccacaacaacttttcacaaagcacatgcaatcaaatctacgcaacgggaaccacctcacatccgcccatgaccgtgggcacagctgttcgaacagttagttaacctctgcagagggatacactttacccacaagacacgaacttactccagacactggacgatgtcagaggttcgcgacaaagcctttcccaagccgacccagggatacctcatgccacatagaaggatcaaatcctcacataaacataggccattttaggcgttcacaaatcaaactccaaccacctcgatcggtaattcaacaagcttctcgttcttacattaccaggaacccggtttggctccaaccgaccccgccccggcgttcccaactattggcatgcgaggtttccctgaatcaactagttatttagccagggtgtcccattccaccttgtggttgcactttgattatgttcgatgagtttcccacaggaatcggtccttatatacgaatacgggacagtgccacatagccacaacccccgcatcgcgagttttcacaattcattttattttcaaacacaccgacaccacatgtcgggttttgaaggcttcacaaacccatttcccaagttttcaacaaacaacggtgtatgtgggatatttggtatacgcgctcagagagcacgaataccgaggtaccacaagggtggagcaacaaggaatcagggtagtacgacctacggaaattagtgcgactactgggtaggtccgtcggtttggcacgcaaacagaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaaccacgatcgacgaaaaatccggtaaccgcaactatacgcaaacaatcgaaaacctaaacaaaagaccaaaataaaggtcctatttagactaaataatagtgccattaaatagatctcaactttacggaaatactggaagctgaacggagtcaatcggacttacggatcgagatatatgaatttcggaagctcgaatgggattttccggacaaggaaatgatttatcggaattttctagattacgagaaatggtttatggaatttatagaaataatattctcaagaatattattgatggtcattgatatgagggaccaaaggaaatgattcatggaataaagaattgatttatggaacgagggaaaaggatttaataatccctttggaaacgaaaaggaaggagggatgtcaatcagacttcctcgggcggcattggtgtggcccaaggggatttgcatgcgcggccgagctgattgggccggacgcgggcgctaggaggcggcccaatggggctcgggtggggagagagaggcggttcggtggaccggatccaccgcgtggggtccagggacggggcccacatggcggcggcctggtccacgaggaataggtgcacgcgagagccgcggggtgggtcgggggaccgggagaccttgaccggtctctgcggggccgggcaggtagacgtggcgtccacgtggacagccacgttggcacgggcgagggaggaggccgggcggccgatccgacggctggcggcgggcggcggcgaacctggaggggcggcgtgcactggaagcaagcggaggtcaaggggaactagttcaacggtgcggatcatggagaggaggcgcgacggcgggatgggtggcacggcgcgggcgcggccggcgaggcgggcggccgcggcggcgcgctgggaaggttcgagggggttcggggatggtggcggcgccgggaatcaaggagaggagggaggctgacggcggaacgcaactgcgcacggcggcggcgaaaaaggcgggtggcgagggagcgagaggaaggggagacggccatggcagcgcggcgcgtaagcgagtgggaaggccggcggcggaaacagagcaacggcgacgacccagctccgtaatctcccgtgtaaatgagcatgcctagagaatttatgccgtttataggggagaaggggagcggagctcaccgggaaggaaggaacgcgccggcggcagggatgtcctcggcgggttcgacgctgaggcggggcggatggcgttgtccgctcgtggcaggacggtcgccgcgacgggagcggcacggcgccaagacggcgcggccggggaagaagagaggggcgcgaggatggggcggtcggcaccacggagtgtctcggcttctcgcgcttgtcggcagaaggagcggcgacagcggcgagcagccaggcggcaacgatggcgcggcagcggtggagagtgaagcaggagggattgagagggggctcggctttatagtggaggcgatgtcggtttgggaggcgtgggcgagttggttggtgctcggctggtgatcacgggcgacgcgagaacggcggacgacgaggatgcgttgggcggcgaaggcggtggatcggacggcgaaaatcgaatcccgggagcgggaggagctgcgcggcatggtcaaagtagaaaaggagggggaaaagggagctctgctccttgccgatttgggcgtgcaaaagggaggagagagggcgcgtgagagaggcgctctgcctctcggttttggaagcacgcggcgtggtgcgacagcggtagcaggactgtgggggtcggcggcagcgcagcgcatgcgtggcagggctgacggcagcggcgttcgggcgacgaccaccacaagggcatgcgcacgtgggaaacggcggaggcggcgaaaattgaatggcggcggtgggagggttcaaaccgcggcggcaggaatcggcaaggcggcggtggtcgacaggtgagagagagaggaagagagatgacgctctctcgggcggcgcacatgcacagcacgtgcaaggaggagggaggagataggcagaggggagatgggctagggggaacatgatcggcccactaaacttgagggaggcaaatagactttttcagagggattgaatggttgaggttagggtttggattcgaattcaaaatttgatattcgaactcgagggtttagggaggaatcaagggagactcgaggagaagtcaaggaagagattcaaaatgagattttgatatttttgggaacggggacatgtatttggcgaggatttcaagataggatttgaatttcggaatttcatttggagacttgaatcggaattggaatcttgaggtgggcgattttgatggcgacgagagggaacaacgatggagattgaattgagatctatggcacgacttaaactcacactcaaagaacgaaattttcgcaattaggattttgccgaattagtttttaatgtctgacgaaaagcggagcgttacagaaaccgactcaaatacaaatatgtatttccaaaagcaaaaaaaatttaaaaaccaactcatacacggatgacgtaccaaaataccagcaaaaacatcttcaatttttataatagttctctatatagattaaaaccaaaacataaaattaaaaccgactaaacagggatgacgaaccgcggaaaaatcttcaatttttataaccgacttaaacacggatgacggaccgcgaaaacatcttcaatttttataagggaaaagtacaccgaaggtccctcaacttgtcatcgagttacgaaatcgtccccaaaccgcaaaactgggtatataacatccctcaacttacgaaaccgttcactttaggtctttcagcggttttgatcccggttttgtctgacgtggcggctgagtcagcgtgggacccacgtgggctccacatgtcaggctgccacgtcacacacccctctctctctctttctcctcctctcccttccccctttctctctcacttttcacctcaatgggcatccggccggcgggtggagagatggtcatcggggcaaggctggagaggatgtccggtagccggcgatgcgggagaaggggagggtggcggcggcgggagcacagggggagcatggcggcggcggcggcctccggtctccccgtcttcaacaccgagtgccgccgccgttcttctcccctgccggccaccggccacgccgtgaaccaccaaggtcggggacgcggcggccaagcgtggaggagcgaagggtcgaagcgaagcccgtcgatgcagcggcgaagaggaacccattgaggagtgctaggaccacgtcggtgctgacgtgcacttggtctcagtgaagaaaacggggaagccgtcatccccgtagccaggccgcctccacggcgcccgctccacctccacaaccatcgctgcgacgcccgcctccatgccaaccgccgcggcgcccgcctccgcatccaccgccgcgacgcacgcctccgtgccaaccgccacggtgcccgcgtctgcactcaccgccgcagcgcccggccccgcctttgcctctgcgcccaccaccgcaatgcccaccgtggcacccgtcgacgcccaccgctacgtcgcccggccccgcctccgccgactcgtcgccccccgcagcggcgcccgtcgacgcccaccgccgcgtcgcccatccctgcctccgccgcctcgtcgcccgccgccgaacctcctctcccaccttgccccgacgaccctctccccacccgccggctggctttccgttgaggagaaaattgagagagagtggaggaggaagaggaagggagaggagaggggaaagagagagagggggtgtgacgtcgcagcctgacatgtggagcccacgtgggtcccacgctgactctgccgccacattagacaaaaccgggatcaaaaccgccgaaggacctaaagtgaacggttttgtaagttgagggatgtcatatacccagttttgcggtttggggacgatttcgtaactcgatgacaagttgagggaccgtacttttccctttttataatagtagagatagagatagagatagagaagagaagagaagagaagagagagatttgctagctcttccaggcaggcggcccttggctgggccgagtgagagagaggggaaagggctgggctgttgaggttgaggcccaagcggagggggaaggaaggggagaaaggattgggctggggagaagtgacggaggtagtggaccggtgagggaagtaaagggaagaaggagatgggttggagtgtgacccaattgcagtgttccttcatattttccacagggaattgtttggtgaatgtttgaatatttgttgagaggagatttgcacgcaaattggatatttgagttccaataattccaggatctcagaggagagaatttcagctgtatttttgtggtatatagaataggatgataccccataaataccatcagataagatgagttcacgccggcaatcctctgatctgtttgtgtacaaacaacattgacagcgatcgaatcgtaataggccttgcaagtttagcaacgctgatacggtatcactggcagatttcaaacggggaaatactatgatcagatacaattgagttggatggtagtccaccatgaactcactcaacaatcaagtcaaccatcaatttaagacacggtttgagctctgaaaaggtaaaaggttcatgcaatccctattggcagttcttctgagaaaatggacatgcagcagtacatattaagcaagacaggattttggcaccgaatagattccattaagttactacctagggtaaaatgcattactttgatacagaatcatcgccctcttgtgctggggtatgaacatctgagttgttgctgctatcaccttttactgagagcgaatcagctgcagctctcttgggaggaggttcagcagagattggcttgatattagcacgtttgatacctctaccaacaaccccaagatcggttacagtgcttccagtacttccggttgtagctgccgtagacagagttgacgaatcaaagccgttgcttgatccagccatctgtgaagaagaattgaaagaagcagccgctggcattgtgtcagtagcattctgttcaccacctgcctttgaggcaatcctcttcataatctcatccataacagagcttggggtagacattgcttgttccaagtcttccagctgaattcaaacaattcatacatattcaagaacaaaatgaagttggcaatgtgaaaggcgtatttgtatgaagaaaataataaagcttattttcacaaatgaacgtatttagcattcatatatgaaagaagaaaataagatggcaatgtcaaaggagtattcatatagacaaaatcaagtttattttaccttcttctcaagttcactcaaaatgccactgagctgctctatctcaccctcaggagcggacttttctgagcctccatcagcagctgatgcgttatcatctttaccagccaacaaagcatctttgtcattttttaggctttgtatgcgtgacttgcataatgaaatagccttagcgcaatatggaattgcatctgaaatcttcgacaccaactcatagaccaaacatatgcggaagtttctaggactgaattaaggcaagcaaaggaataaaaactgaaaataaaagatactagtgtcacctttcctatgaactggataccacagttcatgtccacatttagacaaacacgtacatgtaagaaaatgaaggtaaccatgcagatttgggtggaactcccattgaaaatatacatgtataacaatatttaaaacacaccttcagctgcctaactctttaagtcgagaaggatgcaggttgcaggcactacagcattgggttgcaaatgttgttttatacttgctatatggcagaaggatgcaggttgcaggcagataatttggtagtattatgtttaccaaacaagaaggatacagatcaataattcgacgatgatcaggctcaaacaatttctccaatatggctaaagctttaaagtagtcaccgagtgagttatcaatgtcctctgaaaatgaaatatggggcattagcaccaaaaccatttaccatcaaaactagagagtaactaagatagtggagacagacctctttccatggagacttcagctagagcagaaaagatttttgctttctccaaagtgtcatctgggctcttctcaactatagcccttgcaatatccaacattttccaggcctgatccaaatcagaatcatcttcatctcccaccatctcatcatcatccttgtcactgtcaccgttttcctcctcttgaccttttccagttgagttttgccctaaccaaaactatatcagtacttaccacagaaaccaggaagaaaagcacatggagtgtggccatcatttattatagtacaatagcaacctgctacagggagcagttagatgcatatagatgcacaaatgatcccacccaaccaaatagtgaccaataagtttgttcaattaaaattaaactagtaaggtttcttatagaaatgcaagaccaattatttaatcttgagcaaagtaagaagaactatttacattattgcacgctactataattactcaaataaaggaaactcgtaaatttgcaaaagcatcctgtgcaagtgcttaatctgtttaagctgccatttctattccaagtgcacaagtaagaaaggaatacagataaataaacctaggtgtattcaaaatatggcctggccatataatggttttttacaaaccgcaaaacattttttctgcctctggaatcacgcattatcaatagcacaaaatataattgccctttcagaccaaccaatatatccactgtgaccaaatggcctcctatggaatgataatgataatttgactaatggaggaaataagtctgaacactttccaaaaaataccattactttataacaagaacatattaatgatattgtttttatgcatagtatataagaacagggtaagacaaaaggccataagtgtacaataacaactacataggtacatggtacaataatggtataccttcttcagcatcagctttatccgtggatggagcatcctcagtattgctaccgggggtctttgagcttccactatcatccttgttagtagtactcttcatggactccttattagatgaactcttgggaacattacccaaaggatcagcctcatcctgagctttgtatagcaaggcacatccatacttaaaatatgtgctaacacattccggagcaagttctccatgatgtgcaaccctgatgacaacaaaaggcataaatttgttagggcgcaagcactgaagttatagtacaagttcattgagacataatgtaaactgagatggatcagtagttcgagattggtagctgctctgtctatttaccaagcacaaccacaaactaatataacttgacctcagtgaaatatttccaactagtcagtagtggagcagcatacatacatatttctgagatatcaagaattgagtaatcgcactttgctgctatggtagtcgcaattcacacacaataacaagagataaaacaaactcctagctagtgctatcaattaacacgaggctaagaggagaattgactgattcctcaacacgatagcccaatccattgcgccacgttgataaacaagagaaatccaatcgccaatcatggcctccagcttgctgtagaacctcataaaccctacccgactcacctccccaattacacaagacaaaataacaaacagcttgctgtagaacctcataaaccctacccgactcacctccccaattacacaaggcaaaataacaaactccacatgacagcaacaacacaatcaaatccacagcatcactgaaccaaatattacgttattcccccacatcgaaccagccaggtcgggaaatggaaccgtagaagcggagggggtgtagcggagaaagcccctcacctgatctcgagggcgcggctgaggcagtcgacggcgtcgacgaagtccccctcctcgatggccttggaccccctctcgaacagctcctccgcccgctctagggttttcacctcctcctccccctccccctccgcctccatctcctcgcccgccccggcctcctcgctagggttcggcggtgacggcggcgggtcgcgctgctcgtctcgcggcgcctccacgttctccgacgaggaggccatgggctgcggcggcggcggcggcggcggcggaagcagcgagtggggagagagagagagagagagagagagagagagagagagagagagaggaaggaaatggggaaattttggggtcggaagcgcgaattctcggggatatgtaggagttgccgccaacgggttccgcgtattgggactgggcctacttgggcctacatggctgcaatagtgggcctagttgggctttccaacttaggcccaaatcttgttcatgccattttagtcctcgtttcgtttgttttttttttattatttttagagaagggttttttttagggcctctacatccaattgaatttgaactcaaaccttataatgctactcaagtcactacaaccactatactacatgcgctttcgcatgtttcatttggaatggattccaaggacaaaatttgtgagaattttatgcaaatttgatcgatttctacgctaatatttcatatagaaacttttttttaaaaaaaaacaccgtttagcagtttgaaaagcgtgcgcgtggaaaacgagggagaggggttgggaagaggctcaaacgaacacagccttattcagtttggcaatgttctggaatatggagggatgcccaaatttcgccaaaatactgtatctttggttcatctcaaattttcagatgtctttttttttctgttgatgtttgctttgtttttgaataaaatttggtggattcaaataggctgctaaatcagatgtgaaagttgctcatggtttaggactggaaaaaaaacaaaattaaagatgtcaacgcaaaaaacgtgttgccaacttgcttgcaacgagagccaacacgggagtagaactgagacatgtatctcaaagtaatagcaaaatcaaatcaaattaactcaaattcctatatctataagagatctcgaataatctcatccatgatccatatatacatctcgttcgctgcagcgattatacatatcaaaagtataaaacatgaactaaaaagaaatactccaatttggaatataatcagtggccgaagcagtcgacgaggatggacagggcggtctctgcgcccaagccgccgccgccaccaccagccgccgagctcgccggcggcggcatggcaccatcgccgccgccgccgcagtcgagccctttgtctgacaccgatccatcgcttggcggcgacggcgacggcgccgatctgatggcctcgaggatctttctgcagctccgtatcctcccggccagctccgacgaccaagcatccatcagtctcgatgcaagctgaggagatcgaattttgagctgaattagcaacaaaagatggaacttttgagccggattcgagcttcttctcgggctctccctttctttttcagtacaggagggggacaaagaggaagatatgaaagcgtggtcggcaccggcaaagcaggaggagacatcagacgggtggatttatacaatgagaggagaggagaattgaagtcagagaaggcgaatcaggggacatgcctctggttttggagtagtttagcccactgaatgtctctgaattggaaatctggaagtcttgcacgactttttgatttttgatgacacctacgtggacgatttccaagccaaatattctactctctacttgagttgactgttcatcggtttgcagaaatggaaccaatgctttcgattgcattgttcttgtcgtcgctgcaatgttttcagtacttcattcagtatatagtgcagaagagaatgtgctgctaatctcatcctttctttgatcttaatcagtctatatgtatctagcagtgcaaattgattgattatctctttccctattacttcctgatggctagatgtacaggttcaggttgtcggcgagctgaaacctacaagaatagataggtttctcttctgatgttcacaaggaatcaagaacagtggcgtcgatcacaatcttcgccgtgcagaggacagaggttcctatggcttgccgtgcccgacctgtcggagttcgtcaatttcatgggattcggtcagattcatcgggtaaattgcatgcgaatttgctccctgatcgattggttgcattcgttcgtcttcaggaaaagaaaagaaaagaaaaaacaatcccctcttatggaatcaccgaactcgccacgctctgctctctatttgtttggctgtcggaatatttatctccgaccctcctagtagaattctttttaaaaaaaaaacaattataggtgctcttatgcagaagtgagctgcgcgaaaaaaaaataaaatgaggcactcttcttctgctgcaggtcgccctgggtgatgatgggtcgatcacaatcttgctgccgtgcagctgttccaaaaaaaaaaaagagatttggatggagagacgttgcttcaaacatttttcaagaagaaatagtgagtgtgttgggaattgagccgcttgtcgttgcatctcccgtgcagctgttccaattgcgccaccggagtcggcaagatggtttcgaccacgctaattgggttttggtcgattgcatgcaggattgctctctaatcgattagttacattcggttctctgcagggagagagaaaaatgaagcgataaatcatcgttccactcaaaaaaaaaaggtgagggttagaggagtcggagttttaatctccgaaccccttggttcggttttttctttttttaagaaaatacacgacccattcgtcggcacgtttcctcgccgatcatccatggcggagccgccgacgtggtcgctgccgcagaataatctgggatcgataagctgcgccggcgagatcgcctgggcatgacgtttccttcctcgatctgcatggagcacgagaaaaagaacggcaaccttccttctcctgcacaagcaacattactggaaagtgctagttataatttgtttcattttccagggaatcatcatgatgggagagggactaatcaagtcttttattatcttaatgaactcttgatcaagtcgtacctcggtttagaattttttttttcttctagaagggccgtgaaatatcagtgatagaagaaactagctagaccagtaaaacgttggacttgttttcagaattttcatgccattgactgtgcatggaaatctgaaatgccgggcaacaggttgagtacgaaatagtaacagccaacaggttgagactagagacataaactatatatcaatatcatcatcacactttcaatgatggcaaaagattagacaagaaaaattcagataaaaagaacgattacccatccagtgaacggatttcttgcgtaatatttcaacaccatgttattaccagcttgcttatatgctgagctgaacagactgtgcttcactttcatgaaaccctattgtacataccaagttattgctggcttagaaattaagactgaacaaggctcatttctcatcatgaagaacttcctatccattccccttgttaccctcatcgatctctcttacatgatctagaattctagaatggtgttggcgctaactgcacttccttctctttctgaatccagtctacaattgagcgctgcatctggacaggcgcacgctcaacccacaacttgaggaactcagagatcacatctgcccggctctccagatcaagttcctgtcgtctcgacacagttgcttccctagcagtgctcaatgtgctcggcatattcattctcgtcttccccaaatgaaagaatgcagcttcatgttttgacttccagagaagctggtgtgctgttgcttcagaattctgattgatgctacctattgcctttggcagcatgaccttgtctagctgttccagggtaatgtttctgtgataccaaggctgctcctcgccattgatcacctctactgcagaactctcagctgcaggcagaaggtcatttgaagagctatgaggcaaaaaaagaaccccaagtttcagatgtgaaggccttcttggataacatctttttcctcgtacagctgctctctgtttattgttttttccttgtatagctgccctctgactgttgcatctaaattgtgtgatttgacgctccaaatacacttcaatgattggttgaagagaaacatctagcagttctgccttgtccatgctgccactcccacacatgctctgatcttgatgtttgcagcatattgggtttgggcggaaccacttagtagctataccatgaatgttgtcccaatggtatgaacgataatgtgacacccaggagaagtcttgtgtagggagctgagcaagttccttcctaacagtttcagttgtagacttgaaatgaggggtaaaccattgcaagcacttaattatagtgccaattatgtttgtactctctgaaatttgtagcatcataccgaggaaaaagttattctcaggtgcactgcaatcgttgtaaacaaagatcaacttagcttctactcctcgatctgcaatgtcattgggccgtatccaaaacaaatgctgcttgtttccctgcacaaatttgtactcaagtgtttcaccagcaagaaggtgcccgataagagggtcaaagaacaagtaacggcgaggtgtccctccaaactccagagatttcagaaagtcatcagctcccttagcaaaccactcaaatctttgaacagttgatctacttggctcgtcgatattgccgtgaaagatggatgatatcagtgatttggtggcacaggcaattcgcctaggaaaggaggaattccttacttgctgttccttctcctcttcttcctggacatgctgcctgcacttgcgtagtgtgtcatcacactcttcagtagcacgcttcagcttcttctgccaacgcagcaacggctcactcgtgatctgccacttactggatgtctcaagtgcaagctccaacttgatttgtgccatctccagcctctccatcagctcgtctgcacttaatttttgctcataattgtcaatcatgccagatatgattttgttcactgtctcggtaacaatggcagaactgactatctctcccatcttcagtgatcaatccgcaagagctgcctccctgatcagcacagagcaaagatgtatcagtacattgatcatgatgcctaataaaatcaagagatagatcagtgaattcctgataagtactaacgaagtgcattgttgaagcatatgcaaagcccaacctttctgagttgaactagtaggaagtaatggagctacacaggtgcaccagagagtacccggcagaagataactggattgcatgaattgcacgaaagtataagacttcaggcaggaaaaatagcaaattacagttgggttcttctggaagttaggctggtctaatatggcacctgttgagaaaactattatcggtgactttcaagttgatttgtcacacacagacaattttaaaatcaaaatctgctctcactgactgtcccaatcttgcggactagctactgaagaaaattctcctctcgtcactgtaatcatttttcttattagaaactccagcttcttgtcttgactcttgactgaatggaatctgggaatctgtaaaactatattatcggcgacttaatttgttgggtctgagaaaattattatcggcgactacgaattatagctgggaatctcgggttatgttgcttgtgtagtgcgagtgcctctcccctgaatagaacagcagtaactaaaatcaagctggtcgcgagaggcgaggaaaccgagccgtaccttgatctagcgcgccgtggccgccgcgaggaagcggcggccttcttccctctccgcatcgccgggtcgccgcacaagcacgcgtgtatggtggcggctcacagtggaagcaacagcggcatcggatcgaggaaggaaacgccattatggcaccgccttgcgccgccgatccacgagtgggcgcggcctcgctgcggacccttcggcggcagagcaatccccatctggcggcggagaggccccgtccggccatggcgtcagtggcgtgcacggtggtggttgccatggtggtcagcgactcagcgtggagacgaaggtgtcgatgcggcccatatgtgacagtgaaaactcggacaagcccacagaggcccaagtaaaggcccatgggctgcttaggctgcacagcggccttcgactgcgttcttttggagggcccaagtattaacgcatggttaattagtattagctaaaaaattgaaaacatgattaatatgattttttacaacaacttttctatagaattatttttgaaaaaaataccgtttagtaatttgtgaagcgtgcgcgcagaaaatgagtcatgagaggcagaggttgggaacattgagcgaagaaaacaaccttggcctactgcagaagttggggcagaagcaacactggagtgctagttctatgttaggttgtttaattcggttcatttaccagtagatgatcatgatgggactaaccaaggtttcggtatcttaaaatcttgatcaaatgaaagcaacctagaccacgtaaaactttgtctatttgaagaatttttcatgaaatgagccaatgactgtctgatcacctgatataccatggaaatctgaaatagaagtccacagggtgagacatgaaaaattcagataaaattcaatcttggttgcagcatatacgtgcaaatttcacataaaaaaatattgattacacatccacttttttttacacaaaaggtagagagactctaccttgtaaccattgtattaatggtggtcaaaccagatgagatctggtaaagccaaataagagaacaacaggagcattacagggggagaagaaggataaaaaggagaaagaagaaaaaaggaaaacaggagaaaatacaagatgtaaagcaggaagagaaaatacaaaaaatacaaaaataatacaaaaatacaaaagtggagaaaagagggtggttaatcaaatttgaccacccaagcagtaatgtgtgctcgaaggcaaggcttgaggcggtgctcccataattgcagattttccttgatcagattcaacgttgcggaggtgctttgctgagaagaattgaaggtactgtggttgcgggccttccaaaggttatgcgaacaagcagcaaagcaggccggagggagtagaatatttcctatccattactttcatttccccttgttaccatgatcaatctctattccataatcttggtggcaactgtatttcccttcaaggccttgtttgaatgagcttatagcaacactagcaaatctccagctcgcctaaacagcttatattcttcctccaggttaagaaattaagtagccaccaaatctagattttatgaacctagtaaccagaagctaggtttcaccaacttcctccagattcccaacagctacatgctcatcagcaactttttagaatctccagcttccccaagtagggcctgaatccagtccacagctgcgaactgcatcatgacaggagcacgatcaacccacagcttgagaaactcagagatcacatctgctcggctctccagttcaaggtgatcatgttgttgcaacaacgttgatttcctagcagtactcaatatgcttgacatattcattcttgtgttccacacatgaaagaatgcagcttcatgctttgacttccacagcaactgatgcgctgtcacttctgcattctgattgaagctatctattgcttttggtagcattatcctgttaagcttttccagtgtaacatttttgtgacagtaaagctgctcctcaccattgatcacctctactgcaaaactctcagtggcaggcagaaggtcggttgaagaaacatgaggcaaaaggaatactccaagtttcagatatgatggtcttctgggagaacatatttttccttgtacatctgccctctgtttgttgcaactatattggaagatttggctctccaaatacacttcaatgactggttctagagaaacatcacaaaattctatcttgtccatgtagccactactacataccttatgaccatgcttgcaacacagtgggtttgggcggaaccactcagtagctactctgtgaatgctgtcccaatgaactgaacgagaacgtggcacccaggagaagtcttgtgtaggtagctgagtaagttctttcctaacagcttcagttgtagaagaactgaaataagggctaaacaactgcaagcacctaattgtagtgccaactatgtttgtactctctgaaagctgcagcatcataccaagaaaaaagttatcctcaggtgcactgcaatcattgtaaataaatatcaacttagcttctactcttcgctctgaaatgttgttgggccgtatccaaaacaaatgctgcttgtttccctgcaccgatttgtactctagagtttcacctgcaagaaggtgcccaataagggggtcgaagaatgagtaacgatgtggtgtccctccaaactccacagacctcagaaagtcattagctccttctgcaaaccactcgaatcttcgaacagaagatacagttggctcgtcgatattgccgtgaaagatggatgatatcattgacttggtggcatgggcaattcgcttaggaaaggatgaattccttacttgctgttccacctcctcttcttcctcgacacgctgcctacacttgcgtaatgtgtcatcacactcttcagcagcacgctttagcttcttctgccaccgtaataacggcccactagtgatctgccacttattggatgtctcaagagcaatctccaacttgatttgcgccatctccagcctctccatctgctcctccgcacttgattttcgctcatacttgtcaaccaacccagatatgattttgttcactgtctcatgaacgaccgcataactgactatctctcccatcttcagctgcgagattagcctccctgatctgcatagagcaagatatatcgaaacatcaaccatgatgcccattaaaatcaaaagatagatgagagaatttctgataagaactagcaaagcgcaatatcgcatcgttgaaatatgtaaagcacaaccttcagagaatctgagttgaattagtcgcaagtaaatcgaagccacgcaggtgcgaccagagagtacccagcagataataactagattgaatgaatggtgagcatcaaagttgatgactttggggagaaaatacgagcaaagcaaagctgggctctcatggaagttaggcgggtcttgttgaatgtatggtctaataccacacctgttgaaagttgagagcacactgctctcattgactgttcaatcttgcagcgtggctagttattgaagaaaaactgtcctcgtcactgcgatccttttcctaaaagaaagctctcattgactgtccaatcttgcagcgtggctagttattgaagaaaaattgtccccgtcaggccgtcactgcgatccttttcctaaaaaaaaaaatcctagtgaaatcagttccggcttacttgtgttgactggtagggatctgggaattcgataactatattatcggcgacttgaagtcgtcttttggtctgaaaaaatcattattggcgactacgaattatctgcgacacgttgcttgtgcagtggactaacctatcccctaaacagaacagcaacaaattaagctggacgaaacagatcgcgggatgcgatgaaacctagccgtacctcgatctcaacgcgcctcgccgtggccgccgcgaggaagaagctggcctcctcctctccgcatcgccgggctctcgccgcacgagcacgcacaaatggccgcccccacagtggcaggctggcagcagcagcagcggatcgaggaaggcaacgccattcccccggaccaccttgcgccggcatggcctcgcctggatcgttcgtccgcggcggcggcggaggcctgctcgcgcggtggacggcggtggttgccgtggtggtcggagtggagagtggagagacgaagggctttggtgcggcccaagtgatagtgaattagtgatagctcggcccagtccactgaagcccaaatttaagcccactaactcatgggcttcttgagccgccctaggatgtactttcactaccagttgggccgaatgcacaacccattcgtctacaccatatgtctccttccttcggatgtgtctcaggagaggaaaatatacaccaaatgatacaagtcattagcgattgattaattgagtattaattatttaaaaatattaatatgattttttaaacaacttttatatagatttttttttaaaaaatacaccattaagcaatttggaaaacatgaaaaaaaaaacaaagtttttcttcccctttcttctcggaactaacacagccttcctcgatcctacagaagcagcattacgagatgctagttctatgttaggctgtttgattcggttcatttgccagcagatgatcatgatgggaataatcaagtctccagtatcttaaactctttgatcaaatggagactagctggaccatgtaaaacctttgtcgtgcttgaagaattctcatgaaattgctgtctgatcatcacctaacaaatagcataataaaaagacaagttgcttggagatctgaaatactaaaaggaaacagggtgaggcatgcaaaattcagacaaaatgaccgattacacatcaaagcttcaacaccatgttgagctcatatttacataccagagcaattttatggttcttgagtaggtactatgaggtaccattttttctattataaatttggtacctcttggtatctaggtactatgatgtaccaaattttacactaaaattttggtacctcatggtacctccttaaggaccgtagaattgctcttttcagaatctccaccaagtagggcctccctcctctcttggcataagtcggtctggcttaatgcgttgtgtatcgaatattcttatcttctaatatattaacgtgcaatccttttgcgcgttcgagaaaaagccaaatagggcctgaatccagtccaccactgagaattgcatcaggataggactaccctgaacccacaactctagaaattcagagatcacagctgcttggctctccagctcaaggtcatgtcgttgcaaaaacgttactcattcagggcttgaggccaccgtcgtctacctttacacccgccattgagtcggcctgcaccttgccatctccgtgcccatcttctccacgcacaggtaggcgacgccatggccggatctccagaacacctcatgcgccgcagcctcgtggcacaggcgatcgacggcgttcggcagcagctcctccatctcacgccatccaacgttagtgcgcaccgcttgctcctccctcccgtcgatcgccacgacggcgacgctcttggctccggacggcagctcctccggcgaggcgtgcggcgcgaagacggccgtcacctgcagcagagtcggccccgagcaacccatgttggcatgaccacatgaacatgaatatgatgaagaagacgatgttctcttgtgtcgtgtagcagagacatggcgttgcacgaccaatttgatcaccggctccgggaatgcacctaacggctcaaccatgtcactgcttctgcggcgaccatggtgctcgtgttcttcttcgcagcatgccgggtttgggcgagcacggtgagtttcggattggtggattctcgagtactctggatcagtagaagcaacaaacgggaagcagtagaagcctcgctggtggaactgagcgagctcttgcctcacagcttcagtaacaggcttgaaattggaggtaagcttctccgagcacctggccataatcccgaccacattcgtgcttgctgtcacccgtatcaaaattccgaggaggaagttttcctctggcctctcatggttcttgtactgaagaaacacacaggctactactcctcgctctgcaaatcgtagtggccgtgccgctaggtagtacccacttattccaggaggattttcaaactgcagagctttgccggcaagaaggggacctgtgagaggatcaacgagcatgtagttgatgctgcctatgctgccgaactgcaagaatctcaggaactcaccggcgccatcagcaaacctttcaaacctctgaatggtcgaggttgtgattaggctatcaacattcttgtcgccggagaaagaggagaagaatgatcttgtctcatgggcgatccgtctggggaaagagcatcgcctgatctgctgctccatctcatcgtcttccatggcgcgacgcttgcatctgttcatgacttggctgcactcttcggaggcgcacttcagcttcttcctccaacgcagcagcgaggcatctgtgaccggcggccactttccggacatctccagagcggcctccattctgatgtgtgccatctccagcctctccaggccatcttcctcacttagtttccgtttatgcttgtcgacgaagaaggtggagaccctgctcacagcctcgccaactaccgcagaagcaactacttcagacatcatgatgttctgttgattaccccagcctggttataaaaggggatggaaaggtcaggttacaacttataattgttcactacagaaccagagatacggaagtttataagaacttagcaattagcacaaaatgtactcacctcaataagctgcttgaaactagtgctttggtcatactgcaatattgtgacttgtcaagagcataaatctgtttggtgaatatgggggttcagttttcttcacaatgtcaattggacagtgaaaggtccttaagtaacatttgtaccagaacacacgttgtgacatagacatttgataattaattaatgtgatcgtgaaagcgatgacaagtcttcccttcatactgcctgtatttctccaaatactctatcactgaatcaacttttgagtaatacatatgttcaggccaagaaaattgcttgctgtagttgtttaaaaaaaaaggattagtcttcctctgtggaaggatccatcaaatatataaaatgaaataactaagcaaaagaaaagtctaagattgaacgatatattctggtgacaaactgattagtctcaatagcagactagtcagtcaatagcagactagtcagtcagaagaaataaggtgcaccgcagctaaccgtaaagctttgcaaatggactggaaattattctgaacaactgtaatggaatatctgtctagttgatgaatagtcttgtgttggcttggcatgtccaccactcaccccatccacgggctcaccaagtcaccaatcagtttgttcaccttgctgctctttttttgcatcttcctttgcatctgcgtttcagcacatgacaaagttagaataaatattcatgtgttttctagtttcattttgaaattatccaaaatattataattttaaaccacccagaggttatcgctgtcaaactgggaatttccagtaaataagccatactggatgaaaataacaaaataaaaagaaagtgcatgggaatatgagaaagcaggcaattgagtgagaaatgataattttcttatagcccacaatcatgatagactcatgtaaattcaaatgaaaccagacacatcgaatgagcaaggctggtacattagacttctagggcaagaacatcatgttatcaccatttgccaacataactgacgagacaaacaacagcagtatatgtagaacatttcagatgaatacactcctaagtacttagaaaccaactccctacatgttacttttctcccccattcttttaattttaattatccctgtttcccttctagtccctattacatcatctaaaatgtcagtagaggacctgctactttcttctccttccgaatccagtcaaggagtgagccctgaagccggacaggtgcatgcacagcccaaaggctgaggaagtcagcgacctcatgtctgtgattgtgtgtccggcgatcatgtcgtcgcaacatctttgctttcctggctcctcgaatggttctccgtgtgctccgcatgttcattgttgccttcacagcctgaagaaatgcaccaccatgtttagacttccaaagcatctgatacgctgttgcttttgcattctgacgaaaacaatctacagcccttggcagcatgaacatttgtgtgcaagcaatgttgctcgttaccattaatcacctcaatcacagtactatcaactgctgggaataggtcttctgaagagccatggggcgtatagacaaggataacattcagatgcggaaattctttaagtgaagatttaccctcaacaattgttccctgttctctgaacccaggaggtgaaacttggcacagtaaactcacttcaatgatgggttctagagaaatatctgttaattctaccttgtgcaagttcccactaccacatactttctgaccatgatgcttgcaacacagtggatttgggcggaaccattcagtagctatactatgaatgttctcccaaccgtatgagtgagaatgtgacaccctggagaagtcttgtgtaggtagttgaataagttctttcctaacagtttcagctgtagactcaaaataaggagtaaacaactgcaagcacttaattgtagtaccaactatgtttgtactctctgaaagttgtagaataatatcaatgtaaaagttgtcctcaggtgcactgccatcattgaaagcaaagaacaacttagcttctattcctcgctctgcagagttattgggccgtacccaaaaccaatgctgcttgtttccctgtattgatttgtactctaacgtttcacctgaaataaggtgcccgataagagggtcaaagaacaagtaacggcgtggtgtgcctccaaattccacagatcttagaaaatcattagctccatctgcaaaccactcgaatctttggacagaagatctacccagctcatcactattgctgtgaaagatggaagataccagtgtcttggtggcatgggcaattcgcctaggaaaggaagaattccttacttgttgttccacctcatcttcttcctggatatgttgcctgcacttccgtagtgtgtcatcacactcttcagtagcacgcttcagcttcttctgccaacgtaacaacgggccactagtgatctgccatttattggatgtctcaagtgcgaactccaacttgatttgtgccatctccagcctctccaggtgatcccgtgcacttgattttcgctcacaccggtcaatcaacccagatatgatcctgtttaccgtctcttgaacgatagcagaaccgactatctcttccatcttcagtaatccttccctgatcaacacagagcaagatatatcaatacatcgatcaaaatatagatagagttaattgcatattggaccggctttctttaccatggtcgcagcttggactaggaacaagctattattttcactttgggctagtaatttttacaaaatgttacacttaggacctagtgttcttcttccagctctgcttcctcactctctctaccttcagattgagattcacatacctggctagttggttttagtagagatagagctcaagctccaccagtacagtcatgctcgagctctactcagccagtcagccttcgctgcccctgccacattcattcgtgctcaagatttaatgtgcagccttgattaagtgccctagctccaattaagctagtactgccatggatgaacttgggctagaatgggacctattgactagttggtggagcataagtgtggagtgataacatatggtgttagaatttcccaccgtgccaccgtgattcattggctatgtgctaattgagctcaagctggagctctgccgtgtgccgtgttgagctcaagacggagactaccacacactcaagctcaggcgctgacgtaggtcaaacacgtagatggaacctgaggaagtgtggtgagctcgaactaaaacagggaagagaagagaaaagggggagatctagaggaagaacaagactggttcaatatgaaaatttttgcaaagatttctggttcaaaccgaaaagaatgtcctacctctagtccaacatgcaacaatggtcaataaaagtggcccaggatgcaattttctcatatagataagtgaattcctgataagtacttataaagtatacctttgaagtatatgcaaacccaaccttctgagttgaattagtaggaagaaacttgagggaacacaggtgccttctgagttgaattagtaggaaggaacttgagggaacacaggtgccttctgagttgaattagtaggaaggaacttgagggaacacagatgcaccagagagtacccagctggcagctgccagcagacgataactggattgaatgaacggtgagcataaaggtccatgtccttggtggagaaaactcaagtaaatcaaagatgtggacgttaggtaagccttattctccagttgattatgccctctttgactgaccaatagtaaattttgttattaagactgaaagaccaagaacggctatagagggggggtgaatatagcaattcaaatcttgcccccgaaaatactcatcaagccggatttctcaaaatccttactagaaccgcggctattagagaagccggatctagaaaagaagatagaaggaattcccgaaactagaagaggaagagaaaaggaattcccgaaactagaagagaggtgaggaggagtgagcaaaactcatcatcgcaaagttcaaattgcaagcggaatttaaattgtggaatttaaatggacaagacaaaaacgaaatccttcaaatcatttcattcataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgaaaactctctcaccaagcatctcaaaaggattaccaaaggagcaacctccacccttgcatccatctctctatttatagcctaagacccctaagacattgtctcaaatacccctaggacgaaaccctatctcagatgcaatcctggctgttcattcttccttacatgcgaaggaaacctcttagatgcttgccacgtcgtcgatccgaagactcctcgcacccccgatccgcgtcgtgtccatccgagcctatccacatgcgccatgtgtccacgtgctccgcgcgcgctcgtgctctggccagcgagcgaagtttcccgcgcatcccgtccaaaatctgcgtaggacccacgcggtatagctcccgcgagagagcgcgcggtcaagtccgcgcctgccgcgtgtccctcacgcgcgcgcgccgtcgccgagatctcccgcgctcgcctccgagttgctgcctgccgcgtgtcacgtcttcctgccgatgccgtggtccgtcgaacgggaggacgccacgtcgcccgtacggctcccgccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49623 - DNA, 1666 bp, Oryza sativa
cgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtactgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacctagtcgtcaacgtactgctgtacacgtggaacccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaacaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctaagcatccgcgatggaccgtgcgtagtggaccagccggaagtccacagcgtgcccgtgggtgctagtgaacatcacccacccgaaaaaccacaacaggtacgcctcaagggagcgtcggaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcgg

SEQ ID NO: 49624 - DNA, 11379 bp, Oryza sativa
acggacatgatgcgctgcgggcgattgcaaatgaagcatataggtcatatatatgcaaagaaagaaatcaagaaagcatcaagcgcagactacgtaccgagatggtctttctgaagttcttggggtccttgggatcctcgaaagggtaagcgccgacgagcatgacgtagagggtgacgccgcaggaccagacgtcggcgagcttgccgtcgtactcgcggcgggagaggacctcgggggcgatgtaggcgggggtgccgacggtggatttggggcgggagtggaggagggaggactggagtagccgaagtcgcagatcttgaggcgcggggccgggctgccgtccagcagcgtattctccagcttgaggtcgcggtggcagatctgcatggcgtggcagtagctcaccccgcacaccagctgctggaagaagtagcgcgcctcgtcctcgtggaacctccccgcctcgcatatcctctcgaacagctcccctcccgccgcgtactccatcacgatcgccagatgcctccccgtcaccaccacctccttgaaccttattatgttcgggtgacgcagcgaacgatgattcacgatctcccggaacacgttctcgtcgatctgcaccaatttcatttcatgctatttctttctttcttttcatatatcattccaaaagtaatagttgcttgcttaccctgttccctctctcgatgaacttcatcgccaccagctcccgcgtctccttgttccgcatcagcttcgctaccccgaagttgcccgccccgatctcccgaactggctcgtatttctccatatcctacctcctcttcttctcctctcacttaatttcttgctttcaattctccttctccttctgcttctgcttctgcaggaggaacagtatctggaggaaagaagcagagcagagcaagaagatgaggaggagatgacagacgacgacgcagataacctgcagacagatagacgacggacaggctgaaagaataagaggaaagccagccggccggccttgtgcgaaaaggatggatgcaaccagcgcacgactcggtcggaatttccatatttctcctcatttgcatgctcattaattttcaactgatcaatcatcaccgctgttaatctcttgggagtagtactaagctatggtagatggcgaccactgctgtttgtctgtctgtctgtacctttcagttactactacctccgtcccaagttaaattaagggcaaccatgagtttccgcgtccaactttaatcgttcgtcttatttgaaatttttttataattagtatttttgttgttataaggtgataaaacatgaatagtactttactcttgactaattttttttaatttttttaaataagacgaataattaaagttggacgcggaaaactatgactatagttattttgggacggagggagtactgtgctagctagtgtacagttaatcatatactccttccttggatggactaattaattaactaccactgtgtacaacgacctcaatatatatattccggccggttaattaatgttagctgctcgatgtttgctttccaaacgcactgttgcatatgctaaagggcaaccactatatatgtctaacgctgacacgacaccacacatggatggatggataggtggatggcaaccttacctgctcatgctgtccgcctcctaccgatccagccatcagcagccacagcccacacacgaaacaacaaatatccaagcaggcaggcaccattttgcagatctaattgactactactcatcagcatcgatcactaataatatcgtacttagtagattattaacttgctttccttgtaacatatagtactatccatccatcgtcgatcgccaacgcattctttcggtgtatatttgtcaatccaaattaattaacgtgagtacatatatcaccgtcaccgatgtgctgtgctgtgatgttctgacgaggaaaccacccatgtatatatatgtacggttaaactaacaagctgcaacccggccaatgacgctcatcgatcatcaacaagcctaccaactgcgactgatctacttaattaggagtattaaatatgccatcctaaccttccaaccccaataccccatcatcaatttttatctctctaggtaccttacttagagtatgttgctgctatagaacatattttttttgttgccattgggtcactcaaattcagaccgactgttcttcctagcctagctatcaggtactgtatcagttacctagactatctgtatgagccggaatcatatcactgttcatgtggactagccctacgtactcttacacttgtactcttactagtacttggcatcagtacctgaatcagggaccatcagatttagaaaatgattactcctaattgtcgactgatctgtagtagtagtactagtccagttgggatccaatctggtagtattagtactaagtgaaaaggtactagtagctaatcaagcttatcatcagaaggggcagattaaaagtgatggattggatatctgaacttttgggttggagctgatggtgcatatacatggatgggaggatcatgcagcttctttcgtttgctttacacaagcagctagctagctcagtgctcatgtgccttgctgtccacttattactatggcctcctgtctaatcagatcagctcatgatcttggacattcatgaatccctcgtcggtcaatttcctaacttgatcaacatggagattcagtatttgttttaacctttggagcttaggctttcattgactttgatggctactccagtttgtaactactagcttgtggagattaccataccataaccataaccattacatcacaaacgactgagtcgactaagacctgcagcattggacttgttgtcaagtcaatggacatatgaatggatggatgatgcacagcgcatgcagctggttttactaggaaagtttcagttttggttgcaattaagttttcaattgatgtttgccagaaaaatggaagcagcattcagctataactgaacaaactgaattcgatcgaaagtacgtttgtactatacagtatatactagtacatggatgattgtatacgtgggatgtatagatagatgagatagatcgtgatcgatggcatggagagcaagttgttagtgcgaatctctggtcggattcgattgatcacaataatacaattaagatccagtccaagtctgcaacagtgcaaaagcatggcctaccaacaaagccatccacaccgatagattccttcgatccagtattaagctgacagcgatgcatggcccgcactgcactctaaaatataatctttcaggtaacagtgtattccatattcagtgtcctccatataatccactgctcctagcagggaaagcgaggagaagggcctccccctacctcaaggctgtgtttgtaaaatagttttgggatatgattttccacctctcacagagtaaacttcaatagtagccatccattcttctgatcccatttcatcacatccctccatttattttcatttcctaatcccacccctcctaacccatttaccaaaaacacctcaaatgttagtgttggttaaggcagctcagctcattagtattagtacggaggacctgtacagtttattgtcatttttaaccttaccaatttatcataatgtaaaatacgaatattaagaaaagacctaatatcaaataatagaaggggtgtagcttcagacctagaccggctagcccaccaccttgtagggctagctggaagaccctgagcgtttctcaaattatggcaatgtaacaaactaaatacacttcaatcattgctaccttaccaaattttagcatctttagaagcttcctctcttaaaactctccaaaaatttagcaaatatattaaaacaaaagaaagaaaaaaaaatctaaattacccctaaactattttggaagtacgaattaccccataaattcaaaaacaagatatttttcattctcaacctatcggaccgaacgaattacctcatagccgacttcggagtggttttagtcctatatcaagcacaagtgaaactacaactttgtaactttagaaaacaatagtgatatggtatgaactctaaaatatgtagtccttttttataaatttatttatgactaagtctgtagttttgtgatatgtttataacacaaaggaacaggtacacccaaggtccctcaacttgtcagtgagataaaaaaacgtcatcgaaccgcaaaaacagatatatagggtcccttaactatacaaaaccggtcacccgagattcttcggtggttttgaccccggttttggtctatgtgacggctgagtcagcatggaaccaacgtgggtcccatatgtcagaatgccacgtcagctgctcctcggttcctcctctctctctctctctctgcctgttgagcgcgagcgcgaggcttgcaggcaagcagatggttgaggacccggcgagctcggaccggtgcacgacgcggaaggggtctgggtgaccggcgagggcgcggccgacggctgcaacgcccacggcctcggcggcggagaggaggagatcggcgaccagcgccgccgccgccgcgcttcctccacgcgctggccaccaccgcctccacggggacctcgccgtgggcggcggccatcgtcgacctcgccgcccctagggccctccacgccggcgcacaaggggcttgccgcggaggacgagcggcgtggagctccagacgcgccgccagcggaaggcgagcgcggcggtgcgagtcgcgtccttgacgggaggcgggcgacgaggaggtcgtcggggagtgcgctgacgcggtcctcgccgtcgtagccctcggcggcggaaagcgtggcgccgttgtcggaggcgggatggccggggaaccaccggaggcggccttggacgtggcgctgtcgtcgtcgtcgtcctaggcgtcggggaagaaggtgggcgcggcggcggcggaggctagggggttgccgcggctagtgtggatggaaagctgaacattgcttcttcagctccaagatactgtaattcacgagcctttttattttgatggttgcttcttcagttcgaaaggtgtctctgtttttattcttgttcaagccatcggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtagctagccaatgctaatcttttgagctcgattatgatatatatcgcgtcgtcagatttgtgcagaatactaaaattggtatagagacattctgaccgggttatggtcgatgacactgtccatcatctgagagtttgcaagtctctgaactctgaacattgcccagaatctcttacagggatctttttgttggtgtcctcatacagtatacatcattggccccttgcaagcagaggacaaattctctctgcattcgtatgcattttaattctgcgaaacctgtagcttgtcctgtgtataaacaacgagaatatcatctgtttttcgttccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcatccatgtttcccaagatagaatgacgcgtacacaaacttccagcgtgtcgagggcgaggtcaacggcggcgccgcaccgcgtgtgccagcaaccccgggcgccgcaccccgggagcggcccgctcttgggcgccgccaccgacgcctgcctgctgtacagaaactgcagcacgagcacgagcaccagcaccttgtaccgcaccagccgcggcaaccccctagcctccgccgccgcgcccaccttcttccccgacgcctaggacgacgacgacgacagtgccacgacctcctcctcggcaccgccgccgcccacctctgccgcgtgccccccgcagcaccaccctccccggtggcgccgccgcgccactatgttcgttgccggccggcttgcaacaggagaaaagagtgagagagagaagaggaagggaggatgctgacggcggcgttgcctccgccggcgcgacgccggctgccggacctcctcctctcccctccccccggcggcctcttcccccacagcgctgcccgtcgccggctgagaaaagtgagagagagagagagaaagggagaagaggggaaataagagggaagagatgaggtggcgtgggtttcacgtgggtcccacgctgactcgtccgccacatagtacaaatccggcattaaaaacgccgaaggatgtcgggtgaccgattttgtatagttaagggactccgcatatctgcatatctggttttgcggtttgaggatgatttcgctgacaagttgagggaccttcggtgtacttcttcctaacacaaacatattggatcgtaacatctgttctcctcaaggcctactcacgatgacgggctgaattttctgggccacagcgtaatgaatggcccaagtaaattctagggcctagaagggatcgggaggacgccctggcccagctagcctttccgcccctcctacacatcgacaaagctatcgatcaggattcaggagaagcctgccagccatcagccgcctctgcctccggcctcctgcagtctgcagatgaacaacaagctaggctgccacagccggtgatggtgagggtgaaagaagaagatgactcaaaatgttatgttgtccaacacgctgcctgtatgtgtgttgtccaactcgcatccttagctgttagttgactggcatgtgctctcctttgtaatttagtaattttaatttcacttttttcttgtgtaagttaatgatataattcaggagtataagcattcacatccaacagagtcgagaatttggaaggttcacccatcatgcattcaggagtaccgattgattgttgtgtcctgaatttttgctagtatatgcatataagtagatactactccactacagtacagaggagaggattgacattgactagctagtccacttaaccgtctccttactactatcagaagaagctaatttaattaagtggagtaaaagcaaaatgaggggtgggctgggctcattggtcgtcgttgtcgtcggtgacgaacttgccggttccggggttgatggcggcgaagaagaagaagaggatgttgaagaggaggagcggctcgatctcgttgatggggacgccggtctcgatgttgagctgcgccagcgcgcccttcccggtgatgatctcgccgatgagggagaaggcgatccccagctgcgcgaggcgacccacgaagagctcgttcgccttggtgaacccgaacagcgggccaccctcgctgagccccagcgccgcgcggaaccccttccccggcgggatcacggcgcgctccagcccggtggcgtcgtccacgaagcgcccccggtcgcccagcgcgccgatggcgcccagcagcgtgaagaggatgaagaagaggagcagcggctcggcctcgtagatggggatgcccgtctccaggttgagctgcgccaggatgcccttgccggtgaccgcctcgccgaggagggacgccgcgaaccccagcatggccaccctccccacgaacagctcgttctccttggtgaacccgatgccgccggaggtgccgaagatgccgtcctccacgatcgacttgttcttgttcgacttgtccaccttgggggaagccttggttctgctcttgaacgccgccaccaccaccagatgcttcttcatcctctgcagctgaaccatcggcgatgaccgaggagcggtgccaaggtcagacactaccatcatcggcatcgccatgctctgctgcagagccattaagcttagatggattcaacaattagctagatggatcgatcaaagcatgcagtcgctaatagcttgcagctgcactagctagctgctaaattactacaaaatacgatatgatcgatctcttgatcttggcttgctctcttggaatgaattcgagtcccacgcccgcccggggttttaatagttgaggaaggatgaggcctcgagcaacaagggttaggaagcagccacgtcgcccacttgggatccatccatccatccactgtcctccagcatctaaatctcagtgatcaccattcatttgatttttgttaccaactcttgtactattacgtacgtacacttggccctatgctttagtacatacatactccatgtcacaacaaacaaacaaacaaacaaacaaaaggatcgatcgagcaacatgcctgcctgccaacatgtgcatagtaactactcctcgtccacaaatattggaagcaaactgacacccatcgctcttttcgcttctacaagtttcctccagaagatcgttcattcagtgattcagacacgagacaagcaatcacgaagcagcgccctgcacttgtctcatcgctcaaactcctccagagaatgtcgcccacgctacctgtatccgtgtatactcctataacaaattagtactaaaatccttctattttggaacataataatgtaataactgctcgcgactttgcaatttttcttcttaccgtcaactctatctctccctctcaaaacataaatattttttcttttttgttttgaagaaaacatataccattttgttttctatgttaagtaaacaagcgacgcgatcgagctatccgtcaagattgatcatatcaaattttctccaaggtcgatcctttagtacagcaccgtatacatacacgtatcacactgtaccgctgttgcgccgcgcatacattttcgggtcaaatttcagtttgttttgaactcaaagccttatatagaattcacaggcaatgaacaagatcggttccatggtgtagtggttagcactccagactttgaatctggcgacctgggttcgaatcccggtgggaccttttttttcactattctttttcaatattttattaagctatctcactatctctttgcttcattttcatgttcgtgtcacgttcagtatttagaatggaagtatgatgcacggaatcgaagggccaaaaaacctccaatcctccatgcatgttatgtgttaaaacgagaccaaatgcagtctctctttagtaaacgatctgatcatgaatttctccattgcacgaagggttttcttacttttcccaatgctcaaggtaaaatgctaaatggtgaaatttaactccaaagcttgttaataaaccgtgtagatcgacatccttctgtcatccccgaatagtacgggctgctggatttacataaggtcttgtgtagttcctaattttttttccgaaaaacgtcacatcgactctatgaatatatgtttgaagcattaaataatgataaaataaaaaactaattgcacagttcgtatggaaatcgcgagacgaatcttttgagcctaattagtccatgattagccataagtgctatagtaacctacatgtgctaatgacatattaattaggcttaataaattcgtctcgcggtttccagggttacaaaattagttttttcattcgtgtccgaaaaccccttccgacatccagtcaaacgtccgatataatgtgacacccaaattttctttttttgaactaaacaaggcctaaatattcgcacagtaaacacagtgcatatatataactacactactggatgtcaactttgaactgcactgtcatacaaatgttttccctgcttgttcttcaatttggcctaatgagggtatactctccaaattaacccttccccacaaattaactatgaactacatatttatggcattgtatcacaaaattatagatttaatatcaattttctcataaaactacagctttgtaactttagaaaacaatagttatatatggtctgaactctaaaatatatagttattatttataactttatgactaagtatgtagttttgtgataaatgtcctacatctatagctttgtgataattttggtgcaaaatctttagtttgattgaatacagatgaaggctgattggaacataaatttgttcatactatgaacaaatagattaaaatacaaatgaaggatagtaatttagaacacagattacattttattggaagcgtgatgcgaatacttcatggcaataatctagccgatcaagttattgccaaagattacgcgtgataaatagagatgggtacgtagtagaccagatttagacaagcctagtccatttattttatatttgtccaaggcaagtctgggcttcaatgaagatacgaattggtgctagttgttaccatgcataataagggcatatacaaagctagagtctaatatgagctctctatattaattaatatcactagagactatccttctagtagagacaataagatttctaatccattaatacactaaatatttttttattatacttttttccttttctccacccctcatgcaacaaactttccgttaataaacgctaagagttgactctgagccgttgtcatgcataacaacgatgtttctccttccttccctctctttcttccatgtcaccaaatttacctacatgacaacgaagagagcccgttattagacaccattgtacatgccctaatagcctcatagcaaatgagtcgaaggcaacgtttctcaacccaggaacattgtgcatgtcttaggaatacagaacatagagatatttttgtcctcgtgtagaaatattcgcaagtaactattgaatgtttctcgacatgagaactttgtgttgtggtggtgaaaatgatcaccaaatgctgtattggcttcatacggaatgggattaattaattgtttagctggcattccgcaacaaggtttgcaatacagtaataatgtgtgcaaaggtactactccgtcccagaaaaaacgaattcctatctacgaatctagacacacatatatccagattcgtagataggatttgtcttttttgagacggaggggtgaattaattatgaattgtgggccagatgtcatccatgaacgacatgttatatcacgtatctgtgctagttgtgtactccttctgtcaaaaaaaaaagccaacctaggtggggatg

SEQ ID NO: 49625 - DNA, 3955 bp, Oryza sativa
ccgcgccggcacctgctgacgaccgggtggagcaagttcgtgaacgccaagcagctggtggccggggacacggtggtgttcatgtggtgcggggccccggcccccgagaggaagctgttggtcggggtgcgacgcgcggccaggtactcgggcgagtcggcgtgcaacgcgcgggggcgggtgcagccccaggaggtgatggaggcggtccgactggcggcggagcaggcggcgttcagggtgacctactacccgcggcatggggcgggggagttcgtggtgccgcgggtggaggtggataagggattgactactccgtggaggtgcgggatgcaggtgcgcgcccaggtgatggaggccgaggacacccgccgcctcgcttggctcaatggcaccctcactaacctccgccaccaacaaatctggcgcactctcgaggtacctacctcttcatcgtcccgtcccgtccctcgttaatattaatataatcaccatccccgatcgaggattgcatgcgtctcatgattgcccaatgtcactctctatgttactccctccatcccatagtataaacacttttaaattttgacacagtctccgatatgctattttgatcaataatatctataaaagtaaaatattttaaataaaatgagttgcatattatgataatttggttaatgataaatctagtaatatcgattttatatgattgatcttttttatttttatgctattaatggtcaaagaaaaacattttgacttatcactatgctaaaaatgcttatattttaagacgcaagaagtatgtatgtactccttccgttctaaaaaacaaaagcaaattagtactgtatgtaacacattttagtacactgaatctgaatagagatatatccagatttatagtattagaacgtatcacatccggtactagatttgttttttacatgacggggcagtagttatgtttgatgatagtgatgcttatgcctcgtcacctttgtccccgtccttacaccatgtttttgtagatgagtgttcatttcagcaagcttaattgttatcttcttataatggatattgctttgctcttgttcgtggctatcgcagctgatcatcttcaatttctgcttgtatctctacagttacatattgcattgcgcatcgcatatatagccgatctgacattactgctcgatcggtgcttgtgtgcaggttgaatgggatgcctccgccgcgtcatcttccatgaaaaacagatttgttaatccttggcaggtccagcctgttgatttccctcctcttcccatggggctaaagatttctaacaacaatattagtgcacctgtgtgcaatggggattcactgctggtgccaccgatactaatgcacccgcaacctcaacctcccgctgacattcagggagccaggcataacaatggccatgcctatgcagatataccctcttcatcaacaccatcaatggtgaggactcagcagctgttcccaagggatcttcagattttagttccccacaccgacattgtcactcctcaaaatggatcaccgcccgacaaccccgtaaacacgcctctttctgcatctgacggaatgaagaccatacagctgtttggcgtcacaataacatcacctgtgcaaggagacaccaatggcgctttcgcttcagcacaagtgaatcaggttccagagggtgtagatgatgaaactgctaccgaagaagcttctgacacaagcctacctgactctcttaccaatggccacaatcaagatggtgctaggctttgaaggaatatcccattaaacgtttccaagatgtactagtactttcttattgatattcatgcatttacttgcaattaatggaaaaaaaattcagaaatgcacttactaatcggtctctagttctcaatgccatatatactcaattatactatatgtatagttgtaaaagtactttcttattgatattcatgcatttacttgcaattaatggaaaaagaaattcagaaatgcacgtactaaccggtctctagttctcaatgccatatatactcaattatactatatgtatagttgtaaaagtactttcttattgatattcatgcatttacctgcaattaatggaaaaaattcagaaatgcacttactaaccggtctctagttctcaatgccatatatactcaattatactatatgtatagttgtctggttaccctttgttctctgcaattcgtgctgctcattatttgtcgatgaacaaaagccatattcaatagagtctcctgctctccttcattttttcctgactggattgtcattttctacatcaaccgatttagaagtaactatgttttttttgcagagatacgatgtacttcctccgtttcacaatataagtcattctagcatttcccacatttaaatatgaatgtggaaaatcctagaatgacttacattgtaaaacagagggagtaatatatttttatcagccacctgtttactgactgtttgtttactgttttctacagatggctggaccagatttgtttctaacattttggtctgttctgtttcaccctccggcagtttgacgggatgtggtgttcttatgcatgcatttaatctggagtttaggctggcaactatgccgcatggtccagttaagtttggagtaatctggagaaacgttcatttctttgttagaattgttatagagcagcactgctctgttttattttccttgaattttcacacctgcactttgtttgcttgttgtttgtttacctgtattgatctgataaacatctttaatttcctggggaaccgttgaactctgctttgctgttgcggctagcttttccaattggtatggcataaggatttggcacttccaagtgacatggtgatgattttactagtagtaacaatttgtattgtttacttgtgattgatcgatggagtggatgatgctggtaaggaatatatattggtgtggtatactaggatatacccttttgcaggagaaggggatttcagccagcctgagattgagagacgacgtgttcaaacgattgagcagtctatccttgttggaaatgaagacattgcaactcaccacccacctcaactcgccaccaaagctgaaagagatgctacaatcaatagcaacagtatgtttctgtcaaggtgatcaagtgcagattgattgatttttcagctacactagtctaccatcatgcacggtactccagctctgtgttcccaattcccttctttttgtccaagataggctgtatgcatcttttctttacattcatgattcatcaaaaggcagtcaaaatggtcctttttaatctccttttgccttggaaggatgaaactttacatcttgtgactttaattccttgttaaaagtcctggaccgcagcttgtatttgagtaggtagacaggtagtactagtagtagtagtattttctgagctactgcgagaggaagtaggaaaaagtagataccaagcaaaagcttgagacttggtactatgggacatatcaagcgtgcacatgtgtgtctgtctgtccctgtatctaaaccttctctatggaccatatggatggagtattacttcaaccactggtcaagctaagctagcaaaacgaaatcatgtaatcgttatagttgccaatacactgtccttgctgccagctgccttataacaagcttcagagtaggagccaggctaggcaattcagagtaacagtccatgactccaacagatatttcctcaaacaaaaaaaaaaggttttacaagtacatgaatgaacattcttctgatagataattttttccccagaaaaataggaggcccttaaaagcagttttacacaagtacatgaatgaacattcagatatttacacacaagctccaagtca

SEQ ID NO: 49626 - DNA, 1207 bp, Oryza sativa
caaacaaaaaaaaaaggttttacaagtacatgaatgaacattcttctgatagataattttttccccagaaaaataggaggcccttaaaagcagttttacacaagtacatgaatgaacattcagatatttacacacaagctccaagtcatttttttccatcttggccaaagttcaagatcgatgagcagaaacctcgtcattcccagttgcaagttaaaaaaacaagaagaagatggatgagacggatgatggatcgatgtctctgcattacattacagaaaacacaatgctgcatgcagctgctttccttgtttgtctgctagctgtgattcattcgtcagtccatatacatgtacctccaatccgatcctccgtggatatcatatcatatactactacggagtactaggtagtaatatgcatgtagttacagtaaacaaatgaagagtattactatattcagagcaatccgacgagattaagagtacgtgaagagagtgagggaggtaagaagctactcctagctgagaggcatggcgggtgggcgcctggtgatggtgagggtccggatccagctcctccccctccccctccccctcaccgtcgtccccttggacgacgaccgctccgccgtcttcttgccgtcgatccccagctggtggcacgccgccgccttgccgttgccggacctcttccaccgcgccagctgcagcagccgccccaccacctgcttccgccaccgggttacgccgccccgcttcacgtgctccaccaccgccgtggtcgtcgtatctgtctttttctcgccggcggcggccttctggctgtcccacgtagccttgccgttgtcctcgaacttgatggagatgaaggaatctgttggttttaattaaattggcagcagcaatagtagagtacgtacaagaacacaattagcttgcttgcgagcgacagagaattgaaggcgaggcgaggtgaggtgtaccatcgaggctagcgatggaggcggtgtcggcgtcggagttggcgtcggagtcgtggggggcggggcgaaggtggtggcgagaggagtcgaggcgctggaggaaggaggagccgagcgcgaacaccttggggagagagatgctgctgttcttgcggtggagcggtcggtcggcgaggaggtgggcagcggcaggcgaggtcttggaggcgaggaggaggagga

SEQ ID NO: 49627 - DNA, 16339 bp, Oryza sativa
  unsure (1)..(16339): unsure at all n locations
atctcaagcttaattggaccatcatatatactactatcatgttgcagtagcatcgtatattcgtatcaatataatctccaacaataatgaccatcaattaatataatctcaacaataataatgatcgatcaatatgtggggggtaattgctctactaacaattggcacactcactgatcacctagctacctagtaggtatgtacgtgtacggtttacatattgcgtgcagtgaaggaaaccatccatccagctagctagtgtacgccgtgagtgagtaagcttttttttgccgtacttttttttcaagcttaccaaaggtaaggttatcaatgcaaattcctagccatatttttactatatgacacacaaagtcatggccaacaaaattaagccatgtcacatttttcatagtcactgatatgtgggtcttagattatagaagatgaatcttgctacatatatttgtagtagccaaccaaacattaacttagttagcataatcaaatttgcttaaccacaaatgttcatcgaccaaacaacctctaactacatggttagtatatataagtatacacaggctaagctagccaccttaattatcatctgtgtgctgtttaaagggtgtgtatgtgtatggacagaagaaaactattaattaatgatttaatcgatctgcagtttgctggactgctggcttgtcaacggatcagatatacattaatagtatattagcatacaggatgggcaactgcatttcgttactgtttgaacttatgacaatgagttgatcggatggatgaatgattgatcgaactatagggtcggacgtgatggagctggtcgatcattcatactactagtagttagcttggggtacgtggtccaatttcgatggagaaaaaccaaggaccacttagctactacctccgtcacattataaatccaactttgaccgtccatcttatttcaattttttttaaaaaaattaaaaacataagtcacgagtaaagtactattcatgttttatcatctcataacaacgaaaatactaattataaaaaagtttcaaataagacgaacgatcaaagttggacgcgaaaacttatggttgcacttataatgggacggagggagtagttattagaagatactaatacaatacaaaagggaattatctaattcgatcgatcattttccgttttaagtggtgtttacgtagagcagtattaagcgagtgaaagaaggaaggaatgggcagatgcccccacgtacgtctgaatgaatgaatgaatgaatgaaaggcccaaattattagggaaggagaggcctaattaatctaaatcgatggagggtggtcggcaaatgaagcaaggacgatgggaagagaaggaaaaggcgaatgagttgaatctagctaggaatgcttacttatatcggtgcatgcacgcatgtttattggagagaaaagaaaaaggaaagaaagaaaaaaaagaaagagaagtttctctgctacttggtaggaagaaaaacgagatctatatgaatgtgtgagagagggagaaagggagagagatgcacatgggctgtgggccattccttgttgtaccaatatgtacagtgccatacctgcacgcctgtccctccagttaatctgcctgatttaatctctccaccttctcctcagatcaattctgaccaggtaaaacaatcagtttctgctctagcacaatgcagcggtaaaatacaaggaaattgaccgttaataaatctgctctctacttgtacctgcatacatataccacagcacaacacaagtaccagctgcaagcgtgtccttcaattccatggggccttgttgccatgtccacatgcatggtcaaacacccaacaaatgccaccgtccaatttcgccttttctttattaaaaatgatatatgcatgacacttttatccaactctaatgtacaaccagagagataataaacatcttacacagtagatggctcatgccatgataaatcctagcgtgcacttaccaacgctactcacgctgcaacacggtcggacaacagtagaacaaaaatgtcgtactatcagccctcttttctttatttatttatcccaaacaaggaaagaacttttcgtctttgcacctcctgtatgtatgaaaattagaaaaaaaaaaggtaaactgcacgctccagatcataagtttcggaaaagaaaagaaatctcttcatgcatctttccatccctgggttggatgctggactgtacaagcggagatgtgtaggtagctatcacctccatcaaacactcaaacaggacagtgagcatgaatgcacgaacacacgcacccaccgtaacgccaccggcatgcgaccaaacccagcccaatgcttgtcttggagttgttaagacagccgatggatcttctccttggacaattgtagggtcaaacaaaccatctcgacacacaaacacacacctatccatcgacaaatatactaccactatacccagcacacgcacggcacaataatcaggtcaaagatactactggtaccatctgtccatcatcatctcctacacaaccttcctcgtgaaaccctgtaccccaaccccatacacatcgtcatcatgctcatacccagtcggtgcgccagcggtatcacacaacaaaacaacaattgacacggtatatacatactacattacaaacatacttgctgttttatgttcatgtttcctttcagagatccttgaatgatgtatgcagtgcagcaggagaatatgccgttgatgtgcatttgtcattaccatccaaatagcatccatccaaatatccaattgcgttgtaccaaagcaccgcattgtgtgcactctgaatttagacgctgttgcaatcaacagctccatctctcttgttaggtcggcggcgcggaatcaagtgactgttgctagattccgtgcagccagccatgaaccatctctgcctgatgagctgcacggtgacacagagcttcactgtccttttgcgcttcacaaagcaaaagcaggagcacaaaggcagcagagaattttgttagacgaacatgattcatattgttcgcagtaaaattagagctacccagctactaacacatcgctagaccagcatggaatttgtgacctctggggatcaaaatttgttactacttactacaccacaacatacaaacaagcaaatgaccgatcaaccaacttcagcatgccagcttcccatggttcaggatatcagtaagctcaagcgtaggagctgagaacacgaacatcatggttcacaaagatttcccaagctcagaggatggcagtcccacaatacaagatgattacctctgggaaataaaaagggagttagtgaactggtaattatgggtaacatatagcaaaaagaacagctgaaggactcttaacaattattgcaaagtacaactaaaaattctcatgtttcttcaccatttcagtccaaaattaggttcagtcaatgaagcagggtactgagaaagtatgttgcattacattacaaaaagtggagtacacagaaaagcatgactgatgattaatgaactactcaccgtgtatgcaaaaaatctagatcaatgaactagagaactcaaccgttgtggtgtgtaaatcatctacaagcatgcaagtagtataaaaaggtacagacaaagaagaaaaggtagtaagcatgtctagtcaacatctttcatttctatatggaactggggagatgattaatacaaaaacatagtattcatcaccagagcacatcagtcatagtcaacaggaattagtgcaactgcaaaccagaccaattacaactaatgacaaacattgtcagcatttttaatgaccatcctgggcctgtatatcatgtatttgtgtggccatgcagagacacgctgactgaaaattgaacaaattccaggccttccaggcttctcgctaaagcaggtgctatagtaaaactgattgcaatttcatgcatgtttcttcagcattccactatcacatcagatggtcaggaggctggatacatccatcattatctattttcaattaatttcaaactcaatgtgatgaagtaatgtctgatatgtttgttattagtgcaagtgcctaaaacatcagtgttggtgttttagtcatcaaaatataacacatagcacgaatgtctaagctgtaggaagaaaacagtgtggggaatctatacccaagtatctcagatcaaacacccatgatacaaaagaagttcaagtagatctatgaagtcatatactcatatgttgaagttccaagaaatcaaggaaacatatctaaataggtgaaaggtggaacccaaaacgtaggatgagccacgtaagcaacaaaaatgtggctgtctgattcagtaaacaacaaagtagggagagaccgagagagcattgtaaccatcggatcagatggatggtaaaaaatatatagagagaaaaaacagtggtgtaaagaagcaactagagcccttgagaataaaaacgatagccatccaccgcctgtgactcttggtaccttttcattttagcccctattaatatctcttatcatgcactccactaaatagtacaaatatttgtgaaaatacccctacatcgtactcatatttttaagtcaaggatcttgcaagttttgattttaaaccattgtgcatgctaaattctaactagaaattacggcatgagcatggatttgctgtgacatagacatactaaactaactaaactcttttgttataattttactatgttatgggtataataaattctatagttttcttagaataaggacataataaattctatatatagggatggcaatggggacctgaaccccgatatccaacggggaaaaactccattaggggtgtaaacgggatgttatcggccaaaattttcatccgtcgggtaggccgggggcggggatgctccacaggcccccggccctgaatccccatgggggtgcacatccctctacagtcgcagcccacaatagaaaaataaaggctcaaggcccaatttggtggactgtatatataaagcaatgaaaccctctctcagatccaatcagcagcgggaggccgccaggctccgtaagaccgcggccatgctcagccgtcgcgcctcctggccgagcagccgtcgccacagccaaaagcagcacacgcgggtcgccgtcaccactaccatgcaggcgtgcagcagccgccaccgccgctgcatggtgtcttcatctccttctagtctttcatgctctgccattgatgaagtctttccagctggcgacacaggcaagatgaaacggcaagatgcggaatcagcggccaagcgttgcgaacatgctacttgtttttttaaaaatttcttcttttgtatttcttgatttattttgttcttgtgatgattatttgtgcgaatgaatcgattacttcctattgatacgttcatatgtatgtgtgccattcttcctaaatctgtccttccaattgattcattttttctctaccctctgttccttcctgtttcaatttgttgagcagtggcctttgcgtttttccaggtgtgttgccccgtgggcccctgaaaccccggtgcagaatggagacggtagcaatacatcacccgacgccggggacggggacggggagcgggagatttcagtatgtccgggggtggggacggggtaccacaacccgacaggggcagccccgttgccatccctatctatatatgaagagcaatctctctaagacttgccaacaaaaataaaatgaggatggtttcatagtgatatgctttgctataggtttaattaaaaattaaaagttcaaacttgtcatttcaaaaggtataattttcttaattcttgcataaattttacataagattaaacaaattccttgagagcctgcaaaattatgtgcataggctgtaaagcgggtgtgctaatggaaaataagggaagaataagggggtcatgcagaggtggtggaaacaccaggaagatggcgactcatgcagtggcgaagatggcaacaaataataaacggcaaagagaagatgaatggaaactctaaccctagctgttgcactcaccattttgtagccgaaagatgggatgtgcattttagattacaaacctatttacaacattactacatattacagatttagaaaatcattaaagagggaggtaatagtcgcagcagtaatgtatggtaaattttggtaaaaaaatctatggtaaattatttgttgttgtgataatatttttacttacaaatcaagataaatctgttaatgttatatctaacttcctgccaaagtatgttccacaaacacttatttacactgttagttgttattaccattttaaactaattactataaacaaacatataaacacttttaaaagggaggttatagttgcatgaacgcggaagtcaataggctagttatgagatgaaaacaacatgtttatggaagaaggagagcatacctaacagtatttcatcaaaaagcaacatacaacatgccatcaactcatcatcgctgggatttcctgaaatgtggaaagtgtcattataatatcttaagtggcaagggaaatcataaagagatatgcatatttatgtatgcaacagaaaatgcaatatcagcaagaacaaaaatattatgccccccccctccctctctctcatgtcaagtgaacccctaattcgttttaccatcagcaagaaaaataatcgacggaattaacaatgactcaatgagtaccagctaaacagccatctcacctgtgcaacagtagcgccccttctagtccacctatttccatggttgagggtaactgatgaagcagcagcagcagctgggacgttagtctgaggatggtcaggaatactcgaagtttgttgcccttgagaacagatatgttctggtagaacattttcagtaagtttatgtaaggtgtcacttctgtatagcgaacatgttcaagtgcaaaggattttcctcacccccttgaggttgtgacaaaaagaatctaaaaaagcttacttggattctgaaaactctatggtatcagactgctcttcataatcatcttccagattgattacaggaatcatttggccaatgctctgaccgtgaagcgtagcttgtccatctgcagcctggtctagaagcatctggtcttcctgtaactgagcactatctgcagcctgtttaccagcgccattgtttagaagcatttgttcactgttctggtcatgattatccaaatcatgcacacccataacatgattcaaaagcatttgctcattctttattgggcgatcatcgcctgaatgttcatcagcatcatgattgagctgcacctgttctccattcatattataattttccaacacttgtacagaggtactctgcccctgattcagaagcatttcttcagtttccaccaggtgtccatgatccgtgtgctcatctgcacaccgctttagaagcatttcctcaccgttcataaggccgttatctaaagtatgcacatccatgacatgatttatatgcatctggtcatcctccaactggtgattatcctgtccatgttcatcacctgtctgatttccaaccccttgttcattgttaaaatcatccgtaccatttctttgatttagaggcacttgttcatcctccgactggtggttgtcaaatgcatgttcatcttgaccttgagttcctgaagtgacgcagtttgctccttggctcatctgaccaacttgatcaggaacagagtcacgaccattatctaaaggcgaatcattggaaatctcaaccatttcacagttttcttgagattccacaacattgaggtcaaaaatcccataccaagctggcaggtcttgttcatctttggtaaggtctgcgttatcagtttcaacttcactctgcggagcctccattccatctctgacttcctcggccactggttctaccaagcatgaatccctgggagagatcggaccctccatgccctcctcagcatcgctgaactgggactgcctatgcagtggttcctcatcagactgtgatggatgaacaacatcctcgttggaattggacagcttgtgttgggtaacatttatttcagcaacgcttggataattgaaggcagcaacagcatcgtcaccatcgtcatcgtcatccccatatatatcttgagcttgatcgacctctatgatctctgactccacctctgctgtgtcttcattggctgcagcttggctggcactctcttttgtctccataacaaccactgaacggggaggtgccttgagatctcttggcacatcatcagcatcaccgtatcccacatcagcatcaccgtcacggacaatgccaggctctggcaccttggaatgatccaaatcggcgccggatgctcgccaatctgaatccctccggctgccatagttatagctccttgtcctggttctgctcctgctcctgcttctgcttctgctcctgcttctgctcctgctcctccgtcttcgatccagcctgctatcactggagacacggcggtcgttatgtgaataggagcgtgacatggttggtctcctttggtcgcgtaatcgtggctccggcgggcactccgatcggctgaggcggcatcattgtacttgcgcctgctgtcaaagctgttgctcctcctgtcccagccggatctacgggatagcctgtcatcgtcccctctgtcgcgggggaagtcggcattccggcgggacctggggtcgtcgacgtcatggttcctggcagcagggagggggtcctccctggcgcggagacggtgctcggggatgacgccctgggcgacgaggtagcgggcggcgaggcggccggcctcgagaaggacgtcagcgcgggagcggcggtcggcggcggcggtgagtagggcgtcgggtgggggtgggagatggacatggagagggaggctgtcctcgtggtggtggcggcgggggcggtcgggggtgcgtctgtctctgtgcgggttggggttggaggggggagcgcggtggtggcggcgcggggagggcgatcgtcggcggtatcgtcctcccgaggaggccgggggcgggtcgcggccgcgaatgcgagacctcgactgcatctgcatctgcatctgcaattttctcccttaccaccctaccctaggaggaggaggagaccggagtccaagcttgaatggtagcagcagcaatgtgttcccgttccgtggagttaaatccggcgtttgtctccttcttcagttcctccgttatactccctatgtctcgtcccagctgcccagatcttcgcgcggtcggtcggcgcgttcgttcggtggcggcggcggcggtggaagacgatggttgagagaggcgaggcgaggcgagggtttgcttttggtctctctctgtgtgtttgtgtgtgtaagtagagagagagagctccctccggctccctagataaagcacagcaccgcaccgctcaactccagtagtccactggagggagtggagtacttccctaattaatctctctccccgatttcttctcctctctctggagtctggactggaggagtccttgctaatccaattgttactcctgctaatctgaattactactgtcatagtaactgctatgctattctgaatccctctgccgtttttttttttacggttttaccactccctaggcagttgagtagatctgcccactcagtgctaatgaattatgactgggattaactaggctgcgtctcctgctttgcttcttttattatcactataatatactacactactactgttcctctgtatgtattactactatacaactactaataatactgccctttctttaacaatcgtgatgtggaccaggaccaagaaaggtttaggttaggttaacctgtactagacacccctatttgtgactgatagagactgcaaatctcgaatgtttctttgtagttcgattgcagatgttcttctgtgctcaagactctaagactgcactccaaggtttcaatgtttgcatggttttgttacaattctcgtcatcttaacaacgctactactcttctgaatgcctttgctcccccagcctctcactcctcacctgtatctgtatctgtatgtacgtactcctatgtgtagtcgctgattgagtataacaacacacgatgggcatgatggaatgatgccatcgcatcatataacagcacaaattcacgctacatatactaatttacatcttgtcaagaacctgctttgttgctgggctgcaatctttacaaggcccaaacacacataaaagtgaaccgaatcatgcccaattgacccaatctttgttgacacctcctgggggctttcgtcaactcaacaacaaaaaggtctcaacctccaaaaaagggaaaagatggacatcaatcacacaagttcgaatctgaataggcactccgaacgcaagtcctagattgaagctgagacttgccagccagccattttattcctccttgaatggaaaagatgaaggcaataatgatgtgatgtagtacagcaaagggttcactttggaaacatgagttgctgtacagcaaaggattcctagttttagaaactctgaaagtgaatcactctgtactgtacaccctttcttctgctggcctcagcttgtgtacctaaaatgttctccaaggtagatgtgcacattccaaaaacataagttgctaactgccactagcaacatttatgggatgattgtctagacttcaatgcaatagcttcaatggctactactttttctaactataactgtaataataaaccaaagggtaaagcctcatacatcatcaaaagattagacacaagtactcaattccctccaaaattttagcataatatacttcaccaaacatgaccaacataggcttatcatgaattcatgatactacatcaatgcttatatgcagagagaatgcaagcatagaagatacagcaagaaattaagatgccaataaacagatataacgtgcccaatcccgatatgagcttccatggttggttggcaaacaaaagtaccaaaaagaacatgagaatatacccgtactcctactaaactgttaccaaagtcaagaattgaactgttacactcgtcttgttcctcaggtctagcctggtcctgcacaaaagacatacagcatataatgattgatatttaactcgttcaattgatcgaccaaaacatggcaatggctctcgaatcaaacaaataaaacagaggaaataaaaggggtactgtggatatgtcttatactttcctaacaatctcttactatattggaatcacagctaatttctttggaaacacttaccgttggtaataaaagagggaagcatactttgtcaaggaaaaccgggaaaatacacccccatgtactacaaacttttaccattttcacacctattttggacattttaaagagaaacaaccattgtttctcaaatgattttcagaatgagataaacactgcataataataacctttcatttcaaataaaagagacaaaaaatgatgagattgtcctttgttatgttatactcttaagtcaaaatgagaagttcactatagagaaacagcttataacttataagtaaagtgatttatcaacaaacctctagcagacccaggtgcaccttcacgttggctcatatggggcgcgagcatctccatcacagctctcatagcgtctgcagcctgctctggtcctgccaagtttatttggatgccagcatccctgtgcatgcctggttggccatgctccccttcatgtccacttgaagtttgttgtgggcgatttccttcagtagagcccgtgaacgaaaaaggaggagggactgcagtattggttggaaaagaaggaggtggggtatggttacttgaagtctctgtctgaggtgttccttgactgttcccattgacatttgcatgattaaaaatgtcattcaaatttatatttatggaatgctcagatgattgttgactgatatcagacacacggttgatgatattggcgaagaactcaggagttggagaatttccaggaggaaaaaacgtgaatggaacaccactgcttgattgaccaggaaactgtccatgtgatgcttgactttggggtgcgtatgtattctatacacaacaaaactgatcagttggtaattttgaaaggacaaagaaatcccccaaaagaatgaatttcatgtaatcaaacaatatcagcattctatacctataaccgaagttccaattaggagttttaaatgcacaaattagtttctaaaaagaaaacaatggactgtatgtttgccagaggtaggacatatctcaaagtccagtaaaaagcacacgtggtttccagttacagtacctgttcttctggtggacctcgctgttcagccagcttctttttggtaacctaaagttcaggcatagagcagggataaaaattccatcagccattagcgagagtagcatgaaacaagctttatccagttaatgaaaataagagcataaaaacaatacctcgatattctgccagacattttcattactaggatcaagctcggaggctgcaagaagaaaaacaagttcattatgcacccacgcgttactttactggatatactaaatgcaaaatgtagattcatgccagaatggcaaccagaacaagttggcatccagaacaagttaatttgatctagaaaaatgaggaatataataatcagtagacattagaagcaatgaaggttgaaagtatgtgtttgatgtgaatcagagtctacacagtgctgaaagcatgtggcatggattgcgctgcactagcgaccttgaccacaaaggcaattaattacataaagatctcttaaaaggatacaccagaagaaactgaagggtagatatgtaaggttgtatgtaaaaaaatcaacttttcagaccacaattcaaataagcagcagctttcccagaaaaaaaaatgtaacagatgtaaaaacagtgtatagcagaatgtatcacaggttcagcaaaactaactgagacttatggattgcctacctttcaaatatcccttgtacaaagcatcgtggtattttcccaaagcaaaataagcagatccaagtcggctgtatgctttactgtagttagggtcaatttcaattgacttcaggcaatcctcaacagcttcattgaacatattaagaagggtatatgcagcagccctggaagtaacatgtacttttcaatttttcatgttacattggatcaaagcaatgtatgaagcagataaatgctcttgtgagaaacaagtgcatagttgtaaggcagtaaggattgttaacaccgctaccataacaagagtaaaagacgttaggttaacaagagtaagaacttgacaattatatatcaactttcccccaaaaaaaagggcccatgggccatggcacgtacgatttgtaaccagctgcagctggcttccactgttttaagatgtttgtaccggtgggaagaataataacagatcctgagattactaaccacatcatagcttatagcggattttggggtaacatagtattttatatctgtacttactggttctggcattctagactggattcactattagccactaagccatctcaagatcccatgttacatagaactactcaggaaaacggttgaaataacccaagttttgtttagttccattaattctgacccttatccctaagagttactcagttatgctgaaagagacaacaactgcacagtgcatcctacatattcaccaaaaaggtcatcataaatgtcattaatttgtgcatacctgttacaatagtaaatagcattatttcggctcaacgcaatagcacaggtgtacagttctacagctttaagatgttgttttgacctcatggattcattacctgataaacagacatgcagttagctacagaaggcttgaactgcaaaataattagctctttttacattgataaatgaaaaaaaatgaagatttttcaagtaagaatttttagttaaagttaaaaaaaacaggaaggtgtaaagtggttcactacccaatgaacaaattatgctatgctaaagaaaatgcacaagtgaaaagacaaagggttgtggataaataccttttgacttgaagaattctgcaaggtctcctaagcttgcccttttccttcctgacttccgcatcccctaaacagaggtgcattgtacctcatatcataattaaaaaaacactagactataagcgaaacaagaaaaaagtagcatgcagtccaacagtcgccgatctcttcgtccaagtagtgccactacccaagttgccctagtcatttaagagaatctccatgaaacaggggacagtcctagataacaagggaggcatctgggataacttttccttggtaacagggtgtagggacaatacaatcatgatccattattgtgctttaaaagagcgcgagttagacaagtaaatatcacatattataccagcaatgcatcatcgaagaattgtgttgcttttgaaagctggccaggatcttcagctccagcagatgatgttttaaagaaattgatttcatcaagcgaggtatagaattttgcaaacagttcatctcctgaatgatctgatcaaatagcaaaatcaagttgcatgagtaaacactgatttcaagtgaatgatttttcctacatttgttattactcagtaggaaataacaccatttacaaaaacaagcttaatatttccagcattatctggacatctgatcatagagacaaccaacagtttatgctatagtcatacctaagtcgaaggtatcttcattttggccttcactctggtaaggagaggcagaagtcagtatgagaagctaatatttcttattaaggttgttaaaggatataacaaaacatggtgaacaagacttgatgtatgagattactaggatgtaaaattataggcataatgtaattccaaacgtatgcatgatgttatgtcaatatgtttgtctttatatatatatatataaatggcatggaataagacggatggcggtgattaagcgtgtgacaatgtgtgtgtgtggtgattgaaagaagaagaagagggaaaataaagggnaaaccccaaatttaaccccaatttttttnttggaaattttggnttttgggttacccccaattttttnttaaaggtttnnccaagnggttcctnnttnccctttnggngggaatttaaggntntngnanangttgnccttcngnccanctgcccaagaaggttttgttggataccgggccgggtgcagagttatcttgttgagcagcttccatagagctaaagagttcaagtagaagtcctggatgtaccctttcaacaacagatgaagagttgatactgaaaatggattccagacattccctggcaacctcaagagcttcaggatcagccccaggagctaactcaactgcatagcaaacagaattccaatgtcaggagaaccaatggctttgcaacactgcacatctttgattccaaaaaaggggagctaagctggtaattaattttgtctctactgtgcttttttttttggtgtgggagggaaatcttgcatattgtgctgctttagatttggatggtgattatcgaaaatattatagcctactactgtagctaactagttagtaattagcaaattcaatggtgcttcgcatcgatgtgcgaaatggctccatctagagatagaagaaaaagggcaagtagtaatccgcaacctatacacgcgactccaataaagcggaaatgggatttagggcaggcgtatgggatgggatggaaccctagtagtagtagagtcttctcgaagcataatgatccgaagcgaagcatgttggtgggcggttgcaagggaagtagtccgattgggttgatcgatccgcagcagcaagcaacccatactatactagtactagttcgctcgcaggaaaacagtaaaatcgagcgtgatttggtgagaagagaaaaggggatgggagacgggagacgggagtagtgaccggagttgaggaaatcgaggaaggagaggacgatgaggcgggagatgggggagtcggagcgggtca

SEQ ID NO: 49628 - DNA, 14259 bp, Oryza sativa
agaagccctaaataatttcttcgatgggatgggggctaggataacagaattacacaagcacattctactctagtagcattatattggtagtatggtttcactgagtaacaacatgcatatgagcagatgaaatgaaaagggaacatagcattgctgctggggaagttcgaaatccagagcaaataaaaatcaatggagtacatagtacagcacagattattacattacgaatttacgattacgggagaagaaaaatccatcaatcggaggaaggaggaggcgtgggtggctggtcctggtcttgggactgggactgggactggagaggcgggaggagctgggacttgcggcgggtgtcgcgcggggggagggggacggcgaggaagtgcttggtcttggagatggggcgggagcggcggagctcgacgacgtcgccgaccttgaactggttgtccgggtcgtgcgcctggtacttcttcttgatgcgctcccgccgcttgtactttgggtgaggagccagccgcaccacctccacccccaccgtcttgtccgccttcgtcgtcaccacacgccccgtcagctgcttcgccgcctggatcctcagcgccgtcgccgcgcccgcccacggcgaggcgccgctgcccccattgccctggaccctcacaggggacgacacgaacggggtggtcagcagcatcttcaacgctctctcttccttgctatcgtatccttggctgcctctccacccgtggaagctcaagaagaagctgagcctgatggacgggtaggggataaggtttccggtcggacaacccagcataatgggctggctactgcaacatcaccggcccagcccatttgaaaacacactagctactgtatgtatgcgtgcgttcgtcttgaagccggatggaaatggaaggtcagccaaagcaagacaaatgtgctcataactcgcactacccagacgttaggagtaagcgatatgccgctacataggcctacgaatctcaggcttggatgatcaggagtattttcttttaccatataccctctcaactcaccttgaacatcaggctcaaagcttgttcaatcttccttttgtttcagtctcaatgtttgttcaatactttttttttattggggaatgaatcaatacaaccctgtcgagcacaaaaggaaaaaaaataaaataaaagagagaagaccctacacctaaactcttggacccataaaatacacgctacaaaacctttccaacaactctatgttgctgctggggtgccagtgccagtgccagtggagtgacaaaaaaacagaaccgagtccactgaactgaccagtacaatagaacctacaatcaagcacagctcttcgacccaatcgactcaataaaccaaaagggaaggtactagccttcattctgtctgtcgtggtaattctttcttaccactcacttgtgctgaggacaacgcacatgatgctctcagacagcagtcctgtgcgaaccaatatatcactagcagtggagcatacaaaactaaccggccagaatccatcacatcataaaaatcacacactggcgctgcacgatgagttccctttcttctctttgcttccgtcccaacgtatagtaaagaatagacaaccaaaacaaattccgtcggtatcctcatactccgtatctgcctaatctctgaacgaccgctggctctagggtggacatgcactgttcccaacccccacttccgagcatctatggaaaatgttttttgttagtttgttgcatgtacggtaccgatacagaaccgcaatgaggaatcgttttacccgccctaagaaaaaaaaatatatacctgcttgtatccattcaaaatctggcacacttcattgtgtaaaccttcactctttatctcctgtataaacaaatatcgtgagcttcggtgcagaatactggtgcagaaagcatgtctaatatgacaggaatctcacgttccaacttgcacaggcctggcagataaaagttagtgaacccacagctccagttgggtttgctgctacctagtatagaatgacagtattttgtgtaagtcagacagctttgtaaattgtaacagtaagcaaaagcgtggatgtaccattgcacatagaccatggaatgcatcctctttctcaaaatcatctcgtatcctgtacatgacgaaaattagatccataaaagggcaccagagagcttaaaggacagacacttacatgcacaaggcattgcaccaggcttgcatgaaatggtccatgtggggggccacaatgtctggacagacccagcaaagcctcccaagagtgattgcgctattttcgagaagtgacttattcaagccctgtaatagtatgtcaggacacacgaggcatttagctgaaatgctcactcgagtaaaagacgtgatgagaacaacttaaaatgcaattacctcaggagattttaaaataggcaccaagcaagaaacaacagtgataaccacaggtgaaatttctttgccaatctggaaaggaataatcagttagacatacccacaacaattttacaaaataccaatgagtactagcacgtcataggcacagaaataaactaggagtgcatgttgctggccaagtttagtgtcaaagttgccatgtggcaaatgtgattggcagtagaagcagtaacaaaggtttaaggtatatcctgggaaacaggtatggtactagttgctcagaaaagaaaggaaacatctatgtgtatcaatctagggttgcaatatcttttgaaataaaaaaaactagggttgcaaaagtggtacaaaaccttgattgctaattctccaattgcccaacaggcgttgttagccactgacacagcctccttcacacattgcgggttctgcagcaacaacataatgtgaggagtgaatccgagatgttatactataccagatagaaaatacttaccagttgcttcgcagcaacattaaggaattcttgaaggcggggatgcagatgtatagggcaaacctacatgaatagttgttattttttttattggctacaaagcaacttaaaacaataaaaggtggactttggtggtctgcagcgaaccctagaaaggtcccccaggagggcgagagcactctgtcgaacatccgctgcttcatccatacaacattgcaaaagaatatctctcaaactgctttgtgaaacctaaaacaaaatgaagatggcttacacagatatcgaagagctacacacatcacactttgaagtgtcttacaaataataaagaaaaggcagtatgaagcacaatcttttctgaaacccccaagttttcattcaactaatgccctctttggttgggtttaggcttttaagccgacttttcagtttatatggtttataaccgattgacttttaaaaaagccaaacggaaaagctacatgtttgtttaggcttagactttttggcttataagcctataaacaaagagggcctaaaccatagttagtagcgtcaagaccaatttcccagtcactttgtttgataaccatcatctcaactatgtaccgacatgtaccttattgcagctcacattctaacatattatggacaacctacagaacttggatcctctttttttggagaagcatgtcttagtatttgtaaccctaccttttctttcatctattaatcagtatagccaatacaggaaaggaccaaatattacccacatgttgtctatcacttcaagctagacatgtgcaactagctcctagagagaaaagggtgatggggatccacaagtctaacagcttctgtgaaacttcagcctggaacatccataaacagtctccattcttccctgttgatatactcattgtgcaccccaaaaactatcatttattaacagaggcagaatgtctactttaatgtcatgcaccaatgaaacaggttggtttgtctgctccgctcatatggtctaaccccttagtgtaattctattccaagaaattcgtcacataatctatgtgcataaagaaagagtagggcttggaaaaggtatggatctcctacagattactgaggtcgataggtaagggaacaaagagtaattaacaaaaaaaaggaaatatcattggccatatagttgaatttaccaggctttcaataccagcgccaagtccttctgcaagtcctgacaacagatccaatgcacacacaatgaattccttatcatataatgcaccagctgcagcaggatcaacctgcatgtagaaaaagtgatcccgtataagtttctttgatgcagatggagtcagcagcatccagattccagtgaagatcaatgccgattgaattgactttttgtggaattgagaggaacagcgacaaccccaataaggtgacaagtcctgtctcctgatattcttctattttgattgtatccctaatcctatctctaggtttgttctttcaaaatagaatatgtaaaaaatataattacattaatgtgtacagtcattattcctgtatattttgattgtatccctaatccgatctaggtctgttctttcataatagaatatgtactaatataattacattaatgtgtacagtcattattcctgtatattttgattgtatccctaatctgatctaggtctgttctttcataatagaatatgtaaaaatataattacattaacgtgtacagtcattattcttgcagggcatgtaagtgatgggaagcaaccttaatgtggtttaacctttaatgtggctttcaagtttcaagaccataaaaatgatagatgcattatttattagatttaccgattagtaataaacagctacaaattaataggtttattacttgggttggaaataaccaacttgatatcagctattaatttatcttccactaaaataacgaaggagaccattaagcatttgatgctaaccgatctgtggactgtagtcacatgccagaaaaatagagttagctgcttggataggaaagatccagcatcatatccttaagattagagtggcaatgatctcattttttcctatcattaagattcagttgtaacagaaagttcccagttagttctacaactaaataatttcgttagcgttattgactggccctccaaatcaaagtggatatgtccagtgcaatgctactgttagaaggtgtgtaattgtgttttgtattgaagaatagtcagtcaagtttcagttccactaagaggccttgttcggttaatccctctcataaggggattgagggggatttggaggctattgtggtgtagaattatttcccttaaatcccctccaatccctccctctcggagattaactgaacaaggctaaagatcaataaataccacacctaaaaaaaattgaattctaaggaggtagaatacttgaaatagagaggatcagtggaccaatcaactaaaatccataagtataactaaaaaaagatactgcagatagctatgcttatgtgagaagcaaagaaactgtattttaatataagagggaaaaaagatttcacagacctttgccaggtgctgagattggataagattgatgcatctctgaaatactggctcagcaaactgtgaaaatcctggtcccagggcctgaaataaataaataaataaataaataaataaatcctgatcatgttgatgccagccctgattgacatatcagtatgtttcagacatctttacttgcattattggttaaatatttgagttaagtattgatgaggtaagaaactcatggtggatcacgatttgaagagtcagcttctatcctaattgcattattggttaaatatttgagtaaagtattgaggtaagaaactcatggtggatcacgatttgaagagtcagtttctattctaacttgttttctctattgttactgcaaattaaaatcttaagttaacacaagacaaaatggaccaaattttcatcaagaacatttaacatactgtctggagattataaccacgaatatcgcaaaagatgctctaaaatgggtatgaagggaccttcaaatcaaatttagcatgttcaaactagagaaggtaagcacagacaaaaactgtaagtacctgagcgatagatgtaaagcattcgagcagtgggaataaatctttatcagagttggcaagttgctgccattttgtgattagtggtggcataaatatatctagatattttgcctgcgcagcatattaaaagtagttagttataagtagaaggaatcaacacacaaaaggaatcagacaaacaaagagacataattgcttgttaatagaaaagaacaaacaagagagatattcatcaaaatgctttgcacctggttaagctcagctccaacagcatcagcaagagtgccgagagcatcatagagtattcgaaggtttcgtctctgctcatgaagcaacacgtagagttaaaactaatgaggccttaggaagcacttgttggattgcattgttcaatgcaattgaaaattatgactttaaattacaaagaacctggtattttccataggcacacataaggtgctgcaaaataattcccaagtgtggtactaactcttcagcagcctcctgaaaacagaagaaaatatataataattatacagaaaatctcaaacagaaatggttcaaagatcaagtagataacctcttcaagcgttgcaaatgccgaacacgccgcctcctgcactcttttgttagtatccaaaaccctccttaataaacctaagaggattttatcaaattgttcacgaccattgggatgctctaggctctgcatcagcaaaaaaggatgcacgataagttaagaatcatctatggattgcatatagataaataaagagcaagtccagttcatagagcattatatgaacacagcgaacctttggaccccccccccccaccaccaccaccaccagaaaaaaaaacccaaatagtacaaaatgcatgtcgttaggaatgaaaaaatgagtagtctgccaactgatgtttaaaaggcaaacacagcacgctgaacaaaaaaaaaaaagccaaagtccacattgtcatgtacctactttaaatgcataatacaaaaagggggtggggtgtgtgtggtgtggggttagcttttgaaggaaaacaaaaatcttccagtatagaagatggtagattcaacacttaggaatgctcatattacctgtacaatgaatttactatatcgggagagggtccaacaagtaatactccgtataagaggaaatttatcgtcaagaagtggaataagaaaagcaacaatctgcaaatgaatagaacatgttaggataggtacaattcacaatgagaagggaagcagaatagacagatgaagaaatcaaaagtgagtctcaatacacacatgctactcttttcctaatgaagttcaaggaattaaatacagcaatagttaattgataaaaatacctgcggaagatggggatatagcccagtaatgcatccctccgctatagcaccaatagacaaaacagcagcttccctctccttccacgcatcatcgtcagttcgagccagattttgctgcaaaatacagaaaaaggtgtatgtttatccaaatcattcaaggtcagaaacagcacacagcatcggaacatataaacacttggccaacaacccaataatgctgtggatagggttctacaataatgcttcaatattgaactcctacaaacaggtttctaagtaattgacaaaaacacggtataattcatctctttacaaaggaagttagaaagtcccaaatcccttaacttggcgaaccacaacagagttcattcattttataaaaaaaaaaagccatattacatcaacagccttcacaaaggtaactcgccccaaaaaagtacaggaataaagcaataagttggcaaaaaaaaacgtagttcaccttggaacattgattattatttgaagcctaaagccattttttgagattgacatataaacttaagcattatggtttatcagcttctacaaaacatatgatgatgcagctactgtaacgaaccagaaactgctagttcatatgttaccaactaatcaggaatcatcacaccagtttcgaaggaaaaaaaagattggaagtgcccagctgacaaggtgtgttcaagatcaaactctacaatttgcaaattcagatcagagcaatgccaaatatacctagaatttgagtagcagctcaggggctaatgcatcacaatatcaatcttgataaatatgctagccataataaatacaaaaccaaaagtacaacttacctgtatcaaaggcattaaagtaggaagaatgtcatcaccgaaaacattagaaaggacatccaggccagcagcactacatttcctcaaattccaaacatttacagcatcatcatcatcctgtccatacgacaacaaaacaatgttatcttcatctcgacagtttaagttggtggaagtcattaagctttttaaaaacaaataacatttctggactcacatcgtcttctccggtttcagatccatgtagtcgagaggcatggaaccggggcttcaagtcctgttatacaatgcctttcttgtttataaagaaataaaagcagagagcatatagctgtaaaacatacagtcactttccatatcttttataaattttagggttgcccaacctaataaaggagcaatagacaacgcaagctggtagtaactaatttcaaaaaacataaaaggtagcaaaacctctgatacaccagttccagaacaaaactacaggactgcaaggttaatctaggacattcactgagaactttatcgttacagaagatttaaccaacctgatccctgtctggaaacgattcgtcctcctgataacatataatatatatcagagcaagtcactatcaccaataacccaccagtgaaatatgcgagatataaagaaaatttaccacctcagcatcagcaagtgattcgtcatcatcagaatagctcatgtttgataagagtgtctacaaatgaatgcaagcaaaatatgtaaagaaactgtgaccagctctcaaatgcatcagaactaattataaagagggaaagggacagttactgggattaagcgtggcaagaactctctcaacccctcaggaggcatgctgacatcacagtatgccgacctagatatgcaccatagttacaacttcaataaagcattaatcaacataaaagaaactactgcctatatcgcagctgatgatagtttatttaaaatcagatggatgacgcctaataaaatgtgagcataacgaactactgaaattttaagaataagaacaagtagttgacacatagatatggacacaatatagttttgatatgcatgctggattaccatgtttacaggggacataccagaattcacaagcctcgagagcaacttcatcatctgaatctttattagcttgcagcatcaattcggtaacatttttcaaatgaggctgcagtttactatccaatgttagatccagcataacacaagatataagcaattgaaaaatctacaaatgaagatcaacaaccccagagataaacaagcaaccctagtcaacgacagttgtttatttcttaaaaaaatgaatagcatgaaatctgagctcaatagggtaacttcacggactacttaatgaaaaaataacaaaaatcagtgcaaagtaaaccttgcagcagggcatcaaaagtattgtgattaaaaacaaacaaaaagaaaacaacagatattggatagtttctgcacaaacataaacacaagggaaattaaacatttcattgcctggctacaaaccagggcatgagctgcaagtgaaatgtgtgtgtatgtggcatttaatctggtgtgaaatatttagatcttaggatttattattttttaaaaaaaatagaacttatggtaattttatttgagattgctgaaatgcccaggcaatgtgctagttacctccaaaattgatggccttacttcaataagctgaacccaggctgagcaaacctatcaaagagacaggaagcagaactatatcaaggtaaaacatgcaactgagcaactgaatagtacataggagcatctatagatactcactgtgctccctcctgtcataaaaacatgtaattttggacatgtttcaagtaaaactttaaaactttgaacatcaatgtctttttaaatattcggattagccttcactgcgttatagttttatcagggttttcaaatgatccccagtagaaatttatctgtcgaaattgcatttttgaagaccatgtccacgtcaacgtcaaaaacaacatgtttttgcaaccggagggagtggtcagctagaaaaatgaactcataaaaggatgaaaggaaatctaggtaggcctcattgttcttaaggggtataatcaagctttcgttattccggaactagaaagtgttctgagttttatcttattttggtttaatgtggatcttgtgggatgctctgtaaattgtgtacttctatacactaatataattattttggttatatttccataaaagaaagtagttggatagcaacatagtgtaatttctctatggtgaaataccagtttccgaacatctgctgacggatcctttgcaaggttgaataaaccctgaagatactgatccatcgacatgtacaaagcctgcatataaatgaaaatgattagaaaaattgttaagcaaggtaagacatagagagaggaggggtattcttactgctggcatgaccacgatgtactgattaatacagcccagagctagctttctaaggattgcatgtgttgattggaaaaactgaaaaatcaattgagcagactgttagaacaaatgctgcaaacatgttgaccagagtgtgcaaacatgtatacacctccacagatgcatgttgtgaagagaataagcattcagatggtgcacataaacagatagaatttatgattttacagattgtggaaatgaaagtacacacaccatacaaacctgcagtaatcttggcatgaatacattgattggccgttcaggcaaaccaggaacatcaacatcaagctcctcaggaacatcctcacagatctgtagaaaaacaagtttttgagcatgcaaatcatgttcaagttcacatagagtattcatgctacaggttcgtactgagttactgcttaagcacgtagacaccaactgttcgaagtcttctatgtgaaaatcacagatcaggctcaaaaatatgagagagaagtttaccttgtatatagcatccatagcaccttccatatgatccagatcattactgtccaagcattgatgtagagcttgaaacaactcgatccatccagcaactcgaacaatttgaaagagtacactgatgactgttccgactgtggatctgattgccttattggttgcccctatacatggcaacaactcagactttacgtactgctgggaagcaggaggcatggagctgaaagtagctcggaggttgtttttcagcagaagtccagcagcttgcctggcttcaaaagattttccctggcaagagatttgactacacgtcagagaagacataaacactaggaggttatagggttataaccgtatcaagattaaagaacacattttattccagaacaaggctgataatctgcagagttcttacaaggctaaatctgcatcaggtctacagtttcctagcattggttggccataaaaacgaaaaatagtatttcaaaggttgaaagaaagaaacaaacattttaaaaattttcatcctaccttgctgccattgtttagataaatatcatcccaactgtatgtgtaattttctagagggaaggagtggatatagaatcatattgaatgtattatttattgattgatattgatgaatcaagaccgcactactgtatggtgcacgaacaccttaaaccaaaacaacagtattgcttcaattcaatctgtacatctaattagggagcaatttggtttttaacaggtgtccacccctatatttaagctttcacgtgatgttgcctagttccataaaaagtaaacctcactaaaacctgaggtcatttcaaatacgttgcgctacgggctgacctatgacttgtcacaacagcaaataatgtgaggagtaatctaaaaattcggaggttgtactttagaaagcatgtatgacaagacggggcatcgcagtgacataaacgcatgatttagttgctgctcatttgcttaaagaaaactgaaacccttgtatatggagacatagcagctaaaacaagaaggcgaaggagtgtgcacgggcatgtagggttgtgtgagaagaaacaaaatgaatttctaacatagttgtaagcatgggcaatgtaattataatcaaacgcagtagataagatgaaacatgtggaagtatctccgacgaacagacaccacgccattgaagaggtggtatcagcagctgagcatcgaaaatcccacccaatcagcagtggcgattctacaacacgagtaacttctaatgtagcaaccaaccgagcaattggagcttctaatgtagcagtcaaacgggggcaaggcaagcaggaaaaaaacagtaaacgataagaagaagcggcgcgattcagatcgagagtaatcctgcagcagcgttagaggcaggggtatcgcatattcgcatcggtgaaaaccctagcgaggggggagttggggatggggaagggaagaggtagagtagatgatggatgacctctccgcgggcgaggaggaaaaccaagtagttgttgaagtcagggaactggctgtagtgctggagctgctgccagatgcgagcctggtcggagttgggggagatgtgcgcgtcgaggagggtgcagatctcgcggaggccctcctcctgcggctgccacagcgccgccgccgccgccatcgccgccgacgaagctgcgagtcgagaggaagaggaagaggagggcgaggcggcggctgaggagaagacaactccggaggagaaagggaatcaatcaattggaggagtagtatttcccttcccttacttattagtattactgtttgctcctccaattttatctgctactccatttttcttttaccttttcatttaccccccccccccccatctctcatcttctgattctttctctaattttagcatccttgattaggggtttattatgtaaactaatggtgtagaaatttacttaggctactttcgatttgcttggttgaggtgcaatttaccattgaacagtttagaaaacgtgcccataataaataaggttgtttcacgacgtaaataaagtaccgaaaatggagccttactctccaataattggcttttatacggaaacgttaaatggaaataaaagaaaatattattttcctattaaatggaagacccatgcgcgcacgcgtccacgggtgtgcatcctttattacaaactcaaatgaactgaggccaatgatttatcggttcatcagtatgtcatcttaaccatcgtagtgttgatgctttgcaaaatacacatattttaattgttatcaatatatgccatacgtgctggagaattaaggtcattctcaatgttactccaagaaagaaggtaattccaaaaaaaatttataaactaggttgtttatttttatgccaaaactttggctaagtttgttcaaatcaaagctttttattgctttgccattttagtactgaccattttttccaacaaacctatgggtattttggcattaccctttttttctattgctttattaggcattgaacaagcatgcacaccctaaaatatcaacccgattgaatgaaaataacattgttattaatttctgtcaacctacccatatatgtgcgtggaaataaataataatggacctcctttgttgtctttcatttgctcttcttttctttcatatccatgacacatagtactgcacaatggcaccacatatcagtgatacatatgatgatggtagttttgaatccaaaattttaaggatggcactaagggcctgtttggtacagctccagctcctaaatttaactccaggagttgagtctggagtggagttgt

SEQ ID NO: 49629 - DNA, 11979 bp, Oryza sativa
ttcaaattattaaatgttatagcatagaagcttataatagttaaattttaattattcatatactaataagccttctcatcctgcatgcgttaaaatctccatacgaacctatggaaagaatgcggccttaattaaggtgctctctctaactgagatgaatattgcactgatctaatgggttcaaacaaatttacaaattgtacgcccaataattaagttggtagtggttagtaagaaaataataaaactgtatattgattctccctactgagagagagagcttcgtataagttggtcaagaatagtcccataaaaaagataaatcggtatagtggtattaatatacgtatcttaattttgttttttctcaaaaacatagtataaacgtaaacattcacaacgtgtgactccgataaacgcccacacacacattatactctaatattagtatattaaagatgagcacgcacataattggtgttgcctgtgtatatccagctcgatggagatgattggagtactgggtagtagctggctggccagggaggccgaccggaccaactgcatatgcagcatgcttttcattcttgatgatatgacaggctcagcatgtatagcattataattagaggaaagcgaaaagggaaatggccgaatttcgcagcatgattgggtccaagcatacgtccaccacccatctattctcatactcctgctgccgcgctgtgttgttggacaatgctgttggttttatatattccgctgtgtgtgtgtgggtgggttcatgtatgtacacgctgcaattctgcaagagcaacgcaacaaaaagaaactcggagcaaaagcagcctctcttttggcaaaaggctttcttgctttgctttgctttgctcgtaatactgacagacacacacactactactactactacacgtgagattttcctgaacgtcgaccccgttagcttccaggtgggccgtaagtggagccgaaggccggcgccggggttagggccgcacgggataacacagtgttacaagcaaccgagcttgacgaacctatgcggttattacatgtgcgagatgcttagggtctgtgggagatacagaactaagggtatgtgggagatatagaactgagtttacagatgtaagtcctcatgctccttagatattgcaaatatttcatttaagttgattgtaacacaaatcatttgttttttactttccatagctcccgagcatcccttataacgcaagcccgttcgatcagaaaacgcttatctacttatgcgcggacttatgccggttcattcgtcgcgacacctacaactatccaggagagttccatgatcctcatagctaacttgctacggatcccaaattcaagaacctaatggagcgggagagggaacatgctatagactaaaatgtttatttgtcgcgggggatacttgtaatattacaaacactatacattatatgtaatttgatgtttataactgagctcggtcaattttcggctaatttttcatctattatcccgtgtggtcaaattataccggcccatgggataataggttaaaccagacggctagcatgtgctagagcgacggcacgaattatcccgtgcggtcgccttagcacacgctagctgaggggataacctattatcccgtgcgatcgtccttattacaccgcacaggacaatcaattattccgtgcggtccgtataacccgaccgcacgcaaaaatatcgattttcccagacgagtggttgcaggcgggccgagcgaccgcacgggataatatatccaactacccggaaaaatgggtattgtagtagtgacagtcccgcagactgctgtccaattggatccacgaagcagagcacgcaacacaaatattagaaagtcggtgaatcaaatttaaacaattttctaagaaatgataataaaaactattttttgcaaaaattgaagcttggaaaaggtttatgcagtaatccataagaccataatcaaataaaaggagactgggggtgggtatgcagatgcgatggtgtgttcgttcaaaccgatggagttggatttccgcggcacgcgaaaaccagagtcattagcatataattaaccatataactattacacacttgaaataaatatttttaaataactttcatgtagattttttaagaaacacactgattagcagtttgggaagcgtactcatggataacgagaaagttgcacgtcaaaaaatcaatttataaagactaagaacatctctgaaagagttgttatttgactcttaagccaaaaaatgacaattttagtgaaaatatggtttacaacaaacttaccgatcgaatggccaagctatctggctaaccaaactcatccagtagcccaatttggatagccaaattagcttgccaaacgtgtaccctacaccggtacccctatctctctctctcatttctgcgcttcctctcctatccctagactcctcacgagcatatgtgccgacaaatgcacttcccaccatccgcaaagccgctgagagggtctgtcatccattgttgttgccccccctctccccgaggtaacctgttgccgtccaaaaacaaatcaccgcaccctttcttccattgccacgacgccctttccctgtcgcgcctagcagcagtcgctaaccatgccgaggcctgccactcaacccacagcctcctctttccctgtcactgtcgctcaagcaagtgagatccatgagacggtggggtgatatcatcatagcagagggagtcaaggccgacgaccactctcgtatctcaaggttggcgattgcttcctgcctagctctagcgtcgctgtcgtcggccaaaaggcaagagaaaatctctatcgttgctctcttctatgctgcctacctcgctctctccggtgctgaccacctcaggccaccccgctggcgtcggtggcaatgtcggcctcttagcggtggtgggtggggactagggaggggagaggaggggttgcacatagaaggagagtaaggaagagatacaggctgacatatgagatctgttgttagattggagagggtattttagagtttgttggagcgaaagataaatgtaactctttattttttttatcgattttgctatatatttgtcgataaattttctcccaaaaatttgacagatgtaattacaatacaatcgtagtataattacactgtaacttacatgtaattatactgtaactataatgtaacttgtatgtaactttcaaaaatctctccgtgatattttatttcggtaaaatagaggttgtgggaacaaatccttatacatatgtgtgtgctgtgattttatttttcttcctcaccaaaacaaatcttgtaatagatctaaagattcaaaattacatgaaacttatatacaagtcacactgtagttacatgcaagttacagtataattacatataagttacagtgtaattacactataattgtactataattacatctatcaaatttttagaagaaaatttatcgacaaatatatagaggtggtcttttttttataagctagccaaatgaagtagatatttctagagccaaatttgacaagattgttggagatgcgcgcaaacggccggcacacgtacggacggacttgcatagcagagcagcatgtagagagaaagcaggaggagaaagtgcgcgtgtggcgctgggatttatccctttctttttcagtcgccggactttttatcattccaatccagtcatctcctcttcttctttctatctcaatttttttttcttctctttctttctttctttctttcagctggctgtacaggggggatcacattgggatgggaccttttttttttttggagagaaagagctttcctctacccctccctgtactccactccgtaaagtatcagactatcagagagagtatcagtcaaaagtaatcatgaagtagaagtactcgcgtatatactcctacttgagtaggagaagaggcaagagcagtttactcctagattagattatagtgtcatggaaggaatccttcatcaagatactggagtacccaatcgatcgactgctttatttgccgtgcggaatggaagaatgtagttactccgatcgaggatgtgttatttacatgatgcatcatcaagcaatcaatcaaaccgcaatctcagaattttctgtccatacaatattcacattaggccggttttaatataatttatttattatgtaaaaaatatatatacatattgtatcgtgagtattaattacagtattttactagtggtatgaataataataatcatgcatgatgatgatttgtacaaggagaaaccggagtattagatggtacaacaagcagcaggggccccttgttggcgtttctgtaggcgtaggagcgcgcgaagcagaggaacattgccagctccgcggcactgacgccggcgagcagccagtagaagtagtcgaggtggcctcggttgagatcgtcggcgaaccacccgtcgccgccgtctctcctggtgatgccatccagcgccgatatgagcgcgctgctgatgaagccgccgatgcccatgacgctgtagtagagcgccagccccaggctgcgcatcccctccggcatctcgccgtggaagaactcctgcatccccaccaccgccagcacgtccgccacccccatcgccacgtactgcggcaccagccacgcccagctcatcgccggccgttgctcccgcaccgtctccagccgacgcccctccaccgccgccgccaccgccaccgccgccagcgacagcgccatgcccgtccccgtgcgctgcagcgtggtcagccccctcgggttgcccgtcatgcgccgcagcattggcaccaccgcgcggtcgtagatgggcacggacaccatgatggtgaccggccccaacgtctggagcgcggcgggcgggagctccagtccggcgtggccgatgtggcggtccagcgtgcggccctgcttgttgaacaacgtcatgatctgcgcgtacgccacgccgtacgccaggcacgtcgcccatatggggagcaggcgcagcatgcggcgcgcctcctccgacgactgcttgtagtgtcgtagcgagagcaaggggctggcggcggcggaggagaggcggtaggtgggggtggcgaggaggaagaggaggaaggcgcaggagacgacggcgaaggggatggcgaagccgacgccccagctgacgttctcctggatgtagctgacggtggcgatggagacggtgatgccggtggccatggagaagtaccaccagttgaagagtgagctgcgggaggcgctctccctggggtgctccgggtcgaactgctccgcgcccaacgccagcccgcatggcttgtcgaacccctgtgccaaggccaccaggtacagcgacacgtacaagatgcccacctgtgacttggacgccaccaccgacgacgccaccgtcagcatgccgtacccctgcactcatgtcgatccaactttcaatttgctttcaggtgtaacgacactagtaccacataacgtaatttcacagttgaatttgaactgtaagtatatctttcaccaatcaaatcatttttgccgtttattttaagcatgtatgtatattgaaatagtagtaggataaggacgagcatggtgatggtgccagtggcagtgtttaatttgattgctgtcagtgtcaaatcatcggattgaccaaacgagggagcagatcagatactctagctaggttaagggcataataatagtagaaaaaaccgaaccggtacttgaaccgtcgtggctgctgggtcaccgggtcagtggtccaaccgccggttcatccgggtcaattgcagaaccggactactagttactatcatatatatcatttcactcggtcatctaaacaagtagcagtgtagtccaatggtaacgcgtgagtgtttgtaaccaagccaaccaggtttgatcccccacagagcatattttttcacatattcttctaatataaataggtattaggccttaccagctaatgactttgggcctacgcatgccttatctctttggcccactaatcgaaccgccggttcaaaaatcagccggttcaccggttttcgacaaaaagccgtccggttctcaccgggttgactgcatgaacggtctttgaagcaaaccgaaccggcgaggtccctggttcaggttttttccggtcgaaccaccgggccggtccagtttttttttactatggttaagggtaataatggacgagtagcgtgcagtgctggttagtaattaattactttttcggtccgaaaatatatttgaccggatagataagttgtctctaatctacttctaatttgctatactaatcttctactttactcctcggtccataataaatcaacttaatatgtttaatatgtttagattcgtagtattaaaatatgtcatataataaatcaacttaatatagaatgtccccgtaaaaaaacttaatatagaatgtgatatgaatctggacattcatatgtctagattctatattcgttttttatgggatagattgagtaggtttctatataattttaaattttattgatgaatattgcataggttttgcctctgcacgtctctactagtatatgcgtatgtatgtatgtatgtatgtatgttctatattactatactggtggttgagtaatgagtaggagtatactcctagtagtggttggaggagtattagtagcacaagtatcacatggcagacaacaggctgttacgttccattgattagagtagtccattggagtattattcatcaagaatactaataactaaggtagcgaaatgtaaaagaaacgagtaataacaacaaggcaaatgataagtgaaaaagaagaaaaggggtaaaattggaaccaggaggtaaagggtgcaggcgaggaggatggatgggtagcggccgaggaaggagtcggcgaggaaggcgccgaggagaggaagcatgcaggccgcccccgaccaggcgttcaccgccgccgccgccgacgcgttggattgccccatcggccccgtcagatacgtgatcaggttcgccgacacgccgaagtaggcgaagctgccggccaactccaacactgtccatggaatgaattagctagcctgatcgatctatagactatagctatcctgcctcgccggactaaaatgatgaacagcatacatatacataccggcgacgaagagggcggagcgccagccgcctgaggtggcgcggtaaacggggcgcccgcggaagtcggacacgccggggagcgcctcctcctcctcctcattcggaagcaagggacgaccgtccatcgtattcggattcctcctcgatcgatcgctttgcttttctcttcctttcctttcctcgctgaatcggtgcgctctgctctgctcgtaggtaggatgatggtggcaactacaaatcggccaattgaattgacaaggctcagaggattaattaattaatgcggcttgcttctgctcctgctcctgctcctgctccagttgcacatggccaaatcaaaccatccaggatccttcccttttccaatcctcttctgatggtgatgattcggatggagatatttcagaccaacgaacgagtccacgatccaccacaaattaggcataccagacgacaagacctgctattaattgggcccgcgcccatcccatatcatatggtaactttaggccttcagcccaataataatcccatcggacgatggaaaggcccacagactagatacctcggactacacagtctgtcactaactctctataccttccttccgtttcacgaagaatcaattgcttcatccatcccattttaactatgattttccgtgtttaactttaatcgtccatcttatttaaaacttttttttaaaagaatggtctatttctgtcatctcctttaccgaaagcagaatatatggacaggctccgaaagattaattaatttcagtataaatgtcaatgtcgtcagctcccaacaaagattaattccagtataaatacccataccatgcataggtagctaactagcaagctggtatcatcttcttctacttcctacttcttcttattgtgggttgtggcatatatataatatcccagtgaacagtgaaggatggaggaggagtggtgttgtgtggcgccgggattcaggttccacccgacggaggaggaactggttggttactacctggcacggaaggtggtcgggcagcaggacgacgggatcatccaggaggtggatcttaacagcatcgagccatgggacctgctgcaagctcagcagcatgatcaggagtactactgctacttcttcagctacaaggaccgcaagtaccccagcgcgcgagggacggggacgcggaccaaccgcgccacggcggcgggcttctggaaggccacgggccgtgacaagccggtgctctcctcctctcgatcatcatcgtcgccggcggtgatcggcatgaggaagacgctcgtcttctaccgcggccgcgcgcccaacggctgcaagaccgactggatcatccacgagtaccgcctcgtcgcccaccatcagcagccggacggcagctgctgggtggtgtgccgcgcgtttcacaagcccaccaccaccaccctgcagcatcagcttcacctgcacaggccgcctcctctacttcatcatcccggctattacgccgaacaaaatttatatcctcctctcgctgctgctgctggtggcggcggcttgctctgctcacttgccttggacatggagttggaggacgaggaggatgaatccaagatgatgatcttaagcaatgataatattccgctggtggtgagtccgactgccgtacacacacaaggcaccggcggcgacattattaacgacgctactaccgcgcctgctgctgctgctgctgctgatcatcgtcgacaccttgctccaccaccaccacttcacttgttagctaattcagtcgattaattatattaatgagaaatttactagtaatcggatcatcatgcatccatcatgcgtgaatgactaccacgtattaattcgaatccatactctgtatcatcgtatatagtagtatttatagacaccgtacgttaattaattactgctggccgtcgacctgctacctatactatatattagcacaaaatgttatcagtgcaaatatgtgcatgtagtcctcctccatatacatatcagtacaaatacaaacatgttatctcttacagtatttgggtctttcgttcgtcactacccggccggtctgaatattaatttatgcgatcgttcaccttcacatatacggatgtagttcaccactacacgtacgtatatacatgtatctttgatcgcgcgcgcctttcaaaaagaataagaagaagaagaagaagaagaagaaggggagtatatatgtatctaagtatgttcgatcgatttccaggttaattaatttcatctcgacaaatgcagcagggctctctaccagtacatcgaagtatatttatctgaaccatcggtttataagggcataacaatatttactaactcagtgattagagttaatgctggtattcatgattttatcaattattttttaaaaagaaagagaagaggtttttatccttcatcaaatgatatgcttaatttatattggtctattctacaaccgtgttcaggaaaaaacaacgcatatggcaaattgcaaactgatcgatccaatgcccaagatctaattaactcaatggttttgatatgaatattttaccggagaatggcaattgattaagcggaacgtacgtatgttgttggctgcagcagaggcggggctccgattggggaggagacgaaacacggcgtcgacgtcagctgcgcgcggctacgatttgggaaaggattagcatcacgtacgtgtcgtcgtttgatcgttctggatggagcagtacgtcggtccttcttaattaattaattcatcctgtcgatcaattacatacagcacagcagtacacatcctctactagctaattgtgttgaactgaacgagacagaaacagcaccgacgacgtacggcttgccgggcgggcggttggaaatcatgattattagtcacctctgatctgattccaatggagatagcgaccctgaaaactctgcacgaatagccatcctcaatggacgcatatgcatatatacatgcatgatacacatatatgcatatgctcatgcacgatggcagaagacatggttgatcatctggtacagcggcggctggggcggcggccggccgtatagcagcggatcggatcgattggatggatctctctctctctctctctctacgtacggtggaggccggcgcccttgccgggaggcaatccatcccatctcccccctatatggtcacgtacgtcgtcttttaattaagtgccatccatgcataagtccatatctgactttggcaaatgcaagtgcagatgcaatcatggctaagctctccatctttgtatttagtagtagtagttgttacctttgagttcattgtcatatatctttggaaaatatgtcttctttgcatacatatgtgtgtacaaaagtcaactagtgggctttttctctctcttttttcggagctagactttaaaaataggatttggtgcgatataccactcccaacttcttgttcctgaaatacaattgtttttttatttaaaagtacaactaggtttgatatacaactcttaggaatccttcggaacacatgattttcaaaacacaggaatacgaataatataatatcggaatgtcatgccttgtaaatcctacaagaaatagaaatacaacatttttcaaaaacaaccgtttggatgtcgcatagaaaaaaaacataggaattgaagacaccagaagagggaaaaaaacacattccataagattttcaaaggaattttgaaggttctatccttaggattcaaattttctaaaaatcctccacttttcctgtgttccaaatgagtccttaacttctatccatagatacaaatgcattttgtattcaactaaattgattaatgcacatcaactcactacgattttgcagtgtaaatattatttgttttcttcaatcaatatggaaatttgtaggctcggaggaaatattgtaaattccttttgaccttagtatttaatgtccttcttagctcaacattttcttaaaggtattttgaaatttcgattttttataattaattgtaggtgtttttttaacttgtcttcttagaaaatgaaacacctaaaactataaaagtaataatcaaactagataattaaaaatcagctacaactctcccaaggatatatggggcttaatttagagagagatggaataagtccactttgaatcacttaactagtggtctaatcactacattctagatatctccaacgaagaatatactacgatgaaggatgtgaagcagattcggcaactaggttagtgagtcaaagtggacttattccgagagagaaacaaggttagggagtcacagtggacttattccgagagagaaacagaggtagcgtatgggccggtgacatatggtccgaaagcggtgggtagtaggtgggcctggcctggaagggttacgcgtccagtccagacgtaaggaacccttgctgatcgatcgtctccaacccaacaacaacaagaaacaggaatttcgatttctttttcttcccttctggaggcgtcctgccctgcgttcaccccccgaaatccctctcgattcgccgccgccaccgcctcctccgctccgccgccgctagggtg

SEQ ID NO: 49630 - DNA, 2585 bp, Oryza sativa
ttaccatcattcataaaacaacttcgtatcagccatgtatgatcgggccccttcttcattagtacctttcatttctacattttggaaaaaaagaacaatgtattccaaacttgccccacttttgggaagagtaggtggaacaagttgaatttcccatttttatctcacaagagtcactgtccaatagcggaggaaactaaactgccactaggaaggtcattcattcttcaatgggaaattgttcaccatatttcttgatgaatagcattgcttctaagattgcttccttaacagtgttatttccctgcagatatgcacaagaatgtgcgaatagtccatcgtacaataacacaaacgcaaggaactcccatacaattggcaagctggcaaacttgcttcgggtgagcactctagagttatatacactacatcatcataatcttagttttatcagcctattgcttaaattaatcattcttctctttaaccccattggcaggagaatgacgacttttatgagttagtgttctgtaagttcttatcagacaactcatactcggctgcagtacgctctgctgctgctaggctgctcctaagctgctattctgcctggacggttagcttttccctctctgtcaacacactaagctctctacatttcttctcatctccaactcggacaataccaacctttcatttttcattttggtctctgcagcctcagtatcctcatgcatttgaagatgctattgtagaaaatataaagaaatgggtgacagaagatggtggagcgtcaaatgagtgtgaatcgaagcatctaggaaagaataacaaaccaacagatgctgacatgctgcggacatatgccattgggttgcttgctatggcgctgtgtgggtaatgccatgagttttgtttcacatgtgattgcgtgccatcctttttgctttcaactatctctgccgttcacctaactgttgcttctttttttgtccttcccagtggtgggcagttggtagaagatgtcttaaccatgggggtatcagctaagctcatgcactttttgcgtgtgcgagtgcatggggatgttgcgtgtgcccagaaagattctaatattccactagataccaaacatcctcggagcagagatgagaacaggagcaaatcacgcctggttcaagacagttctcgattggatggaatgaggtctggagatggaatttcaattgacccaacttcagaaaactgtgacaatgttatgggaatgcggcatgcacatggagaacggtggatagatgatgctgcctctcatcgttggatctttttgatgcgatggaggctggtgcaaccaatgatagaacttatagtgcaagcatttgtgatacaaagtcaagagttggggaaaggctttctgcattgagacctggaagagatgaagagatgaacgaaaatacgagagatgatctgttaaagcggaagttgagtcgaacaggatcacgacttagggggaagagcaaagcaggtgaaagcttgcctgaaagtgaaagaacacctttatcaccaacctcaggattgaaaataggaactcggactagcagagagaagaatatggtgaggattgaggatgcaaataaggcattgatgtgaacaacagctctccaggcattgagccatttaatgcaatttccaaagaagagtatgaggatcggttcaaggattgtattattggcttaaaggatatatccgacattgttttaaaggctgtgagagctgctgaagctgaagccagatctgcaaatgcacctgatgagggtgtaaaagcagcaggtgatgcggctgccgagcttgtgaaatctgctgcatcagaggtatggaaaagacggtttgcattcttatacactgacaatttttctttatcatactatagtaacaatttcttgtttgtcaacatttctgaaggtttggaaaactggaaataatggtgatgcggttgtattagctgctgagaaagcagcagctactgtagtggatgctgctatgtcaactagtgtctcacggtaatggattaaatgctctctctctctctctctctctcacacacacacacacacacacactcactcactcatttggtctcatcatattctgagagtttgatttggtattgctgaagctctaaccaagtcggtgaagagcatgttgtggaagagcctgtgcaaatcagcgaggatcatgaattggaagattttgttatcactgaccatgggcagctcctacaacttagagaaaaatatagcattcagtgtctacagattttgggagagtatgttgaagcattgggtcctgttctccatgaaaagggagttgatgtttgccttgcattattgcaacgtagcattaaagaccaggggggacatggccactttacacttctgcctgatgtccttcgattaatttgtgccctggccgcccaccgaaaatttgctgcgctctttgttgaccgtggtggtattcagaagattctctctgttcctaggattgctcagacatataccgctctttctgcctgcttatttacttttggc

SEQ ID NO: 49631 - DNA, 5232 bp, Oryza sativa
ttgttgaccgtggtggtattcagaagattctctctgttcctaggattgctcagacatataccgctctttctgcctgcttatttacttttggctccctccaggtaaacactaacaacctaaattgcctgtctatgcagagttgatatgttatttcctctttgagttgctgaaatatgattcatgcttgcagtcaaccatggaacgtatttgtgcactctcatctgacacacttaataatgtggttgaactggcgcttcaacttcttgaatgtccacaagattcagcgaggaaaaatgcagccatattcttcgctgctgcctttgtgttcaaagctattctggattcatttgatgcaaaggatgggatgcaaaaagttctaggtattttacatggtgctgcttctgttaggtctggtggcaactctggggcattagggtcctctaatgtaaaccaggggaatgatcggtcacctgctgaagttctgactgcatcagaaaagcaggttgcataccattcatgtgttgcactaaggcagtactttagggctcatctgcttcagcttgttgattctattcgaccaagcaaaagtatccgtagtattgctcggaacacttctagcgcaagagctggctacaaaccatttgacattggcaatgaggctatggatgctgtttttcgtcagatccagcgggacagaaagttaggtcctgctcttgtaagagctcgttggcctgtgctggataaatttttggcatctaatggccatataacaatgctagaactctgccaggtgaagcttgtacattttcttttggtcagcaaagtttgttgtttacctattttgacccataacaatttgtttcaggctccacctactgatcgctatctgcatgacttaacacaatatgcatttggagttcttcacattacaacgcttgtgccatactgccgcaaactgatagtacatgctacattaagtaacaatcgtgttggcatgtctgtcctattagatgcagccaacagttttggctatgttgatcctgaggtaagatttttgttatcaaatagattaataagctcaataaattataaattataaatctgtaaaatgtggctgctgaaatcatctctaattaccatttgtggatcaggtgatctgtccagcactgaacgttcttgtcaatcttgtgtgtccccctccttctatcagtaacaagtcatcctcaactggtaaccagcaacctgcagctacccaagcagttggtggggcattttcagagaacagagacaggaatgctgaaaaatgtactacagatagaaatctaactgcaaatcagggtgaatctcgggaacgttgtggtgatggtaacacatctcaacagggcaatactgtgcaaattagcacacctgttgtgccatctggggtggttggtgatcggagaatatctttaggagtaggagctggtggtcctggtcttgctgctcaattggaacaagggtatcgtcaagctcgagaagtggtcagagctaataatggtataaagattcttttacagcttctcagttctcgaatggttacacctcctgtggctattgatcctattcgggcacttgcgtgtcgtgtcctgcttgggttggctagagatgatgcaattgcacatatactcactaaactccaggtactgttggtacaatgtccatctacctttttttcccctacacctctagctatgatttgagcattttttttagcaattggtcaactacattttcactgcataatcactagttagcattaatactgatggtgtactccccccactttgacatacttcttgggtcctttctttacatactgttcaaaacaaatagttaaatcttgaataaaattagtcactgctccttcatcagcaattttcttcttattgtttcaggtaggaaagaaactatcagaactgatccgtgataccagtggacagtcaattggaggagataatagtagatggcaaaatgaactgacccaagtggcaattgaactaattgcggtaagggacttgtattatttattgtgatgcaaatataattgctcaagagcttacattcgtagagttcctttcctgatttaactgttcatgatgtggaacaaggtggttgcaccgtgtagttatttggtattatttcctcaattaccatgaatgcagtgtatgtaagcagcttatacaacttaaattagtggttgtgtgttagaattaacttgtgtttccgcaatattctcctttttacacatggacaatatatatgctcttttaccctaattatgtattgcatgtgtcttgtgtcctgtaattatgactgctgttttattttggtaggtcctgacaaattctggaaaagaaacaaccttagcagcgactgatgctgctgctccagcactgaggcgcattgaacgagctggaatagctgctgcgactcctgtctcgtaccattccaggtttgactgctttatgattttgcttccattacttcatcagcttttgtgtctgggcatttacatttgtttttatttttggtggtgtctagggaactgatgcaactgatacatgaacatctccttggatctggttttactgctactgctgctatgctgcaaaaggaggctgaccttgcacctttgccatcgacagctgcagtgactcctgtccaccaggttgctgccctggagacatcatctgctcagcaacagtggccttctggtcgtgttcagggatttgtgccagatacaacaaaggtgactacagaccaaactggccagagatctgattctgtcttgccttcatcaaagaagaaatcactgtccttctcatccagtttctcgaagcgaactcaaccttcgcatctattttctggtaatagagcaagcaatagcctgaaaagtcctgttcctattgggaatgttgacaatatgatttgcgctgcttctactgtcaatactggagatgcggagacatctcataaaacaccattatcgttgccacagaagaggaagctagtggacatgaaggatcttagttcagcgtcagcagcaaagcgctctgcaatggttgatcaagcatgccagtctcctgtattccaaactcctgctcctactcgcagaggactgtcagtggcagtggattctcctactgcttcatttcattctggacggccaaatttcaacaacatttacacagagaacctggatgattttcaaggcacacctggagcaacaattaccacaccacatcacggtgcaagtgatcaacagccagtaaatttggagtgcatgacgctcgattcactggttgtacaatacttgaaacaccaacaccgccaatgtcctgctccaataacaactttgccaccactctctctgttgcatcctcatgtttgccctgagcccagtcgcagccttagcgcgccagcaaacatagctgctcgcatgggaagccgtgagataaggaggcaatttagtgggatccaaatacctcgcagggatcgccaatttatatacagcaggttcaagctatgccgtgtttgccgtgatgaatcctcacttttgacttgcatgacatttcttggtgatgcatcacgagttgcagctggaaaccacactggggaattaagagtatttgactgcaacactgcaaatatcctagagacccagacatgccaccaacagcttgttacaatagtagagtcggcatcttctggtggaaatgagctgattctcacgtccagccttaacgaggttaaagtctgggatgccttctcagtatctggggggcctttacacacatttgagggttgcaaagctgctcggtttagccattctggaacttcatttgccgccctttccactgatacgactcgtcgggaggttctattgtatgatgtccagacatataatcttgatctgcggcttcctgataactctggctattcaggaggccggggttatgtacaacctattatacatttcagtccatcggatacaatgttgttgtggaatggggtcctgtgggatagacgaagtccaaaccctgtccatcagtttgaccagttcactgactacggcggtggtggcttccatccagctggcaatgaggttgattttcttttcctgaacctttttgttattttgttagtttataattctgttcatttcagagcatgggcatcaagagatttactccctctattgcaaagtcataattttctcaacttatgaaccttccgctctaattccgtccttaaatattgttaaatgccaagcccttataattcataatggagagcaacttttgtacagaaagaatccatatttgtgaatttgtgttgtcacttgcccatgcaccatgtgctatgtgatcctgtacttaacacagctggctcagggccaagctatgatgttaaaccattgggtaataatcgggtaatggtttgcttgctcttgttcaatttgtttaaacaatcatgaaccagctgccgattctcacatttcaacaacttatgcagccaagggccattgctacccagccagtcccatttttcgtccagccacctgatttttggggtgtcgccttccacataaatgacctccataattaatctgcaagactgtttgggtagaataggagcccatggaagtaacataaatgaatttattttcctgattttgccactaaactgtaaattataattatctatatttttttagagtaatttgtttctggtgtgcttgtcttctcatctctgccgtccatactttgcaggtataataaattcagaagtgtgggatctaaggaaatttaagcttctgaggagtgttccttccctggaccagacagtaataaaatttaatggcagaggggatgttatctatgccattctcaggcgtaatcttgacgatgtaacatcatccattcatactcgtagggtcagacatcccctgttccctgcattccgcacgattgatgccgtgacttactcagacattgcaacagtccaaattgatcgtggtgtccttgatcttgcaactgaacccaatgattctcttcttggggttgttgctatggatgatcctgatgagatgttctcttctgctcgcctatttgaagttggcaggaagcgtccaactgatgatgattcagatccggcggacgcaggtgactcagatgacgaagatgatgatga

SEQ ID NO: 49632 - DNA, 1332 bp, Oryza sativa
cagcccagatataagttcatttttatttcagcttttgcactaatatgtcaccatgttttaattgcacgtttcctcatcgcaggacctcgtctgcttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggataggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttgggactaacaaaatatttgtacggtaacaatccaaatataccctaaaaaataataaaattgtattttaccagtcttggagattttaatcttgtatagttttcaatataaaaagatttgatagctattgatatttatacaaaaatatagagcacagtataaaatcgccctccccca

SEQ ID NO: 49633 - DNA, 29232 bp, Oryza sativa
taagtaataaatgttgataagcgaattactaacacatattaaacaagagtacaaacaaacaaaagtgtttagtccgaacactcatcacgataacattatgatacaacacgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaacactatgttgttatcggccatggacggaccaattttcttgtatcgatccctaaagtacgcttgcgtgccgggaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaactagtggtctgcgagattgctcatctgtttgcttcgttgtcaactcatccaacttgtcccacaactcattaaatttcttctcttggttctgtgcacagaacctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccacaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccataacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcataatacgtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatagcctgctcctcccttggttgattttcctcattttgcatcgatggtccaacagcatcccctgcattgataggaccctctacatcttcggtttgcattgaaacatttatatctttctcttgtaccgacacaaatataacgaggggccatgaccgttcaaaagccatttccacataccgtctctaagcatcagtgctgtccatcggcattagttcccaaaaataaccttctgttgcacgactcactacaactgacactgacattgtgtagacttcttggtctattctaaatcctctcaacaacaaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtgctacgccctaagttacattctctacaacattgttctctaaatttctaaaattacgttacattctccagatcaaactaaactacatctgtctcaattcatactattatattctatgctctggatctacacatatgtgctgtgtgctacagatgtgctaaaatatatggaactaaaactaaaacgcaacatatatactcaaacataacatattagtacaaatgcaaaagatgtatgggagcatacatgtgatgaattagcgaaccagcagggcttcgccgctccccttctgctgccctcccctctctctctttcgttttttttggatttttagtgaatataatgaaatttcacagaggaggggctgggctttataggggggaggcaaaaatcgccctcccccagggcggcaagggggccgcctgcaaaattccatgccccatcgccgcccatttgcaggcggccccccccacagtacaaaatcgccctagcggagggtggcaagggggccgcctgcaaaattccatgcccccctcgccgcccatttgcaggcggccccccgcacagtataaaatcgccctagcggagggcggcaagggggccgcctgcaaatttcgttgacggctgtcgcccgagagcgaacggccggctgccacgtcattttcgccgccctctgggagcccagagggcggtaggcgactacttccgtcaattttcaaaatggaaaattatttttgtaaaacttttaataaaaaaaattataaataaaaaaaattcgagaaaagactagtgtgtgtgggctgggctagttagtgtccgggactgcctaaaccgtttattgggcctgtaaggactactcctactaattaaaaataaagttcacttcaaatcccatatcgtgtttcaatcgcaatccctcgaccactgactgaactagcagcagacaccattaatccttgccattgacagcggtgtgggaggacggttgatgcattgcctccactgcctagtaatggaggatgcaagtccatgaaaaaaaaggagatagatgcgcagagggaaggggtgaggaatggtaggaaaccttgatagggtgcatagagggggtgtttggatccagggactaaactttagtctctgtcatatcagatgaatttagagtattaaacatggactacttataaaactaattacataaatgagagctaattcgcgtgacaaattttttaagcctaattaatctgtaattagcgcatgtttactgtcgcatcccataggctaatcatggattaattaggctcaatagattcgtctcgcaaattagtccaggattatagaatgggttttattaatagtctatgtttaatatttataattagtgtctaaacatctgatgtgatagggacttaaaagttttagtcccatttaaacagggtcagattctcctctttaaatcactctcctcactgtcacacacacaagtggaacccagggttcccaacccctctccatcatattccgcgtacacgcttttcaaactattaaatggtgcgttttttataacaagtttttatatgaaagttgcttaaaaatcatattgatccatttttcttaaaaacaattagctactacttaattaatcgggcgctaatgaactgctccgttttcctgcgcccactgttccggatgggaactgccagcagtgaacacggtcagctgatgttggtttccactgaaaataaaaacaagaaaaatcattagtgcacgatcaatctaattttaattattaagagttaaaaattgtatttgatattttaaaagtaacttctatatagtattttccacgaaatgtaccgtttagcattttgaaaaacatgttaacggaaactgagataaattttgtatattaattagaaaataactggttttattgttaaaactccctctggcttaaaataaattaatttttcacgtactcatctcacacataccaatacaaaactaaaactaaaagaattagaatactcctaatttatcaaatcccaatgtaattaattttctctttatctacaattaatgtatttacccttagaaataaatttattctaagataaatggcggaagcttaaaaataaaacttgaagtattttgagacaccgggagcagacgatagtgggtttcctccagtccactcaactcaacagcatctgcacctgcacggctgcacgtacggtacgggcgtgttggagtaaaggaaggctgtatggttggctcgaaacaccacaactccctccctttgctgccgtctccaagttgtagccatttgctttatttgctctgctctgatcggctgctccaacaacaaaattcaaccactcgactgtcatgcttttttggtcccaaagagcatgggcaaaaataccattctcctgtgtacaaacagcacctgagccaaagccttgagaagacatactagtttcagggcttgtttgattttgaatgttgatgactaacgttgccacaactaggattgctaatggtatggcttaccacatgaagtgtgactaaccatcattggtcacaaggagggtagcaaagctggacaccagatcaagtgtatgacatgtgggacagcccctagtagttaacggacgggatcatgcatgccttggcaatgaattttcatactgccactcgatcagtcattaagctcatcgatcgagcccaagaattaacaataagcccactgctagctctagtatgcaataatgtactcctccttcagtagaagaaactaacaaacatctatctgattgtacaaattgattgatacgctgatcactagtcaataccgatcgatcgatcagatagtacaataatcagacattaacgatgaattaattaattataaatgggatcatcatcatcatcgatcgatcgattgattacatgcaattaacgaagagtgaaggaaatgatgctagctaagattattattattggttaatgatcactaatcgatcaggccctgtagacgacgacaaagcaagggagaatggctgtggggttgaagacgtccagctcgtccaggttggagtacagccccggcgtcgtcccggccaccgagtcgtactcctcctcctcttcctccgccgccgccgccgccgcctcctccctcctcacccggccggcgatcacccggcacaccagcatcgcccggcggtcgccctccgacccggacgagacgacggcgtcgtgggcgcggccgctggtggccatggtgcggatgccggcccccggcgcgggcggcctgaagccgtggcggatgatggcgcaggcggcgcaggagaggtggtcgcagaggtgggtggcgccgtggaggccgaggtcgcaggagagggtggcgcagtggaagcggaggagctcgttgccgtcggcggtgcagcgagggtggcggtgggccattgctttggccttgacggcggcgcggtagtcgtcgaagcgggcgagggtgcgggcggcgttgtggaccttgaggatgcggtcgatggcgcacacggggctctgcttcttcagccagctcgactggaatattatcgatattatgttcctgctcgtgtcctccgcccccagctccgacactgcagtgcacgcattccattcattcattcatttttcacattatagtgaattattttgttgcagcagcagctaaattaagcctaacctaattatacattttgctcatcatgcatgcacactccaacaacaatatactgctagtggtagtggctagtgcattcttcattcattctgttctggtcaaaatgaatgtactagtagcagtgtccttgtacagtactactacgagtatatgggtggctactttgcacttgagatttgacagcctgaaactagtatatgtgatgatggtgtggtgtgtgccatgatgaaaggaaccatgcaatcaatcttctccacccgcctgagcctgtactacactcaagttaatatgctgtctatagctacagagatgattgagagcgtgaaaagcagctcctagtacaaggaataaagctccatctcactttcagcaccgaccaacattacaattaacctcattcaatctgaccgcccagtacaacagggccaccacagctacttttatagctaagcacgagtaattttcaaggatatatactcgctcatctcatcacgatatctcatgatgtgatgatggtcaggaaataagactgtacatacatattgtaatgtataccaccaacttaccaagtgtggagtattactctagtacagataacataaagaatgcagcttagtagtctaattagctatgccaaaaaaaaaaacagggagctgatggagggagaaaattaattaattgaagaagggaacgatcgaacaatatgcaactacgcaagcaaattagctggtaattagtaagattaatgatacttcagtaattgaagtggagataataacctgcatgcctgatggactggtggaggtggagggagtcgggcctgacgaagatctcgccgcagtcggggcaggagcagatggtggccctcatggaggagctgtcccggaagacgccgctgatgggatccaccaccatgtggcactcgtagcaccccgacagccgcctcaggctcaactgctgcatcccccggaacgaccccccaccacccgccgtcgacgaacacgacgacgccgatatcgacgccgacgactgcaagctgctgctcgcctcctgctgctgctgcttcactgacttcttcaccgaccgctcgctgctgatgttgcacgcgctcaccgaagctctgcgcttgcagtacggctcggcgaccggcggcttgtccttcaccttgagctctcctccgccctgcgcatgtgctgctgcatcgggttgtcttgcttgaccttgcagatggaggcggaattgcagccgagcttcttgccgtcggcggcgcggtggtggtggtggccggcgtggctgctgctgctgctgtttctgcacgagaagaggctcctgagagctaacctgtaggaagggctctccggctctgtgcactgctgatgacggctctccaccttgcagcactcgtctctgccgctgcttctactgcacttgtaatccacctgcttcttgtctttctcatccaccttcctgcttgctaccaccagcttcttcttcttcttcttcttcttcttcatgacagcggcgtctgagcctgcagagcttgaggctgaggcggtgaccttcgtctcccgcgctctccccggttccaccattgctatcctttttgctagctcgtggagtgaatgatgctgcttcttagcttgttgcttccttatctaaagaggaggtctcggctcggctctgttgcttgctttttgctagatgctcttgccatgcatgctgctgaaatgtctttggaggatgcaaaggaaaagctctccgaattaagatagatggaggtaaatggctgcctgcctaattagttggttttgtacgtcaggttaactagaggagtataagagtgagcagtaatgatgttttggacatgcacacctctctcatgtcaggggactagcatcaaatcagatcatgcatatgttaaaataatcttgtttaagaactccatccctctcatccgtctcaaaatataaaagattttagatatcagatttatatttttaagatgtgtcatattcctctaaaatctcttatattataggacaaaggaattagtgagtactccctccatcccaaaatgtattaatctataatgaattggtatgcatactaatactaaatttaatagatctcttatccagatttacattagtagaataagtttcatccagattattatattttaggatagaggtagtatattttatctacctatctgcagttggaacaacactaggagacggatttttatcccttgaggaggtatctcctttatttctcgcatgtcacctaaatagatagaaaaaattaacatcatatattaatatgaaatatgtcactccacaaatatacgggactaaattcaacttctatatgttgcaatcgaaaggacaaattaaagtgaaaatggttaacgtacatcgacaattattgtagaagttgaaagcagtgatatatttcatattattttatcttattatttttaaaattcttttgatgacatgcaagaaataagcgactatccactccaggaatgaaaacactctccccacctaataacgtgctgatacgatattagctgacatttgttcgctatacagtcagtggcttcttgtctccaaagcagctgctgtctctttttcactccttcctacttattggataatgattggttacgttgagccatgttgttgttaagggctaactagaacatgatgaaagaacaaaagcatagcaaatattcttgcgtgcagagtagctgcgctcatgcatgttgtttgctcaactgatcgaatacagcctcgatatacgaacctagctcaagaagctggatcatatttgatactactagaaatcaaaggtggtagagtgctgacagttttaagtttgggatttatcatttatgtagagaagatgctttttgtctctgcatgcttgcaagggtcaagtgtgttaagttctattgtgtgtttgtatgtaagttgccgacaaactgaaggcgggtcaagcaggccgatggtaaaaaaacgacaggacagcgacgccacaccacacgacgacacggcttggacggggatccatcggagcagcataaacacagagacatacgcatatgctcacgctttggatgttgctggagcagagtactactactccactccatttgtgcagttcaggtgcagagctagtggccatggcagcggcagttgcagcatgatgtctatggatctgcatgctggaaagaaaagaaaaaaaaaaggagcaacacaagcctagaaagagagagagagagagagagagagagagagagagtgatgttggttttggtgattttcgattaaaaggacagggcagctgggcagggagggggagagggagcattgttgctgcattgcaattgcattgcattgcattgcattggggtccgtagaaagaaaaggctggctggcaaggcatggcatgggggcctgggagatgcccatgctggtgctggctgcagcaaccgcaagctgcctatagcagcagaagggaggcacttactacagtaactagtgtgatttactactccactaccactagacactatagcggccggcacggctgcagatgagatgaggcatcaacatcaacccggatgcacggtccgcctgttggaaaggaaataaagaataaagacgaccaaactttttttaaaaaaaagaagaagcatgagctacatgaagctagtagtaacatacagtacatatctgggactgagctgtgggtgtggttgctgcatttcttcatacaagaatacaatgcatgcttccgtagttccgttgatactttatgcgtcactcacacgtctgtgagcctcatcgctcatcgtttgtcctatggcttataagccaaaactaaaatttaaattttaaaacttaattttgaatttaaatttgattctttttcaacatagttttttttaactttagcttttcaatcactaagaacatatacatacaagatttttattcacatatcattttttaatcactaataaaccattatgacttataataaaactagaccaaccgatgaagatctgtctttatatctcgagttaacagtagagttggatatagtgctttctcacagacacacaaaaaaagcatacatagataagacgccgaggcggttacgagggtatgggggtgtttacaaaaacagaaactgagtagtctcctaacggaggggaaaagaaagataagctaggctatgtgcctaatagtccctcgaaggattggcaatcgcctccacccatccaccaattaccttccttcttgtacgatctgtgtcaccaccatcggcacatgtgacagaactccgcgggcattcctttccttctacaagtggcaggtaatcagaatgacaatggagtcgaaacccttcctatcatgcttgtgcaggagacgctgcgaggtttgccagcaatcttggatcattgcgtggtggtttggcgagagattagcgagtccgatcaaggatagcaggttgcaccatcacttgttcaacgaagacgcggtggacgataatatggttcacgctcagaaggggcacatggagtggctgtccattctcttgtcgagcaatcgatcgattggcctcgttgcagcgccaaccaaagaaaaatctttcatttggtcagcctgctgctgcatcaaaaggtttttggcataggagaatgaatggagctaggccaaggaagaaggtttaatttgtaggtcgactgatcgagctgaatatatatgcaccgccggtccagcgccaagcgaactcatcttaattcggtgttgtgaactcgatccaatatccgcgggaattgcgcgatcggactcgatagtgagcgcaccggtgatgtcctgaataatctacgttgatggctgaaccggccgggctccagggacaccatgcatgcatttaaccagtacacaagaaagaggaagtgcgaagacgaatataatcacgatctagtactcccgccagcacgggctgaaaccgatcgagatgatccagcacatccaagatcatcgagaaagggataaccaaccgtgtcaaacgccttggcatgcaattaatatccgacttgaggcgtagtcgcaactgccaacggcagtggacacctgcatgcatatagctagcgaaagtactcccttgatgaagacgctgtggttggccgccacgatcacgtcgagcctcggattgcatatagtattactcctaggcctagccgggattttcacttcacttgcttcatgcatgcatgggctttatgcttctcctttttctttgttctccttgcattggggaagtttccctctactgtgcctcactgttcccaattcctgcctttcacttgccatcccaatattcccaatatatatattccataggtagcctacctagctagcttgcatcagaggctcttcttcctcagccctttgagatgagaaagggataaaaaccaaccggatacaagcctgccttcaccttaatggttaatggttacctattaacccggttcaaggtaaactcaatggtggtggcattcaaccccttattatttattttggccaggaacaccttccaaagatgctgcctgcctctcctctgctgctcttaaaagaaacaaaagcataactcgattaaccaacaatgctatatacttgtactccataattaagcttttttcaggttcaatcatgcatgcatgtcgccatgcatcctcaaactaattaaccgatttcaagaatatatatatccttccctccagccgagacggacgtacgctagctaacatgcatcaccacgcaatcagtgcatccgaatcagctaatcttaacccttgtcgtcattagctagtcaacaaggatgaacagagacaaccatctcagtgcaatgataataggcagctcgtgttcgtaaaggagtactctctccgtccaaaaaaaatctaattctagatttgtatctagacataatggattaggtttttttaggacggaggaagtaataactagtactctttatctggagtactactcctattgtaaactctgaagttcaagacgacgagcgagagtgacgcgcggagatggagaaataattccagtccagtccatgcatctcgatccccatcatcactccatgtggggctggtcatgatcatatatggcttaggcaaacagatttcaacttttttctttaaacttctaactttttcgtcacattaaacttttctacaccacaaacctccaactttttcgtcacgtcgtttcaatttcttcaaacttctaattttagcgtgaaactaaacacagcctaagctagcatggatgggaaaagaaagatgcaatgcactcgaatataaacgcaatgcatgtggcatgttctcatgctctagctgccatgccatgttctatcgatgctagctagctccggcctcagctccttgctcgatctggtctcttgtttgatagtactactcactactcactatgcttgtacctggtcaagtgtgtttgaggctttgagctaggcgtatctgtcctcaggatctcctactgagacctgaggtcatgaacctgcttttgctgagctaacgtatactccctccatttcaaaatatttgacactgttaactttttagcacatattttaacattcgtcttattaaaagaatttgtgaaatatgtaaaactatatgtgtacatgaaagtatatttaacaatgaatcaaatgatatgaaaaaaataaataattacttaatttttttaataagacgaatagtcaaacacgtactaaaaagttaacggtgtcaaacattttgaaatagagggagtatatcctttcactgatatctcactctcatcaatagatcttgcaccatgaacccatactccatcattattatcgttcttgcacacgtgagctatttttgttggcacaattaactaatgttctctatcaatctgattactatttttttgccaccttatctactactacctccatcctatattaattgtggctttgaatttttgtttgtaatgtttgatcattcgtcttatttaaaaaaaattagaattattttttttggcttgctttattatcaaaaatattttaagtatgacttatccctttttatatttacactaatttttcaaataaaatgaatggtcaaataatacaagcaaaaagtgaaagcgaatttattataggacggaggtagtataacacattaacttgtgcacgaggatcatagcaaacacttactccctccgtatcaatttctgggattcaaattttacgtacaccataatataaggatttctgggttgattctcactaatcccatcatttcaatgattccaaagctaatcaaatgtctagaaaggaaatcttaccaatttaaaatacaaaaaataacaactatagtgactaaaaggggatcttttgagctaacctcattatttactaaacaacctgaaaatccatatattttgtaacaaagggagtaaaaatctaaaaatccatatattttggactgtcggatccgtgccaagattcgtataggcctccttttcctctagcttcggtgagacggcgacaaccccgatcagtaagggttttgggttgtggtcagggtgggtagggggagggaggtttccctgaggtttagaggaaaggcagtgggcggtggactcaggtgagtggcgagtcggtggtggtgccgctggagttgcaaggatggggatggtgaagccgccaaggcttccaactctctaatgctctcttctcttctcttcttcctcctctatgtgtttgtgtgtgtcaatggtggagagggtgcccaagtgcagttggtgctgctggtagggtcagctcatccgggcgagctgttgtgtggtgcgtggctgctctatacgtcaaccgtgctaggacgccgccttcatcacaggcaactcgggaagctgtcgttgtttatgttcggttagaggtagctggagttgaaagagaagatgtggagagaggatcccaatgcaaattttgtcccgaattatattctagcgtgtagccagaagtcaatagtgtcaatttatcgaatccctttgcgaagtggcatttagacaaagcccactttttaacactggcgttaatccaaatttctcaaggagggggaggggaaggaaaatgataagattgatgtgcgcttgaatcgtaacacaaatctagcggtccaaaattcatatgatgtggggtgtgattcactactagaaaaagcattttttttccgacgtgggggtctttttttcgcaggcggacatgacccttggagccaaacgaccgcctacaaaaatataaatcagggtgaagtttgctgcggaccacttaaacggcgtctacaaaaatgattttcacaggcagaccacttaagcgacgcaacgcaccttatgtggtccacctgcaaaagccatacctacccaaaaagaaaattttaatcttcccttatcttctcctcccacccctccccaccactcatttcctttcaactctctctctctctccctcaacactcaacctcagcccgtccccctccctccccgccgaagggggagcgacgacggtgcggggcagcggcggctcccctcccccctccctcgcagatctggtcggaggagggaggggggaggccgacgggggcggcggcgaggcgtgtcccgcgatttttttttgtgtgcatttattggattttcacaggcgggctgttaccccgactactgtaggtggttgtcccccacgtctggaaaaattacttttggccacctgcaaaaatactttttctagtagtgattttctgccatatgttgtgtagacaatctccttatatatttattttgtgtgggtgttgtgggcctttgggggctactgctcgatcgacgatcattggaagcaacagtagatcgcacgccaattgatagacttggctaatataatgcctctaagtacattctcaatcgatcgacctgcaacatgcatgaacgatagccccaagtcagaaatgcaagtacatgtctttgctcaaatctgagactacctatttaattagtcatcaatctaaggatcgtttaggaaatataccattgaaagtaattagggggttattcgatcgcaagaacacggacgacttcgttcatggcagggatggaaaaaaaatcgagaaccgcagaccgaaccgagccgactggactggcggtttcttcggtcttgagcttcggcgtcactttttaggaaaaagtataccgaaggtccctcaacttgtcatcgagttacaaaatcgttccccaactgcaaaaccagatatccggcatctcttaactaatcaaaaccgatcacaataggtcatttggtggttttgaccccggttttattctacatggcggctgagtcagcgtgggacccttgtgagccccacatgtgctacaactccctccgtttcaggttataagactttctagcattgcccacattcatatatatgttaatgaatctaggcacatatacatgtctagattcattatcatatatatggatatggacaatgctagaaaattttataatatgaaacggaggaagtagcaatgaatgatgggcttggcatatctgggctctcggctctcgtgcggcagccgccctcctcctctcccgcctcgccccagaggcctcctccctagccgccggccggcttgcccagaggagaggggaggagaggaaagaagagaagagagagaaaggagaaggaagggggatatgacatggcacccgacatgtggggcccacgtgggtctcacgctgactcaggcgccacgtaggataaaaccgggttcaaaaccactaaaggatctattgagaccgattttgattagttaaagaacgctcgatatttagttttacggttggaggacaattttgtaactcggtgtactttttcccagtttttatatcggtttttgatcgcctcttggctgcgtgtgctgggccggtgctatttcgctgggccgtaagcagaccgaattaacgtcgccgtcgtgagcaaaacattctaatattaaattagtatagtataatatacttccttcgtagtagtatcagaataaaacaacatagaataggagtacaaaataacctttggactcggagaaatggatcatatcatatcatgattcatgaggggtgcgtactgttgtctccattggactggcccgcagggtacatatatatgattgagaaaaaaacagaggaaaaggcacatccacttatgctactactgttgtctctctctactgaatgatatacgtatatatatacagtagtactgtattcacatgtgaatgaacaaatctcatgcgtgtgatgtgatgaaacgtacaagcaagcaccagctgtagcgcgcgcgtaccgtttgcttctcagatggatcgtccaggcaagaagactagagtactagcatatatgtcaggttggttttctcatccatgccaataatcaattaattaattagagcgaaaactgcaaagccagaaaagtgaagagcagcgcagaaatgacactaggccaagatcgggtggaggcgctgcagataaggcgattgttgtggtacgtgcacacaggtcgcttcctgaagatgattaatcgagcttaattaattagcaagaggagaaatactttggatggatgaaagaaagaaaggagatggaaacctggtggagcagaaggtgatggtgtagtcggcgttggagctggtgggatcgtcgtaggcgctgtaggcggtggggcaggcggccttgaacttcttggagtagaaggtgggctggcacgtcgacgggttgccgtacatccccctgcagcagtactggtcggtgtcgaagacgtcgcaggcgctccggcacgccaccgtcctcccgttcaccttcttcgacagctccgacgggcagctgtcccgcaggtcgccgtcgcacccggccaccgagcagttgccctccccgttgagagggcgcaccaccatggggaggttgaagccgtccacgaggctgacgtcgtagaagtccttggtggcgagggtgaactcggcgagcgtggccggggtggcgccggagccgccgcacttgagctccgacccgcaggaccccgtggcgcaggagccgttgcccgcctggtcgaagtcgcactccgtccgaccccagatgcgccccgaccaccccaccggcgccgtgaacaccatcgattgccccggcttcagcgcgaaccctccgccgccgaagctctcgccgggcgtcaccgccggccagaccatcgtcttgcactggttgatgatggtgaacacgcgggccgactcacaatgcctcacaaagcagcagcacaggagggccacagccaaccacacaacaccacctcttgccattcttactttattaggtaccaattggatcgatcgatcgatcaaattacagctcctagcttgattgtacgtaggatcggagcatgcatcaacacctgtctgtatgtgattgtatatataacctgccagaatgaagaagattgattgaggcatgcaacaaggaatacgtgcgacaacacattaggcatggccatagcagcaagcaagcaagcaatcatgcaaatcatcttgcttgcagtgcaggagaggcctggaacccctcgctcttccctccattcgcggttaactcatcgcatatttggacatccgtacattccagccggagttgaagctgaatgacaactttaagtggtgtttgtatcatggactaaacctatcacataggatgtttggacgttaatttgtaatattaaatatagactaattacaaaactaattacataaattagagctaattcgtgagataaattttttaagcctaattaatctataattagtacatatttactttagcatcacatacgctaatcatggattaatcactactacaaaatcgttttttcttgacaccacctttttttttctctagcggttatacgtgccagcaaaaatattacggtgggtgaggggctacggaccgccagcaaaaatagattttcgtgggtgaccgagttaagagggccgctagcaaaagtctactttgactccctccaatatatgtacaatttgatttgattcgtttccatctatctattaacttattaaagtaataaaaaaggagcctacatgttcactctcacggcctagaaattatcatattaatcgggaaaaaaaaacatagtcaatataataatacaatttactcccttctctttactctcttgttctgtaatgacacttattcctgtttctagtaatggaaatgggggcagcaagtgccctagttttttttaaaaaaatataaaaatataatttagaaatagctaaaattcggaataaaaaataaaggcaaaataaaaatgtctattttgcctccctctagtctgctttatatcctcacgcaaaactcggtatatcgattctctaatctaccaaaaccggttgttttgcaaaacggtttgtttgtaaggtggtttctgtcctaggtgacacccacaagacacataaacaaacacgttgacttacccttcgtctaatgtagcgtctacatggcgcttaaatattattagtcattcaaaaataaaaaaaataaaagctaagaacccacatgtcagagtcatttctccctcccttcgacaatctcgggccactcgatgcctcctcgggctcccgatacgcagtccacaggaaggaaatgatcaccatgtaaagataaatgaatttcatgcgcaccacaaccaacacgaaaacagaattatctactgtgcaggtaagatcttaaataaaaaacgaagcgacacaactcgaggcagcccttgtatactggagtaactactgtaatgggtaagcaggttatatattgcgctagtttgcttcaaccgggaacatcaaactactaggcggaacgtacacaaattgtctagtcatatacaggctggataaagagtatatattacatatagcgaatgaccaaatttgctgcaagtaggtaccactgtgaacattacacacctgagcagctggctaactgagaactattcaatattatcgcaattaagaagggaccaagcaacagttatttctacctcacagaagcctaatttgcatgtagcacagctttcccctgattttttgggcctgaagcgaaccttatccgttgtgaatagggcctcatcattttgtgcaatcccgccatcatcatctctagttcttttaccaacatgtgtggctgtcaaagaaactgtcagttctccacttaattctacagttacaacacgccttgatagcttgatcacatcatctgaaccaataggcattgtttctgcatcctgggaatcaagcaacataaagtcctcatggcatatactggaagttgtgcaaacaattcgtccttggtattcttttgtccacgatcctctaacaactttgactctgcagatagtcgcctcaactgccccattaagcaccgcatatgtgaacttaaacttgctgtaccacccaagcatgattgggtgaaatctacgaaccagcgttactgattgtctaccattaaaaaacccattttgtctgaagagttgaaagctcaatatttgatcatcggactctcttcttccctttacttttagttcaacgtcaaactcaactgggtcgacaatcagaattgcacgggatggacctgtcaactccaaaaatgaatcctgcaatcatcattcgtacgtcattataataataataataaaattaaatagcaatgcaaggataaaaccaatacacattgatgaaatagtaattgcttactttacaggactaaaattttagtggaagtgcatataagttctgtcgaaaatctcctaggttctagaagcgacaattttatgcatacatatgcatgtcttatgaattaatagtttagtacagtggccaaccatcccatgtctttatcattatatatttgcaagtcttctcttttttgttttccaatttgttattttatatcattagttgtttttgcatgtttgagttgaaataaatatgcttataagagcagttttactactaccacagtccatatatttcaaacattgaattgccaagaaggtttccagtttacagtagatattagagaacgtggcagaattaagaggcggaattgcattcatgataaaataaaatcgtgttatcgtgtacacagtagtaaggtgatttgaatgtttatagcacttgagagggagtacaaaataacagtacctgcagctagaaatgagcaaacaaaaactaaaaaaaatccaaataattaagataatttaaaaatggatggtactccaccttctgagtgagaatttgacaatcatctctagtgcggtggaacagaaggttgcgattatgatccacagagtccctgacagcaaccaagccatagacatgcaacggccactcgagaccctttttgattcttaccacctctatggagaagatctgcaaggtactatcacagcaagcatatcttgcgataggcccatgtgtatatcgcatggcgggcacagacgctgcaaacataagagttatgcatgcatgcaatcagaagacataagaatacattgattatgatccatctttacttataataattagaggctcttccagaagccctctgtcaatcctagataagaacattaatttaatttagaaaattaaaaaaagaaagctagaaatcgcacattaatcaaataaaaaaagatcttgatcacccaatatccataactaacgtaccatgtgaggatatacttatatagtacgtgtcgcaccttgtgaggagatacttatagagcgtcgcactatgttaatgcagaaaggatccaaaaaatatatagtgagtcatggacctcatggtagttgagaaaatggcccatgccacatgcgcacggcaacaaaaaaatttgatatatttgttattgggtttgattcgaaaaacgagttcaattttaagaagaactttggttggatacaagtttttccaaagcgtttaatagattctagttgttccttctttcttaggtacattcatccaactagagcttggagtctattctcttcattagtgatcataacaatgttttgtatgcatggttcctatactcctatgcacattgatgtacatgttctggtttcttaataacaaacaaatggaatgtagattgattcattgtactctccttttaacgcaaatagacatgcagcttatggtttccaaggagtcatattgaatattgagtgaattagctcctgccaaatctcatgcagcagcacataacaataacaagaatattaatctgacgagatattgatactaacagtaagagcacccgcaatggtaaagtaaggtgctctctataaaatatgtacatctcagcaatagacttagattaatagtaaactacctcaatagtatgtctacatgggtatctatagctctctaatccattgcctcgtttttctctatagactatctccaggttagtagatagttttgctctctctcttcatttaatctcttctaagtaggaaaatatgctgacatggatctcttgtagagaacatatagataaccattgcgggtgccctaataaaattggattacgtacttgtgcattggaagggaccataacgggaagacaaagaggaatcccaagatgtacggtagttgcgaatctgctcctcctcgtccacctcagtgtacttgtcctgcaactccaacttcacctgccgcaatttttcctccatctgcaccgggtccagctcctcctcctcaccgaacaccaattccgcgcacctcgaatccctacacccatcctcctcttcctccaacataggagtataattgttcatcctttcttcgtcatcctggtcatcgatcctccttgacttagcagcaaaggcctcctcctcctcacggcggcacttccggccttcgccgcctcctctccccttcgtctccgccgcctccatcgctaaatgtatgagatcagtttccttctctttcacttcttaaggcgttccaaatgtccagtgggccttgccctgggcggctgggccttcatcaacacaaattgaacggaatgcagcccattacggcttaggctcaggttttaatattctcattttcactccactattaatattgtttcagatggataaaaaattactcttctagtcgcgtatatatatatatatatatatatatatatatatatatatatatatatatatatatatatatatatatatatatatatttaacatcagttcccgtgatataaaataaaggattggcttgttcacttcgttcaacaaaagaaacttcaagaggtcaggtggagatgtgtagtagtagtgtttagtttgacacttgaccaaatattggtagcagttttgtgagtagaatggtctagaattatcaataattcgcaaggttgtgttggtaatgacatatttagtttgttatcttagtaaattttggtatcaccaaaatttcgaatagttgagaatggcaaggaagtaaacaaggccaaaattttaagacttccagttccatacactctacagctaacttcagtcaggcctacaacagacgccttctcctcctcgaaataacttatcaatacatccacgagtctctgaaactaagcaagaaaagcatcagcttctagtatacgacagcacagttcaatgcttggtaattaagcaggcttcatcatataaattaagacatacttatggtaaccatctcgcaggacgtcagagaatcacaaggaagaaaccagtgctgttgtcaatagcccctccagataaattatagcaggcaggcaactatctttacacaaaggatatgcctttgatcacgcctaatgcgtgcctcaaaccagtcattggattattacttcatctcacacattgacatgatttatcactgccctaaaggccgaaagagagaggtggggagggagagggagagggagagagaaaaaaaaaaggttattaggcatgttgctgcaccgggaaggcgggaactagaccggacttatgagtgagcgagcagctcatggattggattgtcaaaactcatcggccagactgactccataatgctgagctaggctcttcatgtttccgttctgtacgacattctccagcatgtcgtacttattgtaatttccatcgagtaattcctgttgctgctttgccagctccttctcctcttccaattgattctggcagaaaaaacacaaacaaaacacatcaatgccatgttacaagatcaaaacaacagcaacttggtcctggtaagcaatagcatcaagatcccaaaatactgtcctgctacaaacacaatacttggactaacaacgctgggcaagcgcataatagttctccagtcgcgcttacggttatagttactcgtgttaaatgcagaatgtgtactcaattatccatttctaaattacaatttacaatgtcccggcgaaaaaattagtggcctaccccactattctcctgagcaatggtctgccaactgattcataactgcatatcactacgcagaaactatgctgtttaaggcgtactgagcataaaacaaacataagatggcgattcttagaagcagtgaaataaatagttcatctaaaaaggagtcactaatttacctttatgagtgccatattttctacttcttgcctttttgctaggatcctcaatttcttcattccttgatactctgttccatcttcttgttttacccaccggaactctttcctgatgccagggtgaggagggcgctcccgaaacatctcgggctttgcacatatagctcttacaggccttggcatcccgccaattatgaaagggaaatcattcatcaagtctagtgcagccttagcttgtatttcgtcatccaattccaccaatgcagcagaaggaatgtcatacgggactgtgtaattaacaatgaactccacatcgacaacatttggacattgggcaagagctgctttaattactgagctcgtgacttgaggggaaagatgatcaatatagatcgtcctcttgaccttcttctcgaaatcagcatacgccttcttagcatcttcatcggatgtcaccatgggagcaggggcggatccaacttgagaacccccaaactgttacttgtattctgaaattaaaagaagagtctcttccagatctagaagagaagctagggttaacgaacgaacgcaagaattatccagacaaaagtagtcccgatgggagagaaagatgaatcagaaaggcgcctctcctcccttgttttgttcagctgcgactcgtcttggcggcgcaaggagcggaggagacagattttccttcttttatgccgccaaggtaaggagaagatactcggagaatagcgatggcgatgccgatgccgatgagaaggagcgatgggagggaagcagcggagattgcgcgattgcgcgtgaggggatttgcgatccgaggcattgttcgattacgcttagattcaatccggaccgggaataacaagttcagtaagaaatttatgatagatacaatgagagatcaggatttattttgggtcggaaaacaatttacttatgataaggacaataagagaccggaattagttccacacctcttgactagtggattgattcccggtctcttattgtccctattatgagtaaattggttcctggcccggaataaatcccggcatctcattgtatctatcataaataaatttcttgctatacttttcattcccggtccggattgaatcagcgtaaggccttgttcggggaccgagaggcccctcctttttcagttcggctaggggtagcgagtgtaggttgaggaactgggaatattagaagggatcgagggggtcgggcacgtgatctagcgggcgagacagaagggattataccacgtgatctagtgggcgagacggaagggattatacagattcaggccactaagaagcgtaataccctactcctgtgtatgatgatttttctgatatttgaaagcctctaaatctctggtgtacaagttagggttaagtgttcctattctaacttgttctcctccctctcactagacgtctacctccttttttactccaagaggttattatatgagttgggcgtgccgtccagcaagagagcaaacattctctatattaaatgtgtatcttgcgctacagcttggaaatcgtctgagcatcagctgtcgagcgaggccatcaaatcacgccggctgacgcaagccaacatggaggggggtccctgtcattcttcatttaatggttgtggaatggaggcttggatgcgcgggaatgacgttccggctgctgtgtctcccatcatcttgatgggacagggcatacctaccgcacgccgcctgacgtccgggcagagcagcttcagtcgacagcgagacgacgcgcttgacaacgtctccaaggtgttccactgatgatggatcggcggcggcgatttaggctgtgtttagattcaggggtgaaaatttttaccgtgtcacatcggatgtacggacatacatttgaagtattaaacgtagactaataacaaaacaaattacaaaatccgtctgtatactgcgagacgaatttattaagcctaatttaatccgtcattagcaaatgtttactgtagcaccacattataaaatcatggagcaattaggcttaaaatatttatctcgtaatttatatgcaaactttattttttttatctatatttaatactctgtccaaacatttgatataacggggtgaaaaacttcaagtgatctaaacaggcccttgggatttgtggagacttggggaaggacgggtcctagtcagcctcgctatgcacatcaatggatctacatccaccgattgattgtatagtagtactccgtatgtgctggtctggtagtttgcaacaatcattggcatatgtatactgacgactgtacacaaggggaaatctcgaaagataagcatactcagctcctgatcgatcgatctcatcaatctgcaacgaattgatcgtttggtataataacgaatctgactgggaaatacagtacatacatatttatggctgttgttggatccgcaaaaaggaaaaaagaaaaggaagaatgcacagatcagatcgtagagagaaaggaagaaagaagcagcaggaatggaggtgatccgaggagcaggtgataataatgaatgaatatgatggattcagaggtaaatgcaggacttgtcgagggagatgggcttgttgagcttggcggggttcatgaggaccttgcactcgatggcgcgtgtgaacttgggcttcaccagcgcccccagcacgtacgccctcgagtgcaccgtcgtcctcaggatcatcggcaccggagccatgctgccgctgcccttccccgccgtcagcgtcggccctccgccgtacagcggcaccttgttccccatcacccccacgctcaccgtcctccggctgctccgggcctggtagaacttgttgagatcgccggacgccagcgtcagctggctgtacgacagcgtgaacgggtccgccgtcacgtggatcccgaagaacgtgcccgtgttccggtacgtcagcttcaccgtcgagttggtcgtcgccatgtccgtcggcaccagcgacgcgtccgtccccgcctggattatgaagttgtcgaacgtgatgctctgcaatataatcaacagtaccattatttatttgtcatttcattctacgaagcactaatcaaatgaagaagaaagaagaatagttaccttgatgactatctgtggcttctgggagcggctggcgccccagaggacgagggcgaagaaggagaagaggacgacgaagccgaggacgaagatgaggaagtacttgcagcgcttggggatgcccctgcgctcgtcctcgtcgtcgaggaggccctcctcctcgatcacgccgatctcctgccaccccttccccgccggggcgcccttgcggccggagctggacttgtcgcccttgcgcttggggtggccggagaagcggctggacgaggagtccctgcccaccgagtgccgcggcgaccccatggggctcagcgccggcgtcgagtgcaccgacgtcgccgtcttctccccgtcatgcgagtccctcgacgggctctgcacgtagtacaccggccgcccgccgcgcgacgtcggggaccgcggcggcgacgatggcgccaggctcgtcacctccgagtccgtcttggcgtgcatcttcctcgtcttcttcttcttgatctgcttgctcctctgctctctctctagcttcttcttgatctggcagtggagctcgctaacactagctaagctaatgaccactccgtggtaggagtaatactaataactatagagaagagattcctaaatctaatacagtgatgactagcactagtagtacgtgacaaaggcaggaaggccgcggctaattaaagaataggaaagcaaaggaagcagcgtgtgttagttggatcaaagcgtcggtgctctttggactctggaggccaactaatttttagtttctttttcagatactagctagcagcactactagtggagtacaaacattgcactaccatgcataattagtatttagttttacacttggtttgtagcacattataccttcaaaaaagaatcatttttagtctatataaatgaagttatatcctactactatctattggaggaaagtactactggtatttattctgtaggattattaacaggctaatgtggggggtgaaaatgaaaatgcaaattttccgtataaagtgggtggttgcatgttacacggaagtgagcagagcactggtatggccatgtgacggtgatgtgccgggattcgtcggttgcggcatgagagagagagccggacggaccgacagttcatgcgaggctggctttcccattcccagccagctcaccatctcgcactcgctcgcagctggatcttgctttcctctcacctcttctgccctgccctaccctaccattccctcccagtcccccacatacacctaccatctactgcttgtaattacagagtatacatgtcacagtcaaaagccctcattgcaagcaaccacatgttgcatactcctatgtgtttaattagagtctcttcttccaaccaccattaatcacttgacacaaataatttaaagacaattgtgcggcaccaaccgctgaccataaaaaggtagtttatgcatctccgggctgcagg

SEQ ID NO: 49634 - DNA, 7600 bp, Oryza sativa
gagatgtgtgtttctcgcgctgattcaataataacttttttttctcatgagaaattccgttgtgatttctcacctagtatctcatgaagtgcacttttcatctagatgttgtagcagctttaatatgtgcacttcactggaatcaaataatgtcattaacctaggcccaaaggtaaagcaacaaaatttgagcacagatctagtgttaagtaaaacaacagttaaaaactgcaggtgctagagcagtgttgaactgtagagacccaacttgatgtatgcttgctcaatggtgcatttctcatgttttgactaaactacacaaaaggacattcataaggccaaggaagcagattcattaactaaagcaaacataccagagcattggccacatccattgcaatctgtagtctagactgccagcttaatgcctttcttccagatgctgtagcaattcaaattggacaacttaacagcaattaaaaaatataaattatatgtacagaagattcaagatatacaaagcaatcatacagtgtaggtgatcctttaggcttccgtttgccatgtactcatagacaagaaacctgacaagtacatatataatatgaccacagtgtaaaatctgtacttctgtagtacaataggacaaaaagataccagcgtacctttctttcctttcgatacagaagcccttgagggttacaagatggcgatgatgcaacctagctaaaagctccatttctcggcagaattcttcctcagcttgtcttgataccttgtccatcctttttacggcagctatagatccatcactaaattgagctttgtagactgttccaaaacctccctttccaataactgtgctgaaattgttcgttgctttcattgtctctttgtaactgtacctttggaacattggtgattgacctgaaaagaaggtaacactttggtttcgataagagacaacagaatgatgaggtgatcggtttagtttttattactgccatgctaaagcccaaagctatacttgttgatgcacaacattataactcataaatagcagactttcttttagattttttttcacataacaggtttgacgcaggaatgcataaagcagttgataaacactgatattagaacatcttatgcgcgcatcaacattgggcataacaacgtagcgtaacaacctaagcaagtttcaggcagacatcacactatctgattaccatgatttactgaccataaacaagctaagaccaaattccacctttttactagcttaaagcatttttagtaatgtgaaatatggtgttagatatagattagttgaatagaatcaagtgcacaaaccttctggacatctccaggattgactctgacagaatgcattttctgggttctgagcatgaaggtctgcatttttcaattccctgttctttctacgaatcaatatgactaagacaagttggagcagaacagcaagcaatataaccgctatccctatcccaggtatcactgtaatccggtaaggctggtgatgtttctgcagaacagttttggtctttggagctggagcatcaacaggggttgtcacatttggagaagaagctggagtcgatgtaacagatgatggccctggtaaattccccaagttagagagtggtcatctttaaacttaatcagaatgcatcagtagtaagttagtaatacctggaaaaattgtgatcccttgtacaccgaagaagcacttgacaatgtcgtcgtaagagaaaatgccctgttgagttgcaagcgtgacaaaaaccgcgttccgacagacgctaagaccaacgttatcatccgagccaatgaggcgatgcaagaaacaatgccgtaattcaagcaggtcttgcaagtgatatccaaggatagaggacccctgcagcttccaacaacgtcattgaaatttggggattgcaacatttcaaggacggtgtcgcgtccggcacactgatatgagacccttatcttgggtcccagcccgcagaagacatcagcatcggtggggattccccgtagcttgaatgtctcggatacagagctaagacatatctcagagaaggccggagggacacccagcctgccggtggcattggcgtagcgagccatggaaatggcgacgaatgcattgatgtatcggcagcatgccgcccgctgcgtgggatcagagcacgcggctgaagctaatgtgaagttggcccaactaaaatccaaagggcaatctgcagagaaacgcggtggatttagtagagagaaaagtagtgctagtaattgggaagcaacagaaaatgggtaagcgtctgatgatgtgcattgaatcaagtgagtaggaactcaggtagaagaagaaaacgtgcagttatcaagtgagtagcaattaagcggcatgaaacactgggcattatattcgtactacagaagatggggatggtatatagggttgggaagatcaaatcgggcatgagcagtatcgaaagcaggaaggcaggtagtgattagtacagtaatcagtcgcatggggagcggatcacaaatactgctactctgctagagtaaataaggcaatcgatggatggagaaggtaactgacctccgacggcggttgctgcggggttggcggagaagaagaagggggaggcgagcaggagcaggacgacggagacgaggccgccgcggaggaggggcatttggctggatggcggcgcggagtgtggagctcagctcagtgttgaaggagagagagtgaaggagggttttggctgcgccggccgaggttttcttcttcttgttttttttttttcctgaatctctccctctcttctcttgggtgtggtacaggtactacggtggtgacaaggaaggatttgcttttggggctctgcgcttttatgtgggtgtctccccgtgacaatccctatcttttgctaccacctgctcccaacacccaattgaaggcatgtgccacgctgaggattgaccaaagtttgttggaaacctactagtaataagtttgcctccaaaatttgttgaatttaagtagggtttgtcctgaactttggtgcaggctaaacaagacgggccggtatttgggccatggcaaacagtagaggcgagaaagtggagtccagcagagacagcgggtgggggcagcaggcaggcagccattctggcacaccaccccccactcagcgcagtccagtatcacatgcattgcattgcagccacctaatttagctgccagtgccactaacaatctctcgctcgctgccttggcttgattaattaagaccgctgtaataatgtacaccgacttattaccccacgcattagtgtgtgtaatagtagtatgccatcgtcccgtacaagcagtacgtacgtacaacaacggatcggagctagctagaggtagaagaagaaatccgatcccaacaaccgggcggccgtgtctatttctagtacgtgtgctccccggcttccccgcgactttgtcacagttttcaaccaacgatattatctgtgtgtgtgtgcgccgcgcgggcatgcaccaacgcgcgcaacggatgaaccatccgcctgcatcgatcttcctgcgatggccgccgcgtcgacgttccctctggctctgctgctcgccattgttgccgcatgctgcgtcgccgggggcgagggcggcgcgctggtgggcgacacgtgcacggcgtcgtcggcgtcgagctgcggggcggggatgcggtgcgccacctgctcaccgctgcccgggatgggaccacccgtgtgctcgcggacaacgccccttgaccccaaggcgcacgtacgtacacatcactcctctatcatttcgcaatgcagcaaccaaattcctcctcaatccattgatgcattgcaggggacggacctcgcgttcaaccggtacacatggctcacgacgcacaactccttcgccatcgttggctcgccgtcgcgcaccggcacgcccatcatcgcgccgcccaaccaggaggacaccgtcaccgcgcagctcaaggtctacatctctctctctctctcgccaataaataaataaatattcgaaattataccattctttcttcaccgattttacaaagcatatatatacacgcttataaacgattggtacaagtatattactccattgtcgtatagtgaggtatccatctatatccatctgtgcctgcatactggggtactgcacacggggctctgctactgtatcatagcctgctgtcttttgtgctcgtcgcacataatcgtcggtgcactttatcctctagagagaggtgtcatgtagtatatattctctctctacacaacaaacaaatcagaatcattcaccacaacgcaacgcaacgcatcacggtgtccgtttgctcggtacacatcaaaaggaggcaaaagtaaaaggctgatgctttggtctcaaggtacatttggccacgccacaccgcaccttttgtcaacgtgcatgcgcacccattccccaccaagcccaaattctaccgtttgctgcttacagtttaatttgcatactgtacacaaattgtcgattattgtactttctggtcactcagtgcaagtgatgccagcaagatagattaggcggcttgtctagtttcttagaaagaactacgactatatgataaacagcagttcattcaaccctgtattatctttggccgaaaactatagcatttctgtcaaaaacgagttttggtccgtccaggattaaccatttaagtggtatttatcgatttaactatttaatgtcgattgtaatgcaacacttaaaaattagaaaaattaaaacgatactcggtcaattggaaatttccgtcattattttcatccctattgaccagtgtgtggccttgcaatgcatatctgcacagtacagctgaaagatctgctcatcttcattacaaaactgctactattacgatacttgtagtcctagtagtactagctagcttacagaatcctgtttaatcattactattccgtttgataattaacgtcctagtacgtgctagtgcattgcagaatggcgtgaggggcctgatgctcgacgcgtatgacttccagaacgaagtgtggctctgccactcgttcggcgggaaatgctacaacttcgctgcctatgtaagcctgcattgctctgactgactgactgacgatagaaacctatacgattttgttgttgtttatatgtcgtggattgatcacagcaacgcgcgatggacgtgctaaaggagattggggcgttcctggatgcgaacccatcggaggtgataacggtgttcgtggaggactacgctggtccggggagcctgggcaaagtggtgggcgggtcagggctgagcaagtacctgttcccgcctgccaagatgcccaagggcggaggcgactggcctctgctcaaggacatgatcgcccagaaccaccgcctgctcatgttcacgtccaagaggggcaaggacggcagcgacgggttggcgtacgagtgggactacgtcctggaaacccagtgtacgtaaaagcacactgttgcttaattggtcgtcgtctgcatcgtgatgtctcctgatgttattgatcgatggtacatcacatgcagatgggaacgatgggctggtgggcgggtcgtgcccgaagcgagcggagtcgatggcgatggactccaccaagcagtcgctgatcctgatgaacttcttcagcaccaacccgagccagagctgggcctgcggcaacaactccgcgccgctcgtcgccaagctcaaggcctgctacgacgcctccgccaagcgctggcccaacttcatcgccgtcgattactacatggtccgctcccataatcattctgcctctgtttctgactaactgactgacgacccatccacgtgcagaggagtaagggcggtggagctccgttggcgaccgacgtggccaacggccgccagcaatgcggctgcgacagcatagcatactgcaaggttcttataatatccatcctttgtctccatcggttttctttctcaacccatatttatatatgttgtatacgcagcctgggtcagcgttcgggagctgcagtttgtcatcgcctcctgcagcgccaccaaagatggctgctgcttcaccgccggcagcggctccagcaccagcaccagagatggctcctagttcaccgccggcagaaccaccagagacggcgacggaggctgctggttcagcggtgcgaccggcgtccatcaagttagagaaggacgacacgacgggcacatcgccagcggacaccgccaaatcctcctcctctaatcgctctcctcatccgtccagctgcagcttcctctttggattattattgccatctcttctcctcctccacctttatatttcagattgatcgatgaggcttttatccatctcatcaattcgatggtgctaatatacttttattcatggatggactccatgatccatatgcgcatctcttagctagctagctagtagtagcagcttccacgcaagcgcaatccatccggactcctgctaattaaatgttttgcacaattaactgtacacctagctagctattaccacttaatattagaatctcttgtagtaatggatgcatgcgtgcatgttgacatcaattaatttgtctttgagtctttcgatcttgtttcgttggtactacgttcgtgtcgatccattgggttgttcaaggaaaaaacaacaacttatgctatgcccagtagattagttgtgatcttaataaaagcaacgagctcgaaaagaaattcagaatccttctaccaccgagttaacagagcctgaattgaagcacaccttcctgcagggcgaacggctgcatagccgtctttcaaggacggcccactcaacgcccaacaacttttgcttacggcccaaaaacatttcatgtcacataaggccataaccttgccatctccgcccacataaggcccatatgactggcgtcagtccacttaaggcccaatattttccttcggcccatacatactccaggccgcacactcacagcccataaattctgcatttcgtcctggaataagttcaccggaggtcccttagcttgacagtgagattttttaagatcccttaaccacaaaaccagaaatgtgtacccataaactctcacaaaccgttcatcggaggtccctcgacagtatttttgtctggttttgctgacgtggcatcctagttagcaaaaaaaaataaaaaattaatatgtggggcccacatgtaaatgacacaaaaatgtgagctcaacattcctagtcagcactgatcttctcaatcgcttttttctttggcgcatagggggagcagcagcgacgcgcgtccaaggcaggcagagcggggcgcggtgggcgagcggcggttcgcgagttcggctgcggtgagcgcggcggcgacgggcgaggggcggcggcggtggcgcggcagcagctggtgccggccggagagggcggagatgaggccggcgggagagggggtg

SEQ ID NO: 49635 - DNA, 3529 bp, Oryza sativa
  unsure (1)..(3529): unsure at all n locations
ctcggccagttcggcgctcgtcgctctgtatgcgatgtgtcggaaggagagctcgccgccgccgagctcgccgtcgacggctgcctcctctccgcctttccctccgccgccatgacgctgccggcgcccgtaagtaagcatgcactgacgatttgttcaccaccaggagcgtcagcgtttgctcgccggagaagaagctggtggtgccggagagcgtgtgcgggcggccgttggggctgcagttccaccacgcctctggcgacctgtacgtggccgacgcgtatctgggcctcctgagggtgccggcgcgcggcgggctggccaaggtggtgacgacggaggccatcgatgtgccgttcaacttcctcaaccggaaagtattttactagctaatttactagtccatttattctaacatcgtggacgcacacacttattcttacacagattttgcactacacgattgcacacaacaagagcaaacacacgcaggctttgcggcaccacacaaaagaaccttttctgttcttcctcaacggcttcgacgtcgaccagaggaccggcgacgtctacttgaccgatagcagcagcacgtaccggagaaggtaccccaaattaaatcaatcggtcatgttcatactacacagtgtgcatgcatcatgcagttaatcgtgtgccatgctcgccctccgccgccgcgctcaccctccgcttctttgcctgccgccgcgctcgcgcccgccgccgctccgctgccgcgatcgccctacgctgcgccacccacatccgcacgctaagagaaagaaagaagagagagaagagaagagaaggagaagaaaagagaagaaaaaaaaagtgcggctgacatgtaggccccacatacttttaaaaaaaattgctgactaggatgccacgtcagcgaaaccactcatatatactgctataggaccttgagtgaacggttttagtaatttaggggtaaacatttctgattttgtggttaagggatctcaaataatctcgctgttaagttgaggaacctccggtgaacttactcctttcgtcctacatgcatcccttgtacgaccaattggcgttttcaagtaggcccgttaaggcccacattttcatactagccatattaagcccattttgttcacgtaacgccgtaacttttggtaagtacacttcaggtcccttaatttgtcgccgagtctgaaatacgttcctaaatcaaaatataggtcactcaatttataaaaccggatcacccgaggtccattaattggagcgaactgatattttaactagtcaccttaaaaatggttcaaccggtttcttatatgccaagaaaagtttaccattttttttatgtgccactaaattaaccatttcagaaaagatatatatatctttaaggggattttgagtttccaaatatagctgttagcctgtcagataaacacatccactgaactttttttgaaataaaaaagaaggattgcattctaccaactccaaagtgtgcgagtccaataatcatatatagtcttcctaacgctgcagctgcacgaggacaacatggccactcactttataaattcagccacatgtaatataatatagcggtactagctgggaagtgggaaaacagtgattaaattgaaactatagcctagctcgatgcatccacttgactaatagagtatcgatcgtttatgggactttgaagcgttcaaacgccaagcacaaggtctcggcgcacgcgctacctatcatataacaacaacaagtggatgttagggtatgcatgcatgtttggttactagtcatactttatcaataaatattgatacacttatctaatttgaggtgatcaaattcttagccataatttaataagcctaaaaaaatcttaccacactttttcaagttaataacatatggacctaatttataggaagaaaatattgccacaatagtggctacaaccaaacagccatcaatgtgatcaaacctgcctaagcgtagcaaattacgacaaagtatgattggcaaccaaacaccccggtagtacatatatacaatcttatgcatcgcgtgcgtggcgttaganaactactctccccagccgttttataataaatattgcaagccattttaacttttaactacggagtagttgtttgagaagttttctgtttttaattaagctgttattttataagttgtaattttcgacccacaacatctgtaataatttctacttcccccatttcacaatataagtcattttagcatttcccacattcatattaatgttaatgaatctagatatgtaacatcaatatgaatatgagaaatgttagaatgacttacattgtgaaatatctagattcattaacatcaatatgaatgtgaaaaatgctagaatgacttacattgtgaaacggagggagtagtaatcttatactctctccatccctaaatatttgacgccgttgacttttttaagcatgtttgaccgttcatcttatttaaaaccatatgtacatataatagtatatttaacaatgaatcaaatgataagaaaagaattaataattatttaaataagatgaatggttaaatatgtttaaaaaagttaacggctttaaatattcagagacggaggaagtataagctatgtaattgtccacacctagtaccaacatatgcgtctgcctcacaagggttaaagaaaacaagatctttttcctgatggatccaccaccgtacctgtaattcatcagccctcgataaggtcgactcacgcgcgcacagtacacgtacgacaagatgcatgaagagttgttggcgacgatcgacgagatgcacgttgaggttcagggaacgatggtgtatcaattaaagttggcaactgatcgaccggacgaagcggccaacaagtatcatgtgggggttcatcgcacgccgcatgatcgacacatgcatgcatgcatgccccacgtgatatattgtacatcgatcggtgtcatcatgaatctcgatgtggtatacacgcacgcaccagtccaaataagtactcctatctaaagtactagtagtactacaattatctaaagtagcacgtacataaagaacttaaaagcagcaagtatattattttcttaatgggttcttaatagtagaatttattccgggcatttgctttaaaaaactacagttagatcgagcattgcggcttataaaataacaacttaattaaaaacaagaaaactacttgaataccaagaaaaacaacttccatccatagttagagagaggggggttgttgttgttaaaaatagacaagaggaggtaggatgcatgggatcttttgggagatgttttggggttcttgttaattcggatagcacatatccataagtaggttgtctatccgttgggagcagacacatttaaaaatgggtggccttcgaagcacatgtggtttaaaacttacgaggatattaaactacttaccact

SEQ ID NO: 49636 - DNA, 6171 bp, Oryza sativa
  unsure (1)..(6171): unsure at all n locations
tcacctaaccacatttattgcggtttggctgagcgtgtcacgccgcatgtaacgcagtgcagtgcactagtttatccggtcagtgaccagtcacagaccggtcagatcgcgggttaggtggcgacaggcgatctgacacacgcctcgccccatcccgtcaggacgagggcttctaggcgctcgtccccagctggagctagcgtgttacctcccagagatggcacgttagtcctggtcagatatatgccaggcttcatcctaaccattgcaggcaagatgctgtgtgaagaagggcgaacatgtagattgctaagctgacacgtggtggacaagaatgaccgacgtgactggtctgacaccggtcatgtcgtcagcagacagccacgattccacatcgcacctgctcccggcgaaagtggaggtagttgtggcccgtctcatcagaaggtgactcggacggcaactatacaaatctccgtccatttatgaaaaggtggggtaagtccccacaaaaaaaagagagaaatggtgcatatggtatccccttaagatataaaaggaggaccttgcccactgagatgtggactggacttttccagattgggaacccagaacaagggagaggctggctcataccttgtagctccttcatacgcagatcacccaaaacacaggagtagggtattacgcttctcagtggcccgaacctgtatacatcgcccgtgtcttgtgtgttttcggtctagcgaaccttccacatacagagagcttagaatctcaccctgagtccccggccgaaccggcaaaggggggcctgcgcagtctcccggtgaggagcctcacgctccgtcatctggcgcgccaggtagggggctctgcgagggattttctgagctctcgcactctttcgtgtgcgccaagcttttcctgttcagcccaatggccgagccagcaaaggcacacgacctctccccgagtatgagcggtgacgacggggagccaaacccacgccgtcgacctcgtactccaccgccccttccacgccaaagtcctaggcgggagaaggcgctcgagagggctcaaggatccgcgacttcgacatccacaggaggtggagaagggcggcgagatggggagcgtcgcctcctcgtctacggcgacggcagcacgccccagggcgcgctccaagctgcaggcgcgctcctacgtcacccgcccgtcgcccatgacccggagtctccagcccaacgttggctggacgatgtggccaaattggtcatgactgcacggcagcgcctagatgctggtgggcggtcctccgccaccaaggactctggtgctgctaccaccggctccacgtcgtcaagacggagggcgcggcgagcggcagccgctattcaccattcggccgccactccttcgtcaacgcctccgacccgggaagatctgcgtggggaaccggatgcccgcatcagtatcgagcgccggcgtaatggccgacgtgctccccacgcaacggagggcgcctcctcgtccggagtgtcacctcaccacggacgcggggatcagccctccgtgccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgnnaacttgccacccgcgtctgtccactcttgggaggatttggccaacagttcaccatgaacttccaaggcacatatccgcgcccaggtgaagaagcggacttgcacgcagtacagcgaagggatgatgagtcacttcgctcgtacattcagcggttctgtcaagtccgcaacaccataccatgcatccctgcacacgcggtgttttacgcgttcagggggggtgtgcggcacaaccgcatgctcgaaaagatcgcctccaaagagccccagactaccacggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgagaccggcgctcccagcagggaacgcccaaccggcaagtggtgcaccgtccacaatacatcccttcacgacctcgcggactgccgtgcagtcaaaagtttggctgagcggacgaggaagtgggaggaggagaggaggcaggagcgccgagagggcaaatccccggcggttccttccagtaatcggcgaagtgaggccaagcagaaggcccccgccgaggacatcgatgacggcgatgatgacctaggtttccaagagcctagggccaccattgctaccgtcgatgggggagcgtgtgctcacgtttctcgccggagcttcaaggccatgaagcgagagcttctggccgcggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacgtggccgttaggacacattgacctaccggtcaccttcggtggatccgctaacttccgcacggagcgggtgaacttcgatgtggcggacctcagtctgccctacaacgcggtcctggggaggcccgcattggtgaagttcatggcggcggtccactacgcctacctacagatgaagatgccgggccccggtggccccatctctgtccatggcgacctcaaagtcgcgctcgcttgtctggagcagcgcgcggaccacctcgccgctgcgtccaagcccgagggtggcgacgagaggcttggcgcctacgcccccgccaccccgaggcagcggatgatcacaggcgacgaggtcccggtcaaggaggtttccctgggcgacggcccgtccaacaccacacggatcggtggtcttctggacggcaaataggaagacgcgctcgtctccttcctgcgggcaaacgctgacgtcttctcatggagaccggcggatatgcccggggtccccagggggttgattgagcaccgtcttgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacctccataggaacctattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccccgagaagatacgggctatagagcggatgcgcccccccagcaaacttagggatgtgcaatgcgtcactggttgcatggccgccctaagtcgattcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacatggcccgggagagagcagggaggagaggctcccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggcctaaggcccctgacgaccggagttggccctttacccgcttgtccgacgacgccaggagcccccgacccccaggacggccctgaagccactgtgggaaggccgcccctgttatcctccgaccccgaggtcatcagcacagaagacaagtgcgccccgcgaggctgcttggacaaagagtgccccagggatgcggcccctagcaaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcactgtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactcagagtggcagctggactggggatccgccgcctcctggtgttaggcgactcccagctggtcgttaaccaagtttgtaaggagtaccggtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccaattcccttagattgattgcttggatcgccgagatccaagcatacctcacagataagactctacccgaggaccgcgaagggagtgaacgcgtccatcgcatttccaaacgctacgtgctggtagaagggaccctctatcggcgcgcggctaatggaatcctcctgaagtgcatttctcgggaacaaggtgttgtgcttcttgccgatatccatgaaggcgaatgcggagcccactccgcctcgcgcaccttggttggtannnnnnnnnnnnnnnnnnnnnnnnnnnnnnnnnnnnnnnnnnnnnnnnnnnnnnnnnnnnnnnnnnnnaaatggg

SEQ ID NO: 49637 - DNA, 1119 bp, Oryza sativa
cccatcccatctaggttgttttttttcaacttttttgctattttacattgtaaattatttctaaaggtcacactattaaggggttgtttggttcagaacttcaatttgccatgtttcaccttagacgtgccacactatcttaatcttatggcgggctcatcaccatagttataacttgttacactttttagcaccttgttctatgctttatctgtcccgaaataaataaaatcagtacgggatgtgacatactttctatctagattcacgatactagaatattgtcatatcacgtactagttttgtttattttggaagatcgggagtacgtcatagagtgaattgtttgtctaacttaatcacaagtgcagcttactataatttagtggtcctaaaaagtgtggcaagtgaaatttgttttaaaccgtataataagatggctatgtgaaactaatttgcaggttttcctcctatctcaaaggagaattcttggtcgtgcttatctcctcggaataaagaaaagaaaagaaaagcaacgtgggagaattgagacgtgcgggttgttggcaactgaatcgcgccattgcccgtgtaaatttggttggtctttcttggccggcccggtaaaaaaataattcattaaagacagacaggggaaattagaaaagtgtgtacaaatttaaagacaggtcgcttcccttggccttaatttgggcacgggggagactaaattctcggagaaggaaggtgtccataattaagcgatcgattcgagtccccttcccttcctccctaaaccctaaccaaacccccaccactctctttccgcgcgccgcgtgcgacgatggcgcgcccgccagccgccaccgctccgcctcctcctccgccgccgccgccaccgccaccgccaccgatcgaccgcctcgtctggctcgcctgcgccgccccgctgtcccgcatccccgtcgtcggcacccaggtctcctacttcccagagggccacgccgagcagtgtcccgcccctctcccggatccgctcccctccgcccaccgattcttcctctgcaccatcaccgccgtcgacctctccgccgacaccaccaccggcgagccctacgc

SEQ ID NO: 49638 - DNA, 906 bp, Oryza sativa
tgcacccccgtcgctaccaccacacataatcggagcacgaatcttagtatggatccaactaagaacaaattcgactcaaattttttagcattagatgtgacttaaatataataatcccctccattattttgcttacacaagatataatcagtatatgttaccgtacagttcctactaacgctactactactgctcagttttacgagtaccatactacaaggttatcactgacaaaacagagttaagcaacacactgctcactgtcactactacatacaagtggcctggtcactgccggccgccggcgagcggcggcggcggcggccgctgcagcgcgagctccgccgtgtccttccacagccgcgcctccatctccttctccatcagcctccgctccgcccgccgcagcgccgactccagctccgccacccgctccctgtccctctcgtgctgcacctcgcgcagcctcctctccagctccacgccggacaccccgccgccgccgctgccgccgtcttcctcgtcgccgccggcgacgaagccgaaccctccctccagctcgatgaactcgccgtcgtccgaccactcctcttcctgcagcggcttcttgatctcgacctcgccgttggccgccggcgaggaagccgcacggccggcgctagaggtgttcgacgaatatcccgaagcgagacgagtcgagatcgacgacgacgacgacgacgtggtgcgaagctcgcggcgcgcggcggcggcgatgttgcgcttgcagatggcagcttcgtctctcatctcgctgaggagcgcctccatctgcgcgcgcacctcggccatcttgttgagctcggcggacgttcttgccaggaggaacagcaggctgagccccaacccggcggccgcctccgtcgt

SEQ ID NO: 49639 - DNA, 3025 bp, Oryza sativa
gtcgctgtcgtcgtggaggagtaggaaatccgagatcctgacgagcttcttctcgcgcgcgccaatggcgggcgacgacgccattgcgcgcaagacagagagagcgcgcgcgcggtggagaggtgaagaagaaggaggaggaggaagaaggtggattctaaacactcagtggatgtccactcattaagtacatatcatcatgaaaacattttaaaaaatttataagatagattgatataatatatcactacataaacatacaacttaaaatttaacttttataagttgtaacaaaataacaaatttaactggaatatacgtatactaatcagagtttgatttattatttttgttacaacttatagaaattgaatttaaacttgtatgcttgtaggatgatatattacatatgtatctatcttgttaaattttttgaatttttttcatacacatttagttattatgcaaggtgattaaaagtgtttcccgaagaagaagaaggcggtgggcgttggtggtgggacgatccacgtcgacgacgcgcgcggctgttggtggcgatggatgatgtcactccaactgacgaccaactgtgggctgatgtggcaactgcccctgaaaacaacgtaagtacatgggtagatagatgacaactgtcaggtccatggatggatgatggatgaaactagattaggcttgagttctatggcaaatggaagatagaaaagatagcaaatggatatgggtaaagctaattatgaaatggtaccagtctaaaaagaattatgaaatggttatgggaaaaattgggtatgaatataggttacgtgtatacccttcctagcgtcaggcctaatccataatgacggcctcatattttcacttatgcatgtttgtacttatcagctaaaatttaaattttcaatcttaaatttaaagttgatcttaaggtttttttcattgaagtttattttttagccattgcttttagatagctaagaacacgtatataaaaattttattaacatttttttttgcaaatatgccgtttcgcttatgcttaaaattagccaaacgatggcttcctgagatggttttatttttttccaaaaaattactagtttcaaattttctaggccacaattaattagatgaagctctcatatctattcccttcataaaaaaaaactaggcccagttaaggatgagatattatctagtccaaccaatctgagtaaacaactattcagatttatgggactaggtgatatctcaactagattgggtttttttttttaaatggagggagtataccgaactatgtcctcttgtactacctccgtcccaaaataagtgcagccatgagtttccgcgctcaattttgatcgtccgttttatttgaaatttttttataattagcatttttgttgttataagatgataaaacatgaataatactttactcgtgacttatgtttttaatttttttcaaaaaaatttcaaataagacgaacggtaaaagttagacgcggaaaatcatggctgcacttattttggggcggaggaagtactatctacggagagatggacatggagccctgtcatctgatcccatcccaagtgacacatcatcaaatcagtggctactcaccaacaactattccattccccaatgattgatcaccgatgcagtagggaagaaagccaccactacaactccacggagaaacaacccatctgctcgcaagcatggccaattggatcgccccatcatccatcgccgacgttcgtcgcaaatcgcaaagtgccatatgatgctcccaaagtcccaattgggggccatggcttctccgccccctgccagcgacgacacgacgacaagcagctgcagaccacaccaccacatctcggcaacacatctcctcgatcagcgacgtgaccatcgcggtcatgtgttgtatgtactcctgctacgctcatagtcttctaaccatgcaaattatgagaaatacctgggggtctttcgactaactccacaagacggtgggctagacgacctgcgtttgaacctcacatattctaattatttaatattaggtccttccctaatattcgtatttttaccatgcaaattatcagtggcggatctatgaggacggtagctagggaccgaagccccgtcatgatcagcgttgatcgtggaagccctcattattatttttacttagttatacatgagatatgttggtctagtttgtttagccatcatatatatatggcatcactaatttttttttcatagatcgtacatcttctttggaagatcaataatccatgctacaatgaacttgtgaatgtcatgcgaggctatgaattaattaatgaattaggccgagagcttgataggaatataagatgcccacgtgttggctcggctaaagaggacttttctccatcacatactaatttttagaataaggtggtgtcgaattatggtataataggctattatgggtaataggtggtgttgatttttcttattgtctttgcaggcgagaacttctttagcttatgccagctaaagaatttaagaatttcgaaagattgggtcaagagccactgggtagatttagaaaggaaaaaatatgaattaccccataaactatcgcagtcgaccgaattaccccctgaaccctaaacccagatattgctcaccctgaacttttaataccggacgaattacccccctcgacccaatccagagcggttttgtcctacgtggcttacacgtggcaatccagtcagcattttatttattaaaaaagtgggacccacctgtcatactctccttcctctctcttctctctctcactcttcctctctctcgctcgggtcgaccggcggcaggcgttcggcacgcacgacgggtaatgggcagcgcggcgggacgcggaggcccccgccatgcccaccgctggtcattgcgtcgctgctcccgacgactagcgctacagagagagatagg

SEQ ID NO: 49640 - DNA, 4858 bp, Oryza sativa
cccttatcgaaactagtgaaattaacatagttagatttgttcgggctttaaaaattttcaactaacgccgctgaatcaagaaatgccgtggcgtggtcgttgtgagatgatagtgagagagagacagagagtgtgtggtggtattgacgtgcatagatttggatggccggagagtttgggattggtcgttgacgactcgcccgccggggggggggggagcagccgaagcagaatactcggtaggatgtactcccttcgtctcgaaaaataaatctagaattagatataatatatttgagtataatgaatttggacagaagtatgttcatattcgtagtaataggatgtgtcacatccaatatcagattggttttttataggacggagggagtagggactagggattacttgggatatatatatatatagtgggtgggtccgtgggggagtgtgtttgtcgtgctggattggtggggtgcaggagaattgaatggcagcaggagaaaatgcaacattgctcccggaaactgactgctcaaccgtctcgtgtgcagtaatgtgtttcttctacacacgagaaaccatttattttttttaaaaaaaaagatttacttgaagaagttaagtatagtattttgttggctgtcaacatcaaggtggtcgtgccggagtggttatcgggcatgactagaaatcatgtgggctctgcccgcgcaggttcgaatcctgccgaccacgattgtttcttttattttccttttttctttgggacgccttgcattgcgctgcgcatgtgggataacctttttttttttactactgtacatttgtcgacaaattttctcctaaaaaattgacagatataattatagtacaaccgtagtgtaattacactgtaacttgcatgtaactacagtgtaacttatatgtaagtttcacataattttgaatcgttagatctattacaatatttgttttggtgaggaagaaaacaaatcatagcacacacatatagttacgacctccattttaccgaaataacatgtgacggagagatttttgaaagttacatacaagttacactatagttacagtgtaattacatgcaagttacagtgtaattacattacgattgtactataattacatctgtcaaatttttgggggaaaatttatcgacaaatatatagcaaaatcgttttttttttgcatgcttcattgggctgtatatttgggcctcaatttcatgggtattgggctgggcatgtaggacaactccaggatgggaaggaactggggcccacccaaacgagggctcccgtgttttaaggcatggaataagtctataatttgtccttcaactcttgctcctgattaaatcgtctccctcaaccgcaatactgggtataacacatcgattctcttaaccgcaataccagatataacacctccctaacatttgaaaaccagaaggaatcgagtccctcagctttcataacgctcatggcccacgcatgtcagtagaaaaaaaagaataaaaaaaataacagcccacctgtcagccatctctttcttttctctttatcttttctctcccctctctggttcttggtgactccgggcgagacggccgtcagctcttgtccggcggggtgcgagggccgggtggaggagtatatcgctggtctcaatatccgcatgcacgtcgtgctcgtggcgcagggtgcgcgtaataatccatatggcgatcaacgctcgactggacgccggagatgacgaggatgacaatcggaaaaagccggcggtgctcatcgccggctgcgccaaaggcgacatcagctacgagtactgcaaggccttctcctccctcggctgcggcgtcgtcgccaccgacatccccgaccgcatgccctgctagctctttgttgagaatactactatcagaatgcagcatgaaaccaacacacacatgaaaaggattcatgaaccagcaacacaatgcaattgtgcaagcaagacaacgttatacgtcgccgtggtgaatgtgggcagcgtggagggcacggtcgcgaagccgtgggctggaccctactgtgcgccgaaggcggcagtacactcggctcggcgagagctgctgcgtatgggtgaaaatattacgaaaactttccgggaatctgtcggtctgaaatttttcggagtttttttggaaatggaaatgaattcagaaatattttctcagaaacggaatcgaaaatgataagggtagtttccgtcggaactaggaatcggtcggaaactttccggaaattttctcggaatttccagatattttgtgactgaactaccctgtattccttttttatgacactaatgaatcgattttctagattcgccactggctgcagcctgcttcgccttgcgttgctgggctttcgccacctggtgcttcagtagttcagtccgttgtttcacctagcttcacgtcgtccgactttcgtcctatgtcgcttcgctaagctcacttattaagggtgtgtttggttgggcttttcaacctgcttttgcttttgcaaaagccaaaagctaaccaaagggcccaaaagccacaagtgcttttgctccaaagctgcttttagtgtagtacaaatccaaaagcagcccctacccctgctttcactggcttttgtgggaaaaaattacccacatatgccattacggaagaaaacgattcgctctttctttctttcccgttcccctttcacgaggccaagcgctggccatgggttcgacgcggcgctagggtttgccgccgccagcgcgcgccgccgtgctcccaccgccgggtgctcccgcctgtggtcccgccgtcgcgcgccgcatctaccggtgccggcttgctccatcgcccgtctccccgtcgcccgcccccacgccacccgacgtcaccccaggtcgcccgacggccgacggccgtctactcgttgcctgcccgacgccggtcgacgccgccccatgccggccgatgatccccgacgccggccgaggctgccccaggctgcccaaagccacccctgcccgacgccgccccacgccgcccgacgctactacgactccttcgccactgctccggccggcatgaaaggtgaggccgaatgctcctgctcttgtgttgatgcatgtgttgcccctagaatgttacagcaaattgatttttggcgtgcaaattgattgaacaaaaatttatttggttcaagaatgggtgacaaggcagattggggtgatggttttgtaaggcatttgtttgatgtttgcaaagaagagatagaagctgggaatagacccatgggaattttcaccactacgggttggaaaaatgttgtttccaagtttgcagaaaaatcgggtgacgagcgaaccaaaaaacaattgaagaacaagttagatgtgttgaaaaaggaatatacaatgtttatggagttcaagaattgtgccactggtcttggatgggatgaggcaaaacaaactattgtcttttcgccggaatggtgggaagaacaccttgatgtaagtactattctttcaccctgtgatattttttttctattctttgttgtagtgtgccttgctaactttatttatttaatttcagagatgcaacaatcgtgagaaaggaatcaaatgcgatcatgtgaagtttcgcaaacaaggaccaaaattcctagatgatttgcatatcatttttggcaagtcacatgttagtggggcttcagcatcatgtcctggaaatgtatcctccgatgaggcaagtgatgatgatgtggctgaggtaccaaaacctgcagagacagtgaaccccgaaaaaaataaacgcaaggggtcgtccactattgttcgagataaggatgagaagagcccattcgctcgtatgtacaagaacacttgtttgaagatagaaacggcggcagaaaagatttgtacaagtgttgaagcatcgtcagcttctccatgcaatgtagtccctaccattaaagaggctatgaagatgatgaaagattgtggggtagaagaaaaaactgctctaatgcacacagccacaactttgattatgaagcctgaatttagggaggtctttagctacctagaaacaaatgaaggaagactcgatttgatcgagagggagcatgaaaaggagatgatgaagcgttagtgattccctacattaaaattttatttttatcgattgttgccttgtttatgtgatatttgcttccctatgtgagaacactttgagttatttatttctatgttgtaaaccaatatttgcttggacatgtaaaaccgttatttccatgttgtgagctaatatttacttccctatgtgatgttatgttctgtacttgttgttgtacttgtttgccgttaattgttactatatcttctgtagatggatggaaaattagtagatgtagccaaagaagggcaaaagggatcattgatgctagctgaccttgcccaacatgcttctattaagggagaaatggccaatttgtacactgagcggtatttgcaaaaaggtgcatacagacaaacgccagaaactggaattcaatgggtgatgaggttgatggatcgtccaaggtatttttataagatgtttcggatgagccctgagatttttcatgcacttcatgacttgctagtctctacctacggattgagctcgagcaacaatgtttcatccattgagtcattgacgatgtttttgtggatcgtcggagggccacaatcattttcacaagttgaaagtcgtttcacacggtcactttggatggttcacaccaagtttcatgaagtgttg

SEQ ID NO: 49641 - DNA, 5834 bp, Oryza sativa
catctcagaatgtgctagctatttgtgactttgacatgaggtttatctttgcggttgctggttggccaggttctgcacatgactcgcgcatcctcagtcatgcattggctaattttccttcatttcccatgcctcctacaggtataaatggttccttcattaattttaatatttgtacactagtattattatttgcattactaacttagttttataggaaaatattatctcgtcgactcaggttatccaaaccgaatagggtatcctgcacctttcaaaggaaccacataccatataccagaatttcggcatcgttcgggacctcctcaaggaaagtatgaggtgttcaatttcttgcattcctcccttcgaaatgttattgaaaggtcttttggagtcttgaagcaaaagtggcgtattttgaagggcatcccaagtttctcacctactactcagaagcatatcatcatggcttgtcttgctatgcataacttcgtccgtgatagcaatttacgtgataaggagtttgagagatgtgatgctcatgaggactacttaatagaagatacaagtgacacgtcagacgatgagagtgaagatgcagagaatgatgataccatgaatactattcgtactaggatagctgatgctttgattagtgcaagaggaggatagttatttttagatatggcatcattgtatgaaccatttatcttttgctctgtttatgtggaccatatcactttgatggataaaaaactaatatatgttgatgaaaaactttgattgatgaaaaaattatacattttttctttaaaaattgggcattcaaatacaaaatattgaacatattaggtttgtatgagtaatttgcatataaacagtcccacatgccattaggggtattacaggtatttcttctacaacctacagtttcacagctgctctaaccaaacgggcttctgcttttttcacagctgattttcaacagctgcttttccacaggcacagctcacagcagcttttctaaaaaccacagctcaaccaaacaccccctaagttattatttcgcttagcttctcgtcgtctggccttggtcttgcgctgcttcacgatcgaggcccatttgttacttcgacaggacaatgaaaagttcccaagtgtgcctgcaacacccacggacccttctgaatgtcaaaagttaagtttaatttgattcttgtctgattaataagtacaatagttgctgtcttaaaatactactatgatgtgttcacgtgcctacaggattactacactcgacgaagattcatggctatctgtgagttaggaacgacccggccgtcgcggccgataggcaagtaacaagaatattgcctgttgtctatttattcatttattttctttcgatcacttaggcttatttagtttccaatttttttcctaaaaacgtcacatttaatctttagacacatgtgtggatcattaaatataaatataaacaaaaactaattacacaatttgcatgaaaatcgcgagacaaatctttagaacctaattagtccacatgattagccataagtgctataataacccacatgtgctaacaacggcttaattaggcttaaaagatttgtctcactgtgagttatgaaattagtttttttattcgtgtctaaaaccccttccgacatctggtaaacatccaatgtgacacacgaaaattttctttttcaaactaattatttagttccaaactttttttcaaactttcaacttttccattatatcaaaacttttctacacacaaacttttaacttttctatcacatcgtttcaatttcaagcaaactttcaattttaacgtgatctaaacacacccttaatcaaacaaaggtagagacgtcggagagtagctaggctagtagaacgaaccaaagttgccgcctgccgtcgtgcgcttgactagacgatgtaggagtacgcagctagtgccgtgcacgaccacggaaccagctgctctctgctctaagtctcacaagataagctaattattatctaaagctaattttaagtttaagcttttgattttgagattcatttatgatgttttctagcttgttactgagaagattaatttgacttgtgttatactccttccgtctaaaaaaacgttagatttaacataatatagtatgaacaagctcatatcctaatttgttgtactaaattgtgttaaatacaattttaaattgattttttagggcggtggaagtattacccaacactcctttcattgtttttaaaatgacaagacaaaaaaattgtcaaaggctaggtaatttaaatattaaaacataaaccataattacgaagttgatttcttatcttatttttagcatttgcctttaaaaaacatacataacgaagtgaacgtatagcttaactggttacgaatcttatcataaatttaacacggtgctcgtatttatgactaattaattatctatatgggttcaaatcgtagatttaacacgatgctcgtatttacggctaattattgttttagtggcaacatacgtacccaatcggtagtgaggtacccatggcgactttgtcaatttcatgatttaccgctcagtctcgaaggtgctaagaattagggtatacatgtatgtatttatagggtgagtgtatgtgttgtgagcatttacattatccttggttttttaaagagaacacatgcatttcatctcgaaatgaaatatttgttaggtgagtacaggtattataaaagtaagtggaaatgattgaagaaatagataatccaagaaatgattggttaataggagtaggtagatggagattaacaagtttgctattatgtttaattttgcatgccttatcaactgtggagcaagatcaagatcaagataaaaaatctttatgtgttacttgcttaaagaggtggtgttaacaaggataatttagcaagacggaattggaatggtagtctaaaatgttgtttctgtatgaaaaatgagactattcaacatttatttatggagtgtcattatgcaaagtttatttggatagcagtccagttctcttttggattacaccttcctagtagcatatctgatattttttatggttggcttctaggggttgacaagaaaaagagtaaactgatacttgttggagcctctattttatgttgggctttatggttgagcaggaatggtagggtttttgataaatcaccatatgtttactatatgcatgcaattttcagggcattatattagctccgatagtggacacaattacaaaagtgtgatgatgatgggaagttcctgattgttgcacgtcgtaagcttgaaacgatgattatgcaaactttttaccaattatagatggagattcaccaatatagaataatgttttccttgtcctgtttggttttcttctattttggtttggtgtgtttcttttattttagcctacactcttttaaagtgctagattataataattggttataactcaatctaaagaccagtatgttttatttcattatctaataatcaactgtggagcaaacaatagatactccacacacgacacgatgcattggattggaatgtcctcgtgtatccatatactccgtacacgatgcattggatgggatcagcattcagcataattttgttacggtgggtcccgtcccattgaccttgcgaccgagctcgcgtgcatctcggtcggccggtcggtcggtcggtcggtcaggtcggaccgatcgagctggatccagcccagcgaacgaacgaacgaacaggtgactgaggtgagcgactggttgacgcagccggccagtcgtacgcaccaccgcacgtacgcgccgctgattgcgacgcgccacgacttttacactattcatatataaagtttaaccattcgtcttgtttaaaaattttttacggttaatatttttattattattagatgataaaacatgaatagtactttatgtgcgactaactttttttttaattttctcataaattttttaaataaaacggacggtcaaacgttggacacggattttcgcaactacacttattttgagacagagatagtactacatactccctccatcccaaaatgtttaacaccgttgactttttcaaacatgttttaccattcgtcttatttaaaaaatttaagcaattattaattctttttctatcatttgtttcattgttacatatatatacttttatgtatacgtatagttttacatatttcacaaaagtttttgaataagacgaacggtaaaacatatttaaaaaagttaacggcgtcagacatttagggaaggagggagtatatatctatggctgtttagattatggtgaaaaattttggtgtgtcatgttaaatatatggacttatatttaaagtattaaatatagactaataacaaaacaaattacagattccacctctaaactgcgagatgaatttatcaagtctaattaattcgtcattagcaaatgtttacaatagcaccatattatcaaatcatgaagcaattaggcttaaaagattcatctcacaatttacacgcaatatgtgtaattagttattttttttatttatatttaataatccatgcatgtgtccaaacatttgatgtaatagagtgaaaaattttgtcaggggatctaaataggccctatatgcaaaactaatttattttttaagtaaaattcacacattacaaataattgagctaaactattggaaaactacattcttaagatgatatattacaaaactatacatttaacgataaatttatcacaaaactacagatttaaggctaaatatcacagaactacaaatttaataaaaaaattatcacaaaactatatattttgggtttctctaatattatgctttgagttataatggttgaaattttatgattaaattgatctaaaacttgtaatttgtgatagttatgtgataaattactttaaatatgtaattttataatatattatattgaatctatagttctgtgatagtttgactaaagtacatgtagttttataaaatttacacttattcttctcgaccagttatcaatatatttttgaaattggatgtaaaataatacgtttaattggaaaatcacaagataatcccaagcttttagaaatgcaggagcagaatgtttctcactgattttcttagcgaaaaatagtctccaaggaaaaacattaaaagtcgcggaagaagagaggaggaagcggcgagcgtggaccgggcccccgccgccctgcacgtggttgaccgcccaccgaggtgggcccacccgggccgccgccgcgcagcccgtttccactcgccttcctcgattcccccgcctcccgcggcacccgccaccgcctgccacgtgtcccgatcgagtcctcgtctcctctcgcctcgttttgtcgcagagcggagcgcgtcaaccagcttgtgtcagtagcctactttcgcagacttgtcttcagtaaaaaatgtatacggatgggcccacatgtcagcgtctctcctcgttgaatttcagttcactcttgatacttcacctcaagtgagacagtgaagtgtacagaaagtttggggagtttgtctgatttcgttgaattgttcgggaccgaagcaaatttgggattaattttgctcaaaaggactgcactacgtacacttcaaataattttcctccctactctacatgttacaagcgtcttttgccgacgcaaatatctgaatttttt

SEQ ID NO: 49642 - DNA, 9866 bp, Oryza sativa
cgccgttgttggcgctggcggtgaccatgtcgctgaactggctctgcagcgcctcgtacttggccgccaccgccgccagcatctcgctcagctgccggttctccgcgcccatccgcttcagctccgcctccagcgccgcaaccttcacaacaaaaaaaaccccaaatcagctcaagaaattaagctcatcacgctcccagccatggcggccgtcgatcgtccgtgcacgtatgcttaatcacatgacctacctctgggtctttcttgagaggctgctggtgaaagaagtcctcctcgacgagcaccttgggcttaaccatggcgacggccgccgtcgccggcagcccgacgcggaggtccaggctcagcgaaggctgggtgctaatccacggatccatcggcgaacgatttatcactgatccgacgacctagttagctagctcgatcgagcaaacttttctgctgctccgacgatgtcaagctgagccaaggagagaagagaggagaggaggagacgaggtgagaggaggagctgagccctaatatatatagagaggcgggaatatggcgaggatggtctagtcatgggaggagggaggaagaggaagaagaaggcgcgcgcggggatgtcgcgctcaaacgcatgtgtactcgtcgtcgtcgtcgtctggggtcacgcaggattaggaagcggaggggaagggaaatgagtaaagaaatggagggagggggaattcgagcatgcggatgtggcggaagaatcggaaggagactggagggtgaccggaacagctagcggcgccaactgaattattattttttaaaacaaaaataaaaaccacatccctctagttcttgtgtttgtcatctcgtcatttcataatactcgttttaaaatattactagggtttttgagtggataagacgttttataatttaacaaaagatggttatgattatttgaaataaaatatatagagataaattaaataaaacattgttataattgtttgatatgacatagcacaagaagaaatagctatattttagataaagagcctgtttggcacagctccagctcaaccaaacaatttcagctccacctaaaatagaaatagagttgggtggagctctctcacaaaataaaattaagagttggaactaggtttaggttgcttcacaattctaatttagacttaattacttctgaagctaaatttaggagttgaaactctaccaaatagtccaaagtataaatattagaaatctctatattttagagaaaggtatggtttatcttgtcaaaatagaaatgattaattaattaggggatgtaataacgagtgggtgggagactagtcaggatgtcggccagcagcatgatgcatggtctttgggctggatagtggggcagggtccaaagtcaagaaaatacaccacacatgcctgctattaataaagatccctatctgcatgccttgcaattggcaaagaagaagttggaggaagaaggggacatgcaagacttcttgaccccctactactaaatactcccccgtttcaaaatatttaacaccattgattttttagcatatgtttgaccatttgtcttatttaaaaacttctgtaaaatatgtaaagttatatgcctatataaaaatatatttaacaatgaatcaaatgataggaaaagaattaataattatttaaattttttgaataagacgaacggttaaacatgtgctaaaaagtcaacggcgtcaaatatttcaaaacggaaggagtaccaccttttggacccttgcttgtcagtgagcatgcacttgccaataataacttagctggatcagtgtctaacctcttaattcttccccttttcaactctactagaaactcattttcttggctttatgtgttttattagaaaaacactctctccatacacgaatataaacattttcaggttttaaattttgtttgcaaatacaatagctacatttattattcactggtagttaaatcattaggcgtgatttttctaatcaagtaaattatctgaggcatcaattaatttccacttaaccttaaattttgctaaaataacctaaaatctcacatatttgtggatggtgtactccctctgtcccaaaataagcaatgtaggaagggatgtgaccctcctactaccacgaatctagacagaggtttgtccagattcgctcctaggttgctttttttttttttttgactcccgttccgatttcatttcccccctatgcttaattcctagtgcaactgggcaaagtagctatagtactagagtatcttgtagagcagggtaggtgtgatgcacatagttagtacagtactatgttttcttggtgtctttcctggtttggtgagctccaaacttgaggggccctagattaacctcttaaattaaatcaaatcaaacatccggaaagagctttttgtactatacaatagcttaggtttttgccaaattttgactagaaatacttttggggaagactactctcgccgcacgagtcaatactgcatccaaaataaaaagtttgtttatgacaactaatagcatgattaatccactgttattgaccggcgggcgccgttgggtcgtttactaagcttaattatgcaaatgatcccaaattttccagttcttgtactactccaatgtagggttattaggattggaacgtctggtgttgacaaatctacaattcagatgtatcagagacttttcttttcgtgatgaagaaaaacggaaatgactctgtaattgttactgaaagatatgcaagattactgcagaagttgcagaagagacttgtcattgacaggaacaaagaaagaacgggttataaagtgtacttggcttgagccacgcacaacacaagacttggaccaagtggtttggttggttgccaagaacgagttggctatgttctctggcacacacacagcaacgggcaattcaagcaaccacatgacttgaggtcattgtgctgcaactagctactgtcgacttgcaattttgcaatttgtcctctcctgtttgctggacgaattgatggtgttaatttctttttctgagaatagtttggttgacaacttgacaaaggtatgtgtgaaaaaaaaaacaaaataacctcactgttgggcagataacagtaacacttattgggtttgcttttcaagatttttttttttgacttgtggcttataacttataagcggatgacaaattatcattaaaaacaattatttttaaagcaagagatttgcacttgtattattagcggtctaaaatccaaaatccaagaccgtagaccgggtaacaaaaataattataaaattaaaaattaactacgccggagttcaaacaagtagtaacactgtaacacgcaactgaaattctatatcgtgtaccagctagtatttttactattgtgttaatacggattatttgaatgtcgtctggctgaaaccaaaacgggacatctggtctttcagctaggttcgtttaaatcttccttgctgtacaccatatttctatttctgttcgtatcagaatcagctcaaattggccaggctgtggtggaacctcttcaccgaggttcgattcgatccgactcaccacgaatctcgcattttcagtgtattatgcagttatgctttaggcagatgatatatacatgaacaagggtacatctttatcaataataagatatactaattcagttctaagagctgcttagaaaaataagatatgcttataaaaaacgagtgtgtccgctcctggtgtgcaatattaatcagtgtacacggttctaaataggcaacggctacactctccattctaaaaagagccaacttttaagtatgaattgtttgtccaaatttatttataaaaattagcttttctttttatggttggattagacgttaagatacagatttatcttaatttttgttagtaaatggtacattttctgtaaaaaaaaacttttacataaaagtggttttaaaacatcatatacatactttttaagtttaaaataactttaaaaccttaattaactatgtattaataatctttttacgttttttaatttaatttactacctccgttctaaaatgtaagtatttttaattatgaatctggccggaggtagtagtgaactcaaacgggaccttagtcagcgacaatattcaaccaaactaatatactacggagttatccacagagagtgaaaccgatggagatcgaggcaggcaggcaggtgtctttgtcggagcacagtattcgcccacatgtgaactcggtgcgccgaaactgcaattccggctcgtgacaccgaccggacgctgctccgtcaccgcggtttgacccccaccatgcggccctttgtctccgatcgagaaaaccccaaggttcatcgcgacgaaaaaaacgttgcgacttaccgactctgcacgctgcgaatccgtgaccatatatgccactgcctcccggcggcgagaaaggtatccggtaatatttgacattatttgcttcttccattctacagtattccatctattaatttcattttataagtcactataaaaaatgcccgtacgttacaacgggtgaaggttatgttattatcgttacacggtttagttaatgtaaaattcactgtagaaatttacttacatatatttttctagaaaatcatgagctgcaattagaagcccgatcatctcaagttagcatgtaaattttttatttagatttcttatacgactcctcctatattttcaaaaagaacaaacttaaaacccgactcaaatatggatctgtattttcaaaagcgaacgaacttaaaaaccgactcatacacagatgatgtaccagagtacccgtaaaaacatctttaatttttgtaatagttgagatttaacatttttctagttaaacttatttgaatttgattaaatttataaaaaagatatagtagtattttcaacacaaaacaaacatattataaaattatattcaatgttatatttaatgatactaattttatattttagatgttgttaattttttttaaacttgattaaacttaacaaagtttgactagaaaaaagaattaaatgccttataatataaatggagagggtacttcttaaatataaatccttttccccttagatagctagccagatattcttatacttaggccatgttcgtaacaatgttttgtccagccttaacaactgcctacgaaataagatggattattagtttatgattaattaactattataaatttttaaaataaatttatttaactttttaaaaaaaacttatacatatatataaagtttttcatgaaacacgtcgttagcagtttagaaagcgcgcccataataaacctctaaatgaaaagaaataggccttatcgatgaagaaagaatttctatttaattgtaattttaaatatgaaataattaaaataaaataaaaaagtggaaaatcgtgaagacaaggcttatgttgtgtaaattggaagagatgtttggagaaaccaaattaaacacatcaaatggagcatagctcattcaattagttctttttcttgctcgtcaaggtttaaatcccaaatttaacactgttgcttgcatttttaattaagtggaaatgctatatgtgtgtatgtgtgttcatttgttaaaacatgtgcccttatatgaggccaggtttccaattttgtttagacatgtgtgttaaagagtattgacgtggatatttgtataaaagggttattggttatattcatgctcctctaccttgaaaagaagtattctaaaaaggttgacgaagttctcattatttggagagaagaggattaacttgtagtcttgtactacgtggtttagggtttgccaggtagaaagccaaattaaggtcttaattggctttcaacatctggactgtggattgaccgtataaaatcgatcagtggagttaatcgcagactatgatgtcgttgatcatcgagttgttctagaagctagaaggtgtacagataagattgtcgcctcgtgtacaaaggcatggccgcatgagttgagttgattccaaaacaatcaaacttttgctactttgactgaattgattccaactactaattaattcccctgtacacaaaagcatcccttcgtgattatactcacgagccggtatctgtccatctcagagaggttgtaagttatacgtagtatattcttaattcaccggtccatgtgtaatttacatttacattttcgctagttttcacgtttgcataggcaaaacgttataggttaattacacaatatagtaaatttaaccagatttgtcttaaaaggtaaattcatggtgtaagtaaatttaatagcttgttaacatcctttatactcctatatgatagcgagaagatctagcacaggaggccacgaaaattttattataagcgaggaaaatatttggggtgtgcttagctcacgctaaaattagaaatttaattgaaattgaaacaatgtgacggaaaagttaaaaaattatgtatgtagaaaagttttgatgtgataaaaaaattaaaagttctaataaaaagttgtgagctaaacaggcctgggaatgataatccagctcgtcaaagggacggttggaaaatcggagcagcagcagtgaacaacttgcaatatgggatcttcatagttcaatagcgtttggacaaattaagagaggaagaacatggacgcttttatggagcttgttactttgtcttagggcacccacaatggttatctataggctctctacaagagatccatgtcagcatattttcctacttggaaggtattaaatgaagagagagagcaaagctatctactaacttagagatagtctatagagaaaaacgaggcaatacatgagagagttatagataccaatgtagacatactattaaggtggtttactattaatcgagtctattgctgagatgtacatgttttatagatagcaccttactttaccattgcgggtgctcttataaggctacgatagatccaggtcgaaagaggatcttcagatttatttctctttgactttcagtcattgatacgtgggtttatttgatagagagctcatatatcagtgacctatattaaagaagaatctcaatacgttgaggttattctccaacggaggaattatgtagactaccatgcattctaccaagaggttgtgtttgttgttgtatggaatagctcaatgtttgaatgtttagctgatttgtgataattatggagagtataaacgaattaattacatattataaaattaagaaatgaatttaaaacagtttttataataattttatttttaactataaatttatatagtattccattttacgaaaatcacactgtttatggctcaggaagcatgcacatttattcaccattatattccctggaattgtcaaacggccacttgatccaatataattatataattcctttgtggcattagttaatttctccaacaactgtgatagcaatatggaattgctaaaaaactatcgtaagtttattcagaaaaaaacttttatatgtaactatagtataattatagtttaattataatataattatattgtaactacagtgtaattacactgtaactatattgtaatctctatataagttagatataaagttgcacatattattttagtacttatatacaagttatattatagttatagtaaaattatattacaattataatatagttagatttaaaagttttcctaagaaacttgcgatagttttttaatactcccttgcattaattaattaccgttgtgttaagagttaggtcatttttaggaccacggacgttttggcttgatgccataaaaaaattgaaattgttcagtaaagattcagttaagaggaaattaagatttcccttcattcaccttattgttcaaaaattgtagtttggattctcctcctaaacatttgattggttaaaaatacttggattttgagaaactactatattgtgcaaaaatgtttaaatcccggaaagagttagtagtattatatttgggaattagtggagagaggaggagtcagtaatgagcgctacctatcgaaactttgacgctacggaagctggaagcaatccaaaccagacctacttgaccaactctcaacgatatactcaattcgttttaaaatattgacaccgttaactttttattatttgtttgaccattcgtcttatttaaaaaatttaagtaattatttattcttttcatatcatttgattcattgttaaatatacttttatgtacacatatagttttacatattttataatttttttaataagacgaacggttaaacatgtgctaaaaattcaacggtgtcaaatattttgaaacggagggagtatatactctcttcatcttgaaataattgttaatttacaattttgattttgtctaaaaaaatcattttaggtacttttgtcacatcaactatcaataatttaaaactttctccatcatatactcaactatactctcactatcaactttacatcatttaatagctgaaactatttttttattagaccttaaattttttaaaaaacctagaacgataattattttgaaaatggaggtattgtggtatttgtattttctctcgtcgtacatactcgtagtagataggatacctagaaggtgaaaatggtatataaattttctgaccttaccgatattattttcataaaattaatattaatataataataacatctttacctactgtgactatattcaaattttaatttttttttcaatttctgtaaacgtgatactacataaatccataaatatgaaaaaattttcgatcattttccttgacaatgaaataatatactatttcctaccattttcgatcatttcattcttatttcctccgtctttaaaagacaacctcacattagaatgacacattcttactttctccgtctcaaaataagtgcagtcataaattttcgttttcaacttcaatcattcatattatttaattttttttgaaaaaaactaaaaacataagtcaagtataaaatattatttatattttataatctaataacaataaaaatactaatcataaaatttaaaataaaacgaacgataaaaattggacacgaaaacttatagctgtgtgtttattttagaacggagggagtatgcgttttattttttttacggaggagtacctgaaacctggatgcagttgcatggttgaacccacgcgtgcactctcagggaaaaaaaaaatgaagaagaagaagaagaaggcgacgacgacgacgcaggcggagatcgtagagagtaccccgtctgtcgctgtgtcgtgtcgtgtcgcgcgcggcgcccagcagcgcagcgggatatccacccaaatctggggactcccggattcctccggcatgcagccgcgccgcgtgtgtaccagccacacccacaaactccttctcccccacgtgacgcgcgtggtgcaccgccccgccgccaagcccaatgcccccacgcgtactcaccctcaccccgccgacgacgtccacgcgttggtaccaaaagagaagtgggcccccaagtccggtcaccctcttccaggtggggcccacgtcctgacgccgacgtcgtcgggacacgtggaccactggcgtgttcgtcggaggaggatgaggttggggggggggggggggggaataaaaa

SEQ ID NO: 49643 - DNA, 7012 bp, Oryza sativa
gacgacgcggatgcatatgcatatgatgcatatgcattgcacacagatgatctattgtactagcaactatacttcatgttttccacatgaacctacataaaataatttgagaactttattactctctctgtctaaaaaaatataaaaagttttagttagatgtgacacattgtatatactgtctgtacatattcattgtattaagatgtgttctatacaactaaaacttcttatatttgatctaaaaaaacttcttatatttgggatggatggaacttcttatattttaggacgaatagagtagtaaggtgcgcatatacataaattaatacacattgcatgtgtgatcgatatagatggagctagcttgttaagtcaatttttcaaaaaaaggaaaacgaaaaaacttgttaagtcaatcatcatatcaatatgcgtagacgaccgcaaattaaaaggctggtcgtctttctaggtcgtcaagatcgatcgatcgatcgatcgccgacttaattgtcaaacgaagacaagtggccatcgaattaataatcagttgacaaaacgaaaagagctagcgctagctaagcattatggggcgtgaaatttacaaagctataagcatgcttcaaattcattattcgccgtcaagtacaaatgaaaaacaagaaaagtcaactttcttatatcaaatatcgatcatatgatcaatatagctttatggaaaaaaaacagcttgcaccgattgacatatatatatatatatatatatatatatatatatatatatatatatatatatatatggtgacattagcttataccacgaatctggacagacgtatatccagattttttgtatttgatagtgtaacattctatccgatgttattttattttaagacatactccctccgtcccataatataacaatctagtaccggatatgacacttcatagtacaatgaatctggacatgttttctatccagatttgttgtaccatgaagtgtcccatccggtcttaggtttctatattatgggatggagggagtagatatcttgtcaacacaaaaacgtcttcgcttcttagattccggcgtatcagatggtttcaagcttcttactatctttgatgatagcctatctcgattgtttctttcggcacacttattacttctttgtcttaaacggccactattttaatttctataacaactagatcattttgaaaattagaaattctgttaagttattttcaaaaacatagtattttcttggtgattatgtttcttggctcgtgaaatattcacgtatacttggtgccaaggtgaccacatatgtttcatcgatccgatgaacataactaggggtgggcgttcaggcagactgaaaaatccagtctcggtcttcggtttttcggttagttcggtttttgtaaactcaggaccgaatttcatctaaaaaatctcagaaccgataaattcggtctcggtctcggtctgaccaattttttccacatccgctggagagtggagatggggcgacgccgaggtggaggtggcgccagcgctggaggtggaggtggcacggaggcggcggcctgcaagaggcagaggagcagctgcgggaggcggaggagcggctacatgagctccaccgtcaccgtcggcgtaaccagcacgagggaggaggggatggggatgggaagggcccggtggtcagtggatggagaggaggatgctggtggtggtgggttggataaggttttgcttttgctgaggaggtattgggcctaatgggctaatgctgtatttcggttttcggtcaattcggttaaccgagccctaaaactgaattgaccgaacgaaatttggtgagtagaaagtgctgaccgaatttttcggtctcggtcatttcgtttcggtttttttgttcggtctttttctgcccacccctaaacataaccacacgcacacatatgtgttgataatactatatgtggaatggaaggtacaaagtgttctggggttttttattttttggatttcaggctgttattgtaggaaggggctaattacaaaattaccaccacgctgagatgcggaggggactaagtgcaaaagtgatgtctatatggagtgccacattggcggtcatccccggtgaaacaaggtttggattagcttggtttattataacaaaatgatggatttagatgtgcaattttcaaatttatagatctaaaagtgacacttctctcgaatttagaacgaccatgtgttttactcattaatttaactaggtgattccccgcgttttgctgcagaaattagtaagtaactttttttttaataattgagctaaaagtaaaacaacaaataaaactggtttatcaaaatatgttaagagagaaataaattaagtagacaatgtatgaacttgtagatgaaatatgatatcccgtactttgattatatggatgaatatatgttaagtattataaaaatgatatatatatatatatatatgtgtgtgtgtgtgtgtgtgttataaaaatattgtgaaaaataatgtgaaggaatataattggatgttgatttgtagaatttaatgaattatagatgatgttacatgcttgcataagttttatatgtaattattgctagtggatgatgagttggcatgtttatatggtaagctttagaactagtggattataactgtatagtaagataggattttcacctctataacgggctcgcccaattaaggagaggagttattggacatcgatcctacgatcgagttgacaacagcgttgactttgtccaacaatcagaagcaaattaaagtctcggtcgccgttgacctaaacatatccatcctgcacgcatggctccagtggtccaggaccgttttccgttctgagcttagctgtaacccctgactaatcatccgagattgatttagacaaccattctccatccgtttcgattcaagcgtggataatgtcaactgatccgtacgtccgatcggtcgatcagctagctatagctgttaccgcacgtgccaacgaagataaaagtaactaatcttcttgttcttgtgtcttggtcgtcgtcgtcgtcgtcttcgttttactactctgctaattaaccagaggtttgactggataattaggttgctactactactagtagtacctgcttgctgctgatccgttactgctccaccaactttgacttcatctcgattgtcaactttgattcccgggtcaaactcggccgtcttgttcgatctgccggtcaagttcatcgatcgttcagtttttcttcatttgcttccggataacattggtgattttcttcttcttttttttcactttaacttggatcgatctacatcgtcgtgatttaatttgcaaacttatatgatgccgatcatatacaatctgttattttagggcgaagccaagtggccaatacacccagtatatatacgtagtactaatcaatgtttttgtatgccgtagtgttgtgtatgtgatttggattttgaacttttatttacgcgtttcttaatttacattctatttatattatttatttacatttcaaattatcagtcaatctatcaatttcaagtatctggaatatatcagatcataggcgctgtcactgttctacttgcaaaaagaaaggaggagaatggaggaagtgatgtctccatttcgtgacacgtgcgttcacactagctgtcaagctggagtatatggtaacatgttgccaatgccccaccgtcgtcgtctcgttgatccttaattcctcctcgcatgagacttttcgcacgtcggccatgacaaaatgatttgctttggtttgttaaattgatgcatatttttaaatttgcatatatagatcgaagaccaggtggacgaaatagtcccgaacatgagatcattggaagatcatatttatactattccaactaacaactccgttgattaatcttccgtactatcttggtgctcaagcaatatggacacatttagtggccggcacaattagttatgtttaaccaacaaccagtaccttgcaggggacccaataatgtcactcttaagttaattattactatactaatagattattagtgtactacattgccttagcaaacatgaaacaactactactgtacttttccgaattattaagaagtagtaacaatacttgtccgaattaataaacaaattaagtagtggagtagtacttgttaatcaaggggaagggcatgcacgtgctggtggctactggctagctcgtgtaaaacgtggagtatgtaggtgcctttggaagcttaagatgccacttaagattaaaatttttatgtggtacttgcttaaaggggttgtgttaactaaagataacttggcaaggcgtaattggaatggtagcttgaggtgttcgttttgtttgaagaatgagtctattcaacatctctttttcgattgtcatttggcgaagtttctgtggagagcagttcagttttcttttggatttaatcttccagttagtgtatctcatatttttgatgggtggcttttgggagttgataagaaaatgagtaaactgatacttgttggagcttctgccatttgttgggcaatatggctgggtaggaacaatatagtttttaacaaatcaccatcattttcctatatgcaggtcattttcagagtaacccattggcttcggttttgggcacaactacaaatgtgtgaagatgatgaagagtttctgaaagttgcatgtcggaagctggagactacggttatgtaactttttgccaattatgggtggagatttacaaatagatttcaataattgtaatctcctttgttagactggattctttattgttgcttgctgtgtgttttattcaattagatctacactatgttcgtcaatcgcttctatgtaataattggctgtagctcttttgagtaaagtccgaaatatttatttattccattatctacaaaaaatgtaggtgccttcttttggagcacgtggatcagatgcagcttcttgtactagtgatacgatacatcacatcagcatttgatccgattcagtgactcacagaggctccacgtggttgttggattgctttgattttgaaacagtttcgactgtttttgtggctagggagtagtctggtcgagatgcagcttattgtcttcacattcgtgcttctttgccgtgggaaaatacaaacagtgtagttcgacatcatacgtaaaggtatgttgaaacatagggatggtttggttagagcttcaaatcaaacatggattgagttgtagagcaactccaccctttcatcgttttttttcagcaaattaacatgctccgttttcaaatactccatatgtttcaaaatataagtgattttagatgtatgtgacatatcatattactgtctagattcgtagtaacagaatgtgtgacattccttcaaaatttcttatactatgggacataagaagtaattgataatctagtttagatttggttcgatcaggcaatttcatagaaaaaaactaacaatgtaaaaatgtatggaccattatgaacaacggagcaaacacaatggtttcgtctcgatgatcacaaacacaattaacaaaacaattgctcttaggcccaattgtttttctcaactccaaacttcaactttctcattttccattagcatatttttaaaattgttaaatggtactctttagcaaaaagtttctatgtggaagttgttttttttaaaataaataatctatttttcagtttttataatatagttaatacttaattaatctaataagttttctcgtttcgcgtgcactgaaaatatccctccaaccggagagaacgaacagggccttagcaaaaatatctatcctcaaaaaaaataaaatctaattcctccatcttaaaatatagcaacttaaaacttaatgagacacaacaaattagtaggatatatagtcctaatttctttgttatcctaatttgttaactgactgctccgttacgagtggacttgaggcccatatctcttttatggaccagaaccttggggcccggctcatcacctggcgcgacatgggcctgatcagactcgcgatgcccatcacgcagccacaccgtcatgccgacatgggcttcatcgaggcccattagaaagcgaagccgaagaagcccacgccccgtcgcctcgcctccacacctcccccttcctttcttccccgacacacctcgtcccgtctcttctgccgccaacgcgcgccccgcaccaccgccaccacggcgagcggccgcgcgccgccgatccgaaggccgcgaaccgaaaccctagcgcctccggcgtggcgcgccgcggcaatggaggtggagcacctctcaccgtcgcgatggcgcggatcagccgcctccgccgctgtccccgatgtcgcgcgcgcgcgcgctctgctcccgcatggagggaggttcgaggcatccccttccgcttccgttgtttttattatcagattcccagttccctacctcgctctctcctcgatttcgtttcggttgcccactgcgcagcggcgagtttggtgttttcgatggggggatttgtgcgggtttggggctgcgaattcggtcattcggtgcggcctctgctaatatagcgcctgctgctttaggccccgaataggggttgatctgggctcacgaaacgtggccaccttcgctgtgatcatttgtttcgacaatttctcttgcaaggcgcgcagattgttttacgcgagttgggaaatttgtggagggaaccgatttgtgggatcaatttcctggctataatcctcagcattacgttctattggctactagattctacgattttcgaattgtgttttcgagcaaaatcaagtctgatggttaactggacagaaattcgcatttaacggattg

SEQ ID NO: 49644 - DNA, 3576 bp, Oryza sativa
ctgaattgttatgttgtatgctgttttcatctgatcatgcatgtgctgctctgaagattgatcttgaagttagcatttggtacagcaaactgaatttgaatatgcatgcaactgttaaacacagcctaaaacgtgtttacatggatctctactgcattcccataatcaatcactacggttttggttatcattggtactggaactgccagtcaatttcttctatgtaacagtcgtcttagacgaagaatgtgcacagcaataataatatgtttgtgtctatgatgtcctttctattggacttgttcatccatatggattgttagttttgaactgcattcacgacttagcttgcatgccaacttcaggtaacactatgcaacaaatatacgaagtttaaattggaggtttcgtgctttcaaattcaacttatagtttatataattcatttgtatttttccattaaaagtgccaaatcttgaagctctttgtatttatacatccctttaggtatgtagtatatagcagtttgccattttatgcacacattagaacattgcacaggataatgaccttgaaattttttttgtcacttctatatgattttagtgtatgtcaggtagaaacaccttttttgtattatagaccctgtgtatttttgtttatatgctgctaaagcatccccttaacaagtgaaatatcctttcaagtatttttgttcttattgctgatgcatgacttcgcaatgtgtaagctttgtatacaaacacaaccagattgtcagtgtgcattttgttaatttccagcctagtacagatagctgcatacaataaacctaaaactggattggacttctcttgtattcatgtctgccatggtatgtttgtctcagagtaacatgtggcggtatatctgttttgaatataaattaattagcaagatcttgttagattgtaaaattaaattgttttgtttttttggacagaacctggactgttcttcgcgcatgaatttggctagtttgcacatcgacctactgtgtattgtgtgcatccaacttttttatgagtatgtgacgccatgtttcatgtccgcactatctgatttcggactatcttttgtttttccttgtctctttgtatcatcacaagatttgtgcgtgcatgtatccgtctagctagcttttaatttcatcacgagtattgtggccacagctgtagattctatacatgcaaagaaatggatggctcacatgcaaataaagattagcaggcgaacttccatttctttacctgaattgatcaatccatctgtatccgacatgcccacttatctatcaggttatattctcatttgatacatgaatgttcttcttcagtacaatccaggatcttgagagctgcggccaatctattagcccaaacttattttgttctactcaccaacttgtctcggatttctaaaacaagcttgactggagcctcggaaggagacaaagaggcttttattccggcttgtattgctgcagttgggccagaaaatcaagggacatttctggttgactgaagaaagatgccaaggtgagccatcttgttttagctccctctcactaacattatgtatgtgacactgatcaatatactgtctagaattatttgtgcctgtactgttcttttttatgagcctaaagcacacgttaggttgcatgtccgatgctgtggcagcataggaaaatagttgcacatgtgaatgtgagtatcagaaaatttcttctaagcttatccaaggcttcagcagatggtcaatagtattagctgcctattttataagaccaggcttggtgaaatatggtcaccttgtggtgaatttagtcctagcccactgtaaagaagcaaggagcatgcgggatagtggcgtggtgccatggtagggttaggtgaagtgggtgaaacctatcccacaagttcccagatccatgggtcgagaaataggattgaggaacacgggatgctacttattttaggtttaacatgggagggacaatattgttcccgtgttcccgtcagttccatatttcttgtgacgtttgactggatatcggaaggagttttcggacacgaatgaaaaaactaatttcatagttcacttggaaaccgcgagacgaatttattaagcttaattaatctgtcattagcacatgtgggttactgtagcacttatggctaatcatagactaattaggctcaaaagattcgtctcgctatttccgtgcgaactgtgcaattagttttttcatctatatttaatgctttatttgggtgtcgaaagattcgatgtgatgtttttggtaaaaaaattttgcgaactaaaccaggccttagggtgaaacccgcgaacaatccacctaagattaatggtaagctgtgacagtgattttcagaagaaaaaaatcgtctggaaaagccacatgtctgtaagattgtgaaattttctcttcttttgtagtaataccttagtgcggcttgtatctatgatctatctacaccaaatgggagtacatgatgtagctgaaaatttgaaacagtagcttccacatgtgactcgtgacctctcctagctagtagtcctagctactagatgatcgtgcaactcttgtacacaccatatcagggaatgcattttttgctgcaatacatttctttttcaaccaatggcatgcattccttgggtgtatactagactttttttctggcaacctgatttgatgagctgatgcgcagtttgtgcacaatgggcagctgctttctgaaaatgatttgcttgaaagctgacaccgcgaataatgtcgccctgtgcaagtcaacatgactgtagattgctctgcaggtttttgcactgtggaagggagattgaccctcgcttttcagcagcagcatgtgaagttagtgccatttgatggagtcacggtcagatttacatgcccatcacagtacattgagaggtatcactcaaattagtttctttgcttctctggttctgggctctagcacagtggatgcatgttccgttcagtttggtcactttccagttaacccagcagtagactgctgctagatagctgttgtataactgctatcgatcctgtctgctgcttcagagggcagaagctgggccacaggtcatagaatcatggaggaggtcgatggatggactctcagtaagtaagcaggcccttttagaggaattattgcttgacacactaacttgactttgaccacttgtctgtgcagctgtagcaactggtccaattggctaggtcccgtggggcgagctagagcccagcgatcgagatgcaatcgtactgccacattttgctcggcatcttgctatcatgctatgaattgcttagctggtgagtgtccctcccatgcttatatattgcttgtggtccttacctctcggttctagttcagaacgtggtaaaatctccagaattttatatgctaattttttttcctgaattatattttccgatccgattcgagccagtgctattgccatgtgcacattataccatat

SEQ ID NO: 49645 - DNA, 8948 bp, Oryza sativa
tgtctcacctaattgcttagaaatcatacagacacaattctcttctttaaatttgatcttgatgctggaaaattggtcccgctcctatatcgccttccatggacttgtagctagtctactctaggagtgcccatctcacaccagtcacatcttcaccacctttacttggagtatatttgtgcatccggatgtgcatgtgaggaagctacagatctatgcaccaatctatttcagggcatttgacaatcgatgcacaaactctcaagcgctgaggttatctggaatattttgcaaagcttttccaagagatcagatgcatgtacactagaaattatctagattacactataaatataaatacaacctagtacagatgtgacttattatagaactatgaatctggacagctgtctatctagattacacttatattggaacagaggtagtagtcattatattaaaaaagtacacaagaaattagtggggataaaatcataaatctgttagtagatgctgaacatgcttttccatttgaccttagcagctggctagctttcacatgtgattaaagatgtttctggagctgaacatgatccatcgagatgcatgtatcactgttccagaacagtgctagctccagataaactaattaaaatgaaaacgatgttagttttttttcctgctacgatgtcagcttcaagacgtaggtcatctaatttagttgtaccgtagctcactggtgcattcatgtatctctgtttggaattgtagctgggtaccttcaattgatctggtttccaaatatgggcactattttatcttttgaaagtgagttaattgatacggagttacggatgaaacgatacttttccatttgggatggaagatgcattgacgaaatcccctatattttacgaatgaagtagtatatatttaaatgtccatatggtgaaaaaaaaattaactggtcgatcagacaggttttttgctaaaagtagcagattttatattggcttgctatatagtttgggtgcccactattattaatttgttgagttttatgctcagattgatctctctgcaattgtaatctgtgaggacgattgacatactatatataattttagaatatgttttctgaatggttattattggagtatgtctctctactcaagaaagtattgtttcgaaaaacaagaatacatgttattctaacttctggctggtttgctgatgtatttccatgagaaattagttttcatatgagaatttcgaagtctctaggtgttctaggatttttttagaatattgcacaatgcctacatcgcaatatttgttttgcatcttaatggaacgatgttgagcttttaaaagggcaggattaatgtagagtgaagaatcatgtaatgatcaatccaaactcaattcatccaaagtttaggaactcccaaattagtaattatattatttttaactaccattttttcttttgatttttccttgttgaatttatcatcaattgtttgttagttccctcctgatttggctcaagttaaatctaatatttcaatggctggcaggttaagataccgggttatttcctcagtctcttcggtatgaactcaaatttacttcattttgtccttcagttcatataatagccatgcttagttactttaccttcatttggaaaaatctttggaagttattactggcaattcaaactaacaatagattttctaaaatgttgtttacataatattacgtatctctagatgtttagctgcaaaacagggttactgaaattaagtactagttgaagaatgtgatggacatagtacatagcaacaccttctcttaatctggaaatgaaaagctgcagtgtaaattcaactgcaagcaaattaagcatataagagaaaactttcttaaaaaaaactgaaaagtaaaactttgtgggaaggaagctagtgacaacccaagaccagatagttctgctggatatgacaatctgtaagttttcctgtacttacgtaggttataaccatccagctcaggttcgacgaccaggatgctatgctggatgatactctaactgtaagttttcctgtactttctagtgctgcttctttcgaggactggctatccatctattcaattgatacttcagtttatttgagatataggaataggagtactctatattgtgataatgtgatccatttttcttttgaggcttggtttagttcccaaattttttttctaaaaacatcatatcgaatctttgaactcatgcatgtagcattaaatatagattagaaaaactaattgcacggttagggggaaatcgcgagacgaattaaacaggccctgaaacctgtgatcattatagtggtatagcacctgggatcaatggtggcgtctgggctttgccagcgtctgatcgaacgtttgaacacctgtatgaaatattaaatataggcttaaaaaaaactaattacgcagattgcgactaatttgcgagacgaatattttaagcctacttgctccatgatttgacaatgtggtgctacagtaaacattcgctaatgatgtattaattaggcttaataaatttgtctcgcagtttacaggcagaatatgtaatttgttttttattagactatgtttaatacattaaatgtttgtccatatatccgatgcgacacggcaaaaatttttaccccttaatctaaacactgtctaaacgatggtccagctagctctataaataaacaacattttatccggtctacatcacgatgttctctgtgacatcaaatcttaaacactgctgaatctaatctggtcttcaaaagtttggtccaatatatatactgcgatatgcaccgactccttaaaattaacgattaaaaatatatgagaatatctatagtttggatatgatggaatatttatagtactcctaggatatagcttatcttgtacctgattccggccagctaaaagatgtatactgaaaaacaagttatttaaatttaaatgggtcaacttatacaccctgtagtgctgtcgttaacaatctagctcctcgcaaatggcaccatgcgcacatatatatatgcagctaattggagtttgtaaggcaagctcacaagctgctaaatactcccactggaccgaaataaatccaactttcatatctagagttggacttattttcggacaggaagtatggcgtagaggattttagccttccaataaacatctatactcatttaaaagacaatagtgatggtggtggcagcctccccatcatttcttttatagtttttacaattagcccctaatatttactgattttatagaatagtccaatatcttgttttaaacaagtgaatatcatatatatttaagtaagcaaacaagtaacactaacatattttatatataagtagaatagggtaagactattctacacccggggtatagaataactttcatcttcctcccgatccccccacccccaccttctcgcgcgcctcgcgatcccccctcccccacccgagcgcgcgaccctccccctctccttttttttttcctcccgatcgctcccctcctcctgatcggacatacatttgaagtattaaacgtagactaataacaaaacaaattacatatttcgcctgtaaactgcgagacgaatttattaagcctaattaatccatcattagcaaatgtttactgtagcatcacattgtcaaatcatggcgtaattaggctcaaaagattcatctcgcaatttacagtcggactgtgcaattggtttttctttcgtccacatttgatgctctatacatgtatccaaacatttgatgtgatgaaaaagttgaaagtttgaagaaaaaaaagttgaaatctaaacacggcctaagcaaatttgccatcagctatgcttttcaagttggattagtgggacgttatgggctgtgtttagttacacgctaaaattggaagtttaaagaaattgtaacgatgtgacagaaaagttggaagtttgtgcatgtaggaaagtttgatgtgatgaaaaagttggaatataaaaaaggccatagtatgatttgtcaaggggtacggacgtaattttggcaccagcaagtactaactaggtctagagtcgacattgctgtactgcgcccactctacccgccatggctttctccaagcctcaggggcagcggtcgggatgggcccacaacggccattcccaggcgtcgacggttggcccaccaccgcggtgaaccaatcacgggtcgacagcgccggtgccgaatgtccgacaaggacccgccgctccgggccccgagagcgaaccgcaaccaaaatgaataaaatagaatagagaaaaagaacaggcaaacaattcctttttgttaaattactactcgtactaggcatgcaatgcacgcaccttcgacggtagccaccgcgtgtgacggtgtggtgctgcaaccaaacgctgctgctgctgccagccactggagggttgggggatggaatcatggaagggataggcggatagctcagcagtggtcagctctgctagtagtaacaacctgtaggatggatgagagttattgtagtagtactttggtagtaccagtatattacgagtaggaatggtaatgtgttgagttatatatacccctgtaaaagaaaaaaaaatcctagctatgagcctaaaaaaatatgcccactccctccattcaaaaaaaaaatccatttttagggatgaatctggacatacaaaggttcaaattcattcttagaattagacttttttatggagggagtaggttagtagctaggattaagttttttataggacaaagtagtatgtcatttcacaatcctattagctcttatatatttttaggttaaaaatgtataaaaatttagcccatctcattttaatcccaaccctcaaagaaaaatgttagacccttcaccacccttaagtactctttttttccccttttactacctctgtcttaaagagattttgactatgtatttggataaccacttttaaattatagtaatgtttatagtaaacacaaatagtaaagttatactactatttagcattcaaaatactttaattaattataaaacttttgggaggaaaaaaaagaatagaagtgatcaatgtcgttgcatgcatgaatagtatctagtgccaactactccctccatcgtaatataagtgcaacctagtatagatgtgatatatcttaaactataaatctagacagtatgtttatttagatttgtagttttaggatactgtccaaattcatactaaattgcatttatattaggagagagggagtaggagtaaaaagcacggagggagtacaaaataaggtgcgcgtcaatcacattgattggggcatgcatgtctggggtccctgcagtactggtcctgctggtagtagtttcctctgtcactcaggccatgggattacaagggtcctactagtatttgcatcccgctgattctgtttgaagcacttcaatttcttaggaatggaaagccctcctatgtgacttcttctgggctttctatatgtgtgttataaagctggattgtactaatcatcgatgattaaaagaacaccccaatgttacattgcaaacatcgaatgtgaacaattaatatataatagagcggggctgcattgggaaattcggttgtaaggaaattcgggccttgtggtgtaaggggagaaattttggattatcttgccattgggagccagcctgcgttagaaaacatatgattgctactctgagtcagattggtagggactcttcatcatcaaatttgcctgttaagattgctatcacagatatgaccttgaggaggcacctttttattgacctagaaatcatacgttattaatatatatgaatgcaagaatagcttgtgtcagttgaccactactaattttagaacattttgaccacgtttggaatttgaatttttctaattcctttgggatttagattgtttttatgcaaaattaatgcattgcaaataagagtttatattattgtctgatagcggaattattaattaatactatcataatttatgtattactatatattaattaaatggacaaatactagctatagttatgagataagggttgcagtagatcgagttgtcaaatgatgtgagagtgcatgtcgggtgctcactgatcgtcatgcatgcatttcttcaatatttcgatctgtctgagtctgtccaactcagctatcgtcccaaagaaggcggtgcctatctagtcaatgcgagtatatcaaggccgagtgagtttagctccaaaatttttctacaaactttcaacttttccatcacatcaaaacttttctacacacacaaacttccaacttttccgtcacaacgttccaatttcaaccaaactttcaatttttgcgtgaactaaacacaccccaagtttgggggacaagtggagtagtcgacgtgaacgcaaaaaggagattcggagaaagatatccctccaacattttcttaagaagaaattatgagcgcgttgggaattgaacatgagacatcagggttgaaaccacacatcccttgtcactacattatcaagtgcatctcgctaatttaatttagttgctatgttcatctccatggccctgtttggaagattagcccagagctaattttaagagctaatgtttagtcttgaattagtaggctaaacattagcttaggatgatatgtttggatctatgggctaatatagggctaaaaggtggagagagagtagagagagagaggagagaggaagggagatagggctacttttttatgatccccacagaaaattagccccattatcaccccttggaggagctaatgttttgagggtggctaattcacttaagccttaaattagcccatatgtttggattttttggggctaattcagggctaaaagatgggggctaataattagtccatgtaaccaaacagggcccatgtcattgttgataaccgaggaacgtaatgcctcccgtcatcatattgtttttgtgtcggtaattcacttctatttcttgcgattgcaatcaggtcaacgttttcatacccttggtagcactgcaagtacgtcaaaccatgcaaaagagagaatccacgggtagtttgtttaatccttggggatgtcactgaactttaacatctcctgctcagctgcagcattccagctagcggcctagctatttggccaacatgttgtgttattacatgtttgatttattttggtgacatcccaaacagaagagaattggttgatagtattagtagttgattatggcatgtccaatagtccttagaatttgacattttatcagaagttctatatatttgtcaggggaaaggaggccagggaatgtgtcatctgttttgcaaagggtcatagagagcctggagacgaaaatcaaacacacaggacagattctgcgcatataaagacggccaaaagccatatatacaagtcagaggccatcattaatgcttgctgcctgtaggacaactcgatcaggtacgcattctttgcttctacggtattgctgcagcgtaaacggtcaaactaatttactacagtagtaatttattggcagaagaaatgttgatcaaaagtacctttccaaagttcaaaaatgaaacgtgcatgaggtgtacacagcatatctgattttaaggagaatagatgcttgaattgaatcaacataaccaccaccttcttatgctagctctactaatcaactactacaaaaacatgttctggacatctcagcgctgtcctaaaaatgactttggtagctaatatttattgtgaaacatttgaaaactcaataagttataatactataaaagtacttttcaaggaaaatctataattatatatatatgtaatactatgtgatttttcatacattcaatctaaataattaaaattgtattgatgtccaatgtttttaaagtttgagataaacatgtctaaaccgatatgtttgcgtgactggagggagaagaaatgctccagtgaaatcaaactagtatttgactttctgttcttaattggtctatatatattcatatgtcgcaatacaaatagatcatgcacatggataaaatattttcaccaaccgagctttccatgaccagacaaatatgtgcggcttggagcaaagctttcaacggccaattcaagcaatcagcttgaccactctaccacttactgctaaactagaggccctgtttcgtcgaatttaacgcaagggctaaactaccttacaaagcttcagatatggaaatcagcatggctattttaaaatcctaatacctctcttcaaagtttgccatgtacctcctctcagatctgtccaaggaagagactagagagtaaacaatggtcatgataaactaagatcaactaacttcatcgaattaatggaagttcatcggagataccattgtcgtactatgaacagtggcaaagtaaactttctttaatttttgggtgggatattggtaccttgtcctcctccaaaatctgacatgtaattaatcaaaatgcaagtaggagttctcactgtacacacagtgttagctcttgctaattggaacttcactactgcaaggcaggagcagggtctataactagtactactatgcataaaccttcagccctgggaggtacgaccatcacccgtcccatccatctcctctgctccaagaagcaaacaccaagaaacaaagagggagggagagagagagatagagggagagagtccttttctctcaccagctctcctttcaagctcagtacggtggccgctca

SEQ ID NO: 49646 - DNA, 1020 bp, Oryza sativa
ctgatttctttgcattaagagacagacgatagctattgtatccaccccgttgaccgatttgtgtcaactagtaaattaactacctaataagcttcctagaaggagatttattgctatagattcacctgtgtggatagaaatgtgacacatagaagtaaaaaagctaagctgccttgtcaattgaccgatctcttgcagggattgggatgagatatgattcaagctgatggatgctttacaaaagtcacttcatgtgcttgacatgcatgcgcgtgcagtcccattctgagaggtaattattttagcgcgttgattttgtcaacattatttactttgttttattgggtgtggttaactatgcatgttggtgattctttttaacagaaattctgctaatttattttggtgcatgcatcatgccctcttttcatgtgataattagtcaaattagttaatgtgatccattccttttgtgatggatccatcacaaacatggtatctgtcaaggtttgataagtatggtaaatgccaaaaaaaactctctgaataatttttagaattggccctgtagattttggaaaatgaactaattatatatgtcgaattattatgttactttctacgagttcatataaagagatcatccatatacggatatgcatttaattgccctcatcataggggacttgtataattaggagttgcatatgatagcattagatacatgagagcagacattcctaatgatctaaacaaaatctaattttatgtggacaatattaactagggtaaaattcacttttatctgttaaaacaacacagaagtatatagtcttaagaacagctcgaaagtagttgtgcaatagttttaccctttgccgacttaatagttttgttgattcgacgatgtgcttgtactgttctacggtggatgaaagaagtgtgagaagtaaaataatgtacgtgttgaaatgaaaataatttggacatgcattttgctgtatgcactggttaactaca

SEQ ID NO: 49647 - DNA, 4678 bp, Oryza sativa
tatcattttactagaattcagatttttcacatattggcagaaatctatctagatgaagatgcctctaggtctatcattttactagaattcagatttttcacatattgggcatatatatacctagattgttgaatctcttttaggctcaaagatacttactatggagtatatatgttcctgttaacattaaatttaatatcaaaatacaatttggtatttggtagtcgacacagtcaaagagtatacggactgaatcacctaagaaagtgagccatgctgcatcaatggatccttcaatgcatgatggatatccagctgtaggtgcacgggtagatcactttataattaggcatttcttaaattgcaatttacatctagattcgtacgagtagtatggaataacatcctaaattctaaaaaaaaactatatattttaggacacaggtaattcatatctacttcatcctatagttcagaatagaggtaatagtaccataccagcatacattttcatttttatcctttgtcctaaaatatagcaatatatgactggattatatacattttatatcatctgtctaaatttattgaagtaagatgtgtctaatccaatattaagttgctatacacagctagtccctttgtcctaaaataagaataacttacaacatccgtcccagaatataagaaacgattattaagaaagtaggtaaaattaaataaggagatgttctgattggttgagaaatgtcgaggtatgtggaaaaagtgaatggagggttgtgattggttaggaagggaatattagtggagaaattgttagattttgagacaaatcctaagtgctaaaaattgttatattttaggacgaagagtaatttctacggttcataccctattccacagtaaattgatttttgctcttttagctttgtacttggacttgggattactaaggtctaaggtctaaggggttaaataggtaggcaaaagatggtcacaagtgaaaaggaatgggattggctttgtgcggaggaaccattcttgaaacccgcaatacccattccttaaaaagtactgcaaattcattttccctctagaaaaaaaatttgtccagcgtgagtcaaaagtaatacttttttctatttcccttcacgatcaacctttcggattttagaagctaagcaacccggtgaaaaaagcaaccgtattaataggggggctggctgctcacttgaaacaaagagctgctctgggtccaagaagcgaagggaatgagcttggcttctgctcctccacgcttctttgggcctgtttgaggtagcttctagcagctgcagcttcttccagagtcagaagctcccctaaacagttcagcttttggtccagattctgagaagctgtagttgagaaacccagttttttcagattctgagaagctggctaccaaaccagctgcttcttataatcttaagctctccaaacagggcctttatttttccgtgccctttctgctcgtgcgaattcacaaactaagaagttttattactttaatacccttatctatcgattcaccaatagtaatttttcttttcattttgtaataactttttctccttttaaaagtgccttaaaatgtaaggggtggttttttttgggtggatgataatgggccggatactccctcccctccattcccgaatataaatattttgagcgtttaaatttcattcataatttggtttacaccatcagacgttatttttccgaatcaagtaaacttcatcagtatgtccctaatttcaactcaaccttaatttgtgttaaaaaaaaaacccccttgaaatgccttaggatggtattttgttactttttagctgtcatattattgtaggcattgctacggtcaccactgtcacttctgatcattgtcgttttaattaagtaaaatatgttaaaaattcagtggtgagtattttgttgaccaattaatctagcaggatttagaactatcattttccatgtgacataaaaaaaaactgtgttgtcaaagtgttgggatataacggtatatatatgtgtgacaacggtcttcatcgacattagtacatcacattacatcgttctctctttcagattatacgcagctgcaaaattcaagacataaattttactacgatacttgagtaatgtgaaagttctatgatcttaacagggcctcaatcttggcgcggctggagacggacactgttgaataaattggaactgatcgaaggctcgaagcacagattatactagtatacacgagttctagatggatgcatgttgttagcctccagatatcgtgtttatgttcttcctgtctctacaaaatcttttctctgtatcctccaatgtacagttatgcttttttatttaatttgttttgatttctgtatgtataaggattgcctcatgatcacaatagtgtatatgttgtatatatctatcaacaatgtataccaagtttttccacataaccttatctgaagcatcctttaataattcaactcatatccctgatgatatacacattggttgttcttattatctgcttttaggatgaactcccagaaattggcaatttgccagagatatcgaactgaatcaaattagtgagctatgtaaactctgagataagccgtcggtcaaaagggatttcttcagaaacctatcaaagcttcgacatcagcatgctcgcgggtgaattttgagggggagaactttgcctgtgaagctcctgcaataatcaagataccatcagggatatgtatgtgatcatttttgtcagaatcggaaaaaaaaagttgtttcatccagctatttatatttgatatggatttttcagaatgttccttcctcattctgctaatgatcataaatatgagtatctatgctatcatatggttgtttttttccaatttcaccttttccttttgcttaagatgtagaagaagttaatcgataagcgattggatttttaccttggtattggaggtcttcttgatgaatcctttgtcttccagggacttcactgcttcatacaggtattcatgcacaggtgtgaacttgatgcctagatccttcagaggttggtttgtgaacttgtagcccttctttggtggatttatctcatccctgcacctgtagaagtaacatgtaacagattagattgggcatcaaccagaatgtattccactaagtataaaaacattgtttagtaatctacaaggaattgcggagttcagacatcacatatgttatatcttgaaaacaatcgtgttattgtctttcaagcaaaggaaagctattgttgtgtcttcagaattcatataccactttctattttgtccacaacaataaattgccatcacaaggaaatataggagggctttattacgcacaggcgcacagtaaaaggaaagaataatttccactgcgattcatagtttgagttatccaaagtactaaccatggcattctaaaatgatcttcaagccactgactaacctgagattcaagtacctcatggcaagtcactagtgcagtagttcttcagtttcgatattaagaatttcagaatactatcatataatgcagaggtagagttttggagaaagacccatgtcttcccttttcttttttctagatagaaggaaaactatcatacacccaaccaaacacatcctaattgtgcaatccagattagttgactactggctttctgacaaagcaaattgcaaaccatgggaaatactagttctcaaactctctagtccctactgcctttggtagtacatagctgtcagcatgagtgcatatttggctacttgacaagttgacattctgcaattgctaaaaatcgagcaaccgaacatagctaaaaaaaattgatcaacaatcacaaaattccttatgaatacagccttggtatgaaacagaaagatcaatcagaattgctgttagtaccagtttggatgtagaggccggtttaatccattatcaaagaaaacaaaagtaccttgtagggatcggatactccgggaagaggccggcgaggatccggcagagctcgccgcggtgcagggtgcgctcggcgcagatgtaccggcgtccgccggcccccggcgcctccagcaccctgacgtgggcctcggcggcgtccacgacgtgcacgtaggcgtgggactcgttgacgtacgtcttggcctcgccggtgaggtacttgagaatgtgcttggtgctggtgttcatccctggctgcagcagctcgccgagcaccaccaccgggatcaccaccgccatgtccaccccccgacccctcgccacctcccacgccttcctctccgctatcgtcttcgcgtagcaataccaattctgccattccatcatcgcaatttgcacatttgttgattcgcaggtgatcgagaaatggggatttaaagtatccaaatctcaatctttgcaatgcaagaaatggggattagaaaaccccaatctttgcgaggaatggggattgaaaataaaaattcagagtcttctgccatttcattccattgcacaacttgtatgagagaaaaaaatggggattgaaaaaaaaaatcaatcaatggaagtatggggattgcaaaaaaaaaaa

SEQ ID NO: 49648 - DNA, 2427 bp, Oryza sativa
  unsure (1)..(2427): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtatagatgcagtatcaccaggaagtttaccagctctccgcttgcgaaggatctcttccctaatatccacaagcttttctttgtacccctacaggcaggacattttggttcacaaataatgcactacgatgatggatgaagcatttcaaaggacaaaaggctacctgcttaagctcgttcttcagctcatgccgtacacgctcaaccaaggatctttcaccctcggtcagcattaagggaccaaagcccatgccgtctgacccatcatttccatcaaacatgttggcttcactgtccacttggttatcttcatcatcagacatagtcgctccagtcccttcaccaggagatgcccctgcagaaccaatcatacaagcataactcagttgtccgaacatcatctaggccccttcagtaagaagtatcagactttaagatacaaatccgagcacaaaaaagggcatgttctccatataaagtggtgaacagctagcttatcaaactcaactccaattgtagttacccagcgttatctacaagcctggatcaactcagaattgttaccaaggcctcacacatgcctttgagattctgatcaatatcagcatgtgtagtagagctcagaaaatgaacaaaatcatatttaagattttacgtaatagttggtagcttatggctgctgacaagttggcacggattgtctctgagatctaagtttgcttaatcctaagcttattgtagggcacaacaaaaactcctttttctgatagagtaataattaccaaagtgatggttgaaatttaaaaaggtattgaacatacattcttggtctcaaatgaatagtgttgaaaatgttatgtatacttcttttcctttctagtttcaattgatctactatgtagtttcccattgcaattggactgaaactaactcatagcaaattagcaatctgcttgcctgaatattatcaatgaaataacaaaaaaaaagtgtatgtttgaaattttctaccatttgctgaactgattcaagcagatagaagctttggtctacctgttagactttgtaaagactgttcaagttcccagcaccccatcactgcttccattgcatgaacacgcacatgctgctgaagttgttccttgaatgagcaaagaagcaacacataatgtgtctgcaattaagagaagtatgttagagtccacaagaagggctgccatgtgaaaaacacaatgacatgttcatttccaagataaggagtaacacaggggtcataacgtcacagcaaatttcgtagaaagagaggtaatggcatcaatacatgagcttatttttccagttaacagcatgatgagaacaaggtattgtcattagatgagattagcatagcacagatattaatagcaaatcaataatcttggcagggaactttcattcatgcaaggttttacatcatctcagaaactagagaaatgggcctcagctatttttccactttgatagcttttggtctagatttatgagcctttgaatttgtggatttatttcttatttatatgactgtgtcccgtttagaaggtatcaatggatgcgggagtagcaataattatcaacgggtgatagaatcctttcaagcaaacaattcttgtaacaacttcataatcactaggacaaatccacaatatgccactaagtttcaactatctccactacgtgccactcactataaggatgtcactaagacatcagtggcatatcaaagtcatctacaacaacaaaacgggctttgcaacaaaataaccatagtacaagttcacccttgtggtgattttcaaggtatagtgagactgtttgaactttatcctgagattttttgtccaatttggatgacaaccaatcataagcataggggaaacgtgcaaacttactactactactaccatataaagtccatacaatagcaaagcaattgaaaaatcttattgcagataatccaaacaaacttaattgtccatttcttttcctcccatcgccgtttccccgacctgcagcagaaaattctgcacgcggaaaggggcataaggaggggcctgggagcggagaggcgtaccatgaagaggtcgagctcctcgccaccggaggggccaccggcggcggcggcggcggaggcggctgcaaagggaggcgggcgcgcggcgatctgcgcgtcgatgcgg

SEQ ID NO: 49649 - DNA, 1086 bp, Oryza sativa
ccgccgccgcacccacacgcggcgccgcaccacatgcacgtcatgcccggcgccgccgccgccggctacgccgaccagaccgagtgcacctccggcgagccctgcaagcgcatccgcgaggagtgcaagcccaagatctccaagctctacgtccacgccgacccatccgacctcagcctggtacgaatccccaaccccaattaacatccgatcatctcatttcatgtgcctaacttaacttctttttgttctgaattctagccttgattaattaattaatcctgttcttgcaatgaatccatgcaggtggtgaaagatgggtaccaatggaggaagtatggtcagaaggtcaccaaggacaacccctgcccaagagcctacttcagatgctcatttgctcccgcctgccctgtcaagaagaaggtaacttaaattcctctaactaattccaaagtgatttcgtaagttttgctaaatttagtgcaaattcgagcctgtttctgaactttgttcgtggttcaaatgttgtttcaggttcagagaagcgcggaggacaacacgatcctcgtggcgacgtacgagggggagcacaaccacggccagccgccgccgccgctgcagtcggcggcgcagaacagcgacggctccggcaagagcgccgggaagccaccccatgcgccggcggcggcgccgccggcgccggtggtgccgcaccgtcagcacgaaccggtcgtcgtcaacggcgagcagcaggccgcggcggcgtcggagatgatcaggcggaacctggccgagcagatggcgatgacgctgacgcgtgacccaagcttcaaggcggcgctcgtcaccgccctctccggccgcatcctcgagctctcgccgaccaaggattgacgattgctactgatcgacgcggcggattcgatcgcttcttcttgcaactgcgggcatggccattgccatcctctcctgtctctgcctctctgttcttggtggcgccagcaagaacacgatcgacgcggtgtccatccatggcggagttcgatcgatcgattgatcggctagggaggaattgatgattcgctg

SEQ ID NO: 49650 - DNA, 3107 bp, Oryza sativa
cctccatgtctccccccttcttctccgaccagcaacggccatggcagcggcggcggtcgaagcttggatcgcaccggggatgcaggtcttcgctgcggaagacgccgccgccggagaggagcccggagggtggagaggagagcagcgacgccaccggcaatgccaagcccagcatccaggtccgtttcccctcctctctgctccaagatttccctctcgtagaggtgacttctctcatgtggttttctcatgtgattccatgggtggccttcctgccctggtctaactgatgaatataaatgcaaatgaaaattgcacacagttgattatttattttttttgaacgaatcgacgaggctgccaatttcattgaatagaggagacgaaaactgtacaaaaaggataaggtacaggaaaaaaaaaacagggccgtggccctaactataggcagttacattgtcaaccaggcggcgagattttttccgcccgccaacccccatgtttttcttcctcctttatcttggctagcagagttagcgccggcaactccttgtgctggaaagtcctccggttacttttgttccatatctcatagctaaagcacacagttgattagaggttagctcatgtggactatcgtcctgcctcctgatggagacttatattgtcgttaaatgccctgcgatatgaatatcagcatcaaatgtgcttcttgtttactgttcaacttggtttaaacatgttgaatgctgactggacaggactagatatgaggcattccaaacttagttgacaggcattgttttgacagcgtaggtggtttatgaaataatttatccttttcctaatgttgactgccactgaactattttcattcttttcttaatgttgactgccactgatctaatttcatcgctccacgttgtgtcaagacagatgaagtgggatgtgacaggaggggagttgttttggtggtgagtttgagtaccagtggtatatatttttgcattattgtgagtagtcttctctagtaaattactgtttcagaaaatagtttatttatctgtttgggcataatttacaatgtcttgggactaaacattatcatccactgtataatatttctttaatgatgacttggtgccaccttggcaccttctcattttcctgattctttccagcaaatctactatttttcctagtcatttgctttcttaacttcagtacattcctcatgcaccagcaaggccaattaaagggtattgttgttgcatcttcttttttgtctaacttttctaataagatcttttcttctttgctcaagtggatcactagctgattggacgtttttttttatctctggcaaattgtagtttttagaaatctagaattcagcgcatagtttcatgcaggcagattggaatgattatgcgtattccatgtccacattgcggtcttcattaggcttaggtatggtgtcaggacctagtcataagttattctcagtctgcatatgagagccaacaacaaatatgcttttgtgtctttaatttgtagcctcctatttatgttagttctttagaccaaaaaatatcaaagaatgttctttgaatagtttgaataaattttacatgacatctgacataaacaattgcacttttgtcttgatacaaacagaatatcttttattctgttctgatgtcactaagaaaatgatttatatgcacctcaatgttgacttttaaacttgtccttttgtctctactaatactcccttatgtccttttgtcgctactaatactcccttactcccggtgaaaaaaaaatgtcatgtagttccccttagaccatcgcatttcctcgcttgtttgatatcgtattcctaaccatttaaacatcatattgttatctagtatctttcatacaggttatttcatttcctccaaactatctcttgtttttctttgctattcttggctacactctgtggacgatgctagaggaatcaatctgtcagtggtcatgactttgcttcttatgatcttatccaggttttagaggaaaaataggaggacactaggttatgaacataattatttgttcttttgtttgtatgttgtttgtatctggtattattgtctgaagaaaatccaagttatgattaggtttatgagggccttgtccagggcctactgattagaatttgagttccttttcatgccatatggggttggtacgatgtgatcctaaaatggatatttttcttctatggacttagtttaactggccccatcaaattgatgtctgaaagtttctttttttttaaaaaaaaatcctgggatgtatgaatttaatatatcatatgtgatcttgtgcaagatgaaaaaattgctacaatataagtaatcacacccattttttattatcctttgctttctgaaactttactcattcagtcaatgatagttctttttttttttcagaccagagaattcttcagatgtaattgttccctttgaattttctgattgatgacagcaagagaggacccaagcacaggctgtctgaatctgtgatttgcacatgtgttatttttctcttgttacacagttaatctggtccattttgatgatggaatcttcagggtttagacttagtaggaggcaagtgctaattgaacttactacactattggggtgtaatttttttttatctatattccaagctgcaaatttgcaatgaatttctttttttttttttgcatccatttgcaaagcttgcagctcacacacgtcatgtatggtgatgtatttacaacgtcgtcagaataccaaaactgaatggagtttcagaattcccgagggtccacgaacaggacggacgacggcggcgccgtcgtccagtcgtcgtcgtcgccggcggcgggggcggcattgccgttggcggcgacggacgtgattttcttgatgcaccagacgtcctcgtcgcatgagaagcgtcgccagtgcggcacggcggcggcggccgggtcgtcgggcgcgacgtcggcggcgacgacggcgcacgccgggttgttgcgcgccacgttgtgggcgtggcggcagagc

SEQ ID NO: 49651 - DNA, 4290 bp, Oryza sativa
aattaaaaaataatctgatcagtatatgctcaagctatttcgtactggtcagttaaataattagtatgtagctgcaggtctctattaaccccaattagttaagaataattactagtacttcacttgtggacttgtcgctgtgcgtgttcaacaacttttggtcgattgatgcttccttgatcctctagtaaattgcacatgtcttcttcaatcatatatagcttaaattgtactagtgttaagatataattaattaccgggaacttgctaatgacttgctgagtgttttcttgtccaatcctaggaaagtttctgccctatataatactacatgcttgggttacagagtaattaagcttatcgatgacgaaaggttaatttattctatacacgcagtcaagtgaattctgaattaaacaggggacaatgtacctttcgtaaaatcttgtttaggtgatatcatacaaactaatatatacaatcattacacattcgtgcacatttagcgtaaatttatgtgccttcccacaatctataggatatgatcggaatatttgatgtatttggaattttcgagcttgtgtagagaagaccatatatggcgttcacgaaaaaagatgtgttcgggaaagaccatatatggttgtagatgtagtaaatatgcgcgttatacttatttgtcgaaagatgtggtctgcctattaatttttctagaattaacgacaaattaccatttaacaaaaagatttaacaacttgacgttaaaatgctttctctatcgacagacatctgacgcgaaatctggatcatggtgtaatcaacgtaagcataaatttgagatcaaattaagttaaatcgatcagagagtgtatttcaagatatgtatttacagtcgcgttgaaatatttacagttgatggagcatatttatactactttgagctagggacgtatttacagtacagtagatcagagatccagtgggcagggtgcaattatcgcctctgttttagtaatatggtagcgtaagttagaaaaattaatggtcgattagccaatgaaatcttgatcaagatatagtgaaaagacgatgaaaaagaaaatattggagaggagtatatttgtacaacttgtgtagcttattagctaatgaactaccaataatgctaattagatattgagcatatatgaaagcacatattgactaagctagtggcgtgttaataattaaggttgacatcgtcttgaccaggcgagcataccgggttcatttccaattaattagtgtgacatgtctacaagtgtagtaccattaacatatatacaatctcccctcgaggaaaaaaaactttataatctatacattagaggaggtcaaaaatagttgtgttcacattgagtgaagtctatatacaaaattagttagcctgtgtacaatgcattctgaattttattgcctccaggagtgctatttaatttagctcactgtctgtttgtatgctaccaaacttggccacataatttagaggttgcagttttctttccagtaatgactttgtgcagtgtcatgtgtctcattatcttgggtccaacttgtgctagatagcttattatttagaatcattcgagtggctaaacttggtacacatatataactagcaatgcaactagtttaattttaatatttggtgaagcatgatgtattaatgaataaatgatcgagatgtatatatgtgagagaatattccagtcaaatatgcaagtcaacttaagaacattcatgcggatgtcactgtttttttcttgagcatataagaatccattcaaactaattaggttatctaatcatccatatataatatattatatatatgcactgaaaataagatttgttcgtttctgttgcattccaagtcgatcagggactctagctattgacttcgatcgtcaagtactccatatacacttgatgaagtcaatgaccaagtaaaagaccattttttaaaaaggtaaagaccttgcaagacgtgtctacatcgatactggtattatttgataggtgccttgcttagaactaatcataagctttgttaaccaaaacaataaaatgagattaattaattgttaattaacacaaagattaactgtaagaataaattgcacacaaataacggagcatgttgtttcattaaccttatgtatgaaaaaaaataaaggtcaaacttagtgattactcccttcggttccattttaattgacgttttagataatgacacggtctacaaaatatatttttaaccttatttttctattataatatatataataaataaatatatgtttacttttattatagcgttttgaaagacaaatctatatatgttgttctagttcctttacgctaaatattttttaaagttattgatggtcaaaattataaaagtttgatctccatcttatccaaaacgttaattaatatggaaccggagggagtaattatgagttgcttagctagctatatgttgtacatacagacatgtgctcatggttcacattgaggattatttgtagcaactaatatagattctcctatctctccacttggagtgtacatggaatcaacaaaaccaattagtacctactaaagatcatgtcacgaaaaggtagggcacatttcgacatagcatcatgatcagaaaatatacattttggttcatagatagattgagctactgcatgcaacgatgcgtatctaaccaaactattttttttctgagataaagcctggaccatgcattagcggttagccagctgcctgcacataggctctctcctactcaggttcttgtcggtccacaggtccatctaaaaaaacactatggttcatgttccatagctagctaattaaagattcacattgtccatgatccaagtaattccgtttaaaagaatgcacgccaatatattagaagaaaatagagttttagttatacgacataaccgactaggtggccattgctacaggacaagaaaacagagttttagttatatgacacaaccggccaggtggccattatattgctacaggaagctaaacttgaaaaaactgctcctacaaaggaggggaggggggggggcttagtcctactagactcccaaaagccgtgatgcctgcagaagaccacattcagtcttctgcagctaattattttcttgtaactagctagggaccatgcatatattttttttaaaaaaaagagggcaaaactttgcctcgtatatattgatagagaagaggaccatgcatatatgcgcgcatacgcatggttatattaattactccctccgtaccaaaataaatcttcgagtatgataaatctggacatacatagatatgtcacatcctgtacgatgttggtttattttgagacaggtggagtatgtgtgttcatcaatatcattcatacatttagattgtttgtttggaatctgatcccagatatgctgtgatcaaccgcgatttaattctgaaaacgtgtacatgcatgtcgccttcaaattttcaggcaaatcatgaaaattaattcatttcatacagtttgatccggttgttgcattttgacttgaatatatggcttgcccaccagttagagaagtatctatgtatatacttctttaatatatagttttaaaaattttgtcttaacgtagctaatcatggtaggcacgtacacaccgactttaagtaaattgctcccacttactcaaggtttggttgtgtgtaattaatcatgcatgcaaagcgtgtattatatttgcattccttaattatcatcgaatatacttaacttatatacatatttgtgtcaattaggacacttaattacgatcatggcatgcacttatgcataattagtctgctagtgatcagctcatcgatcttagttggtttctgaaacgtagtatatacaccacctctatctcaagaaaaaaaaacgtacagagtactagctatatatacatatcaaggtatatctcgttctggtactattgagaaacaatttttgaggtattctctgcttaattaaggggccatatatatgtgtacagaaaacatatatagtgtaattatttgcacgatatgtttctttaaagagaaaaaaaatcctccatgcaaatcattacatcatattgacaatgcatggatatatcgatatgatatatcatgcagctacaatcaattcctaaatatctgtcgaaagactagtgttaacaaccaaatatttcatga

SEQ ID NO: 49652 - DNA, 3640 bp, Oryza sativa
tccttcgtatcacacctgtaaacgctttatagataagtgtcaacctaactttataaatttgggggactaatacatcaggaattggtaaagaaaagacattctagtcttttaattttatattagtatgtgtatatactagtacaacaattaagttaactttacaagcgctctcaaggaactacaggaatgcttaaataaatgtattatggtatttgaattcgtctcgaataatacttaataaaattggcctaatattggatattagatttataaaaattgctaatcttgtgtgcttaagagaaactgcctagcttgtaacggacgaagtgacgatcgttgtaatcaatatgtcccttgcaacaacgtggggcctgtgtggtagggagagaagcgtatatatatatgcatatggtctggcagctaaggtagtaccgccgtcataaaatgctataacctaggacgagatttgaccgatctgaatagaactttgggtatgtttagttcatgctaaaattgaaagtttgattaaaattagaacaatgtgatggaaaagttagaagtttgtgtgtaggaaagttttgatgtgatggaaaagttaaaaatttgaagaaaaagttgggaactaaacaaagcctttgtccaatttcattgttttagaagggtcaaatctcattctaatcattctaggttgttatattttagaactggagaagcagctaattaagggtgtccccacacttttgcagtgtcaaagaccaaagcaaagtgaccaatcaaaacacactttataactacatgcctgatcgatgcataaatatatcagcagccatgtctcatatcttgcttaaggtatatgggtttcacctgcaacttcctgcaaaattccaaagaaaaaaataaagatgatttaatttatatataccaactaagggctatggtagtagcatcatgtgtataggaaaatataaagaaaatcaagtagctagtagtatacatagtactatttaggagccaaataagctgttcctaaaatttgaatttttaattttaattttggaattgattttgtgagatattatcatagtttatttttcagcattacatttaaaccgcgataacatagatataaaagttttagccgcagataattagtgttctgcttatatgccatttacggcttatcagcagtagcctgtagctaggccaaacaatcaacagaagaaacatgagaatatttagtgtgtataaaagctatttttatttgcttaatgaaatcttcattatctgaaaagaaaaaacagatatgccattcttggcgaatgtaagtgttgctttaatttggatttataaattttgatatgcatggctacttgtacctcgtctggattcgtcctagctatctagaaagctagttggtacggcttaattcagttgagcttgcttttacctttaatttgctagttatttatctaagaaaggatgtgagctttcatggaaggcctcacgtttgtctccatctttctgccaaactccaagctatacgtggaagaagagaagttaataaaggtggtggctcaaaaggagatttgcaaaaggatcacttgggatatggtattttacacaggacataaagtattatgtataagtgataatactttttttaatatatgacaccattgacattttatctatatttgacattcgttttattcaaattttttatgcaaataaaaattattcttaaaaaacatttgatgataaataaagtcattataattacatatttgtttataagacgaatggtcgtcagatgtatcttacaaaatcaacatcgctatacattaaaaaaacagagagagtaatatataaattaatagtcatacatagagggtcttgatcgtactccgtaggagataagcctcagatatccatgggtgctctacaactcaattgaaatcttgggatcagctttttctctgtgtcgatcggagcgcaaaatattaattgtaccgcgtgcatttttttcttagcaatgcaatagagatagcaaaacaatattctacaaaaataagtacatgttttggccctcttctcttgtctcagactggatttaaacttttaaatacgaaacattattcactttaacaaaccgtagacctaaatgatgtggttttgtcggagatggtgcagatatattgtagtgtgtttggctggaaaagagtatttattaattctctatttgctaataatgctttcgtggtgtagtaaagcaagtgctaaccaagtgcaacgtcatgggtaacaatttttttttccttggaaataatcaaataagatgttggatttctaataaggtgacgacaggctggattcaattccattaacgaaaaaatttggtgacgatcgacatgattaactttagcgcctataatacgacatttgcttgccaaattgcaatgtatgatggatacgattaatgtaagtaattaagcacttatatagagacaaattgctctttaatttctagcattcccaaatatataaatatccttatacacacttgggaagatgtacagggggacacaattccacaaagaattactagttacgcaatatatgtttcatggaaactaaaagggctaataattaataatgtcattgagatcagcattcccccgacaggcttacataagtattactgtttattattgttcagacaacttatagttgggttgttgagaattaagcactaattagtcttttgaatggtgaaaacttgccaaggttaaaaacaaatggttttagacttaatagtcccctaacctcatttgctagctaagccaaagcttgttgttcctcttggatgctagctaggttgtcaactggcagcaacactggaagttggaagatgacttcatgtactatgaaacatgaaaaaaaaattgacatctagctggctacctcatgatgacaagtgacaacaccttgttccaaggttatcacaagcaaataacctagctaatggcatatgcgccaattgagataaaatgctagattcagcgccaatttcacatggttttcggaggaatttttcagaaaagcaactcaatttctgcaggaagatgaaattttagtcaagatgtaataggtaaagttcctataccattcttgtgttttctttgttgttttgtccgagtgcactttgcacagaagctaaatgttttttatttacttaatgaaattaatgtccactatctacatgaggaagatgaaaattttcccgacagctcaactgtagccttcagaaaatgacccaactaaattcaagcacccagaggcaactgtgcacacaccatagacacatcatcagatatatggtattaattgttttgtttttgagatgcagaggcaagaagaaaagcatcagtgctgacagctggtacatgttgcccattgtatgattgtatcctgatcagtgtgatgacttttcaagttttgcccagttgagttttctaatccaaaggctgactcagatgcacttactgaatgtcatttttctcttaagaaaattattttcctgtcccctgctgatgtgcacgcagactgcaaatcaataggtttgctgattgggtatatataa

SEQ ID NO: 49653 - DNA, 721 bp, Oryza sativa
atagctagtacccatgcatggaaatacgtacggtatagtcgttgatttttacagattaaagtttaaccacaataatttcttataaactatattcttcattgctataaaatcaatattacttgaaaacactttaaaatagtatgaatctatcagtgtaaagtttataaatcaaatatacttgtaattttagtttggttagaaactaaggaaactaaggaaatacttccggatcaacaaataaatgacattttggaaatgtgtgatcaatgcgcttaaactttgacagtcaatttctctttaaatatttcaattcaccttttaaaagtggtatatggttaaatttgccttcaaaacatgttttaaaatattataattttgctatatttttatagggtttatactagtaaccaaaaacaagtggcttggtgaaccatcacttgttgaaccatgttgctttccaaaacgtcacttatttgtgctcataggaagtagtgataagaaaattttaatcaaaagagatgatatagtttctcaaatgcagtgctatatttttcaaagttattttaggaagaggtaaactaaagaacatacctagcgcatgtacacacacacacacaatatatatatatatatatatatatatatatatatatatatatatatatatatatatatatatatatatatatatacgcacacgtgaaaacaacgggctgcagga

SEQ ID NO: 49654 - DNA, 1201 bp, Oryza sativa
caaatagaaacaaaatgattcattcaaatattataaataaatcatagatccaaatccataaatttataaagctaaaaatacaaagctctaataaaccttaaatataaaactatcctaaacaccccctctaactactcacgagctgcttgtcggaatcttgaaaatccttgaaacaaaaaaaagccactcctccgtttcatattataagttgttgtaaactttttcataaccaaatttatggaaaaaaatagcaacatctttaacaccaaactagtttttattaaaactgaaatttaatatattttgacagtttatttgttttgtgttgaaatgttgctatattttctataaatttaatcaaacttgaagaagtttaactaaggaaaaaaatcaaaataaattataatataaaacagagggagtaacttataactatatatctagacatagactttgttcagataatagttactccctccgttttaaaatataagagattttgaagggatgtgacacatctagagctagaatatgtcacaaacctttaaaatttcttataggacggagggagttcgagttagcttaggtattgtttagttgggaaaaaaatttggggttggttgtcacatcagatatacggatacacatttgaagtaataaagtaataataaaacaaatttcactagaaaaccgcgaaatgaatttattaaacctaattaatcatcattagcaaatgtttactgtagcatcacattgtcaaatcatggtgcaattagtcttataagattcgtctcgcaatttatatgcaaactgtgtaattggtttttttatctatatttaatactttatatatgtgtgtaaacattcgatgtgatgagtgaaaaaaatttatttcgagaagtaaacagcccctttattttgagacggagcgaatagagcacaagtcctcgcggagggtagtagcggagttcaccgttacatcgtgccaagctgaccctgcgaccacaaaagcaggccaaaagcagtggactcgccaccccaccatcaccacccaacccaacccaacctcctctcctatcgtcatccgctcttcttcccctcttccccactcgcaccaaccccaacccccccaaccgccgccgccgccgccgacgacccaccggtcgccgcgtcgccggagtcgcgtactggagaggggggc

SEQ ID NO: 49655 - DNA, 15026 bp, Oryza sativa
cctgcaattcctctatgtacacttgctattctgtcagcaaagctgcactaatctggagagctcaatggactgatccatcagcagcgtcctgcacaggaatgttgagatctggaagagcgaagccgcctccgatggactgcgtggctgactgctgatcaatctgttgctttccttttagatcctctgtaatcatcggtttgttccgtgagctcgagatctgtaatcttatctgcaattccgaaaagaacttacattagatgtctatactgttcagattttgacaccaacttggttgtaagtacacaaggccacaagggtaatatcacaaagcatcttcacaagcaatggttgttgttggaaacaatagtagtaactcgtcagcaatgagagaacataagattcttcacccacatgggcaaaattgagaaaaagaatactccttcagtggacccccaaaatcagcattcgttgtgtagaaattattttgcatgaaataggtgtatcaaacaaaacatgtttgccattataatgggtggaaccatctcgatgcttatatctcatattctcattaataaatgagatccatcaaattgaaattacccggttggtgcaactacagttcaactgaatgagatgggattaggtgggcaggctattttaaatgtggtagacaaaatattgtttaccatttttggaagttgtggcttgttaagtgtaggatttattaattgggaatgtgtgtaggtcatcaggagctaaactagcgataaaattccacttcaaatatcggtaaaaccagttattatatttgccaaaactcaaacaagatcccttgaaaaaaaggattattcaagggtacacatcactaatatgtattttaaacattgtcatatgacacaatgcattgccaactgactatgcattcacctttcagacacaatgactttagggcgtgtttagttccacatcaaaattggaggtttgaagaaaaaacttggaagtttatgtatgtagaaaagttttgatgtgataagctatgcctaatgagagtttttaaatttggaagttggataagctaaactctcatttaggaaagttggaagtttgaagaaaaagttgggaactaaactcggccttaatatggctttcagtaaaggtagcaacaaatcgtggcacatgtcaacatcgttaccacctagtatcatttataagtgggcagtggcagctctctgtaccttcaagatctttactcattaattgggatacatgctgtcctgaatacagaacagggtagcatctccatgactgggaaatatggagtataaagcaaaaacaggcgagtagctttcaattcaatattggagaccatgtgtagctgcccaggccccagaagtcaatcaattcctttattggtcagatatatcagtcacaaccaccatactcaatagtagtaggctctatccaagaaagttgagttctgccagttctcagatgttggtgaaggtcgatttcatcccaacaagacaaatacttctaatcctcggctacagaggtacgtactcagatgttggtgaggttcaattccatccaacaagacaaatattaggttttctaaaggtgcagcttgcatcgtaaaagtttgcaacacaactgcgttcatatgtactactattgatggccaatgatatctatccagagcatactattagtgcggtagtgaacaaggaaattatagtgttatttgaatgaaaatttgcctctgggcttgctaagtatcttcgaacttatttctgaagacctagagtaaaggatctgaattcatctactgtttctcacgcaatgattttttttttcgttttgtaaatagtgcgtctaatcagttgttgttgctaagattatagtcaatcatacaccaaattaataactgacaagcccatttcccaacagagacctctgcagagactttgcaaaagactagaaaaatctacatccattattgtcaaaggcccatcagccttgataatgatatccatgtctattgcatagcttatcagagtgagatagcctcaagttaatttgcttaaaagatatgaactggatcatatggaccactacctttggaggtataaacccttagcaatttaaaaactctcattaggctttaagctaaaataagtgacacagcttttgtcattcaacccaaaacacaccattactggcccagatgccaaatttgggaagaactaaaagagaaacagattaaaattgttattacctcaagcttgtcgttttcttttgaaagcgcagcgcaagctctctgcaaagtacgcatctcctgctcacagcaaaaccaagtaccaaacggcagttagtgaatttgaagtagaatacataataaactgcacatagtaaagaatgtgagcatcacctcacggaggctgtcgttctccactgcaagagatcgcaccagctgctgtacgtccggtagcctctgcatatcaccaaaacaaccaagcattaagacgaattaagcaacaccagcaagagaacaggctttggccccccaacagttcacaagatttgatctttttgttggctagtacacctttgtggctttgccctaagattccactttttgttcaacctcccagcctttcaaagggcaggccgagatgtagcagcttctgctttatgctaaactagtacaaatatggctcaaccaccacaagaagaacaaccccgcccttttctcttgtgatgatagtggtttactcctccgaccgggtcaagactcaaagactcctcttttgccctagaactagtaaagcgcgtacacaaatcctaatacttttcccaacacgtgacacacacacatacattgctttgcaactgttttttgagtgccctgcgcgcgtacgcaccactcacgctggccgtagtactactattcaaacaaccaagaatgacctacagggttgcgaggacaaaggtgtggtggctcaccattttcttccgtggacgctgaccggccggccgtagaggcgacggcgctgagaatggcagttgttgctgccgacccatggcgctaacctacagggagacgaaccaaaccatctgtgagtcatttacacaaatccaaccaatcaatcattttccctgaaaatcatatacaacatccaagaaagccacactcgatggtggcaagaacaaaggaaggacaggacagacactggtaggtgggccccacccccaaccacagctgtcccaacgcatgatagtcacaggatcccacattattagtaaaaaaacaaaacatcagttataataagcacgctaataggaaaggaaccctcagctaaacctacacctaaaccataccctcctccatctctttaaaaagaaaaatcaaattctaattatgaacttgaacaaatctttaaattgatttatttcgagaactgcatacgaccatccatcccattcgccgcgcaaccgcatgacgaacgaagctcagccaaccgctacgaccactgactattacatgtgggcccggctcacctttcctcaaaggggaaaaaaaaggaaagataagaaaagaaaaaacccgacacaggtcatcgacaggtggggcccctctcgccggcgctcacgtcacccacgtcgaccaccgcctccgccgcgcgccgccgccgacacgcgcgcgggaggtgggcgcccacgtgtcgcgggcccacctagctttgactctgtccaaccgcgggggggagtgtggcccccaccaccaccaccacgctcccaccacacgagcaattgcaccggaggataaaaggagcacggaaattaccaccctacccccggaacaagcgtaagtgcgtaaccaatccccattggccatggtgaagagagcgaggggcagcatgggaaatccgcgtgcgccgcacacccacttcgccgagtccctgagtcaaccacaaactctactacttccagccatacaaccactggacgaaaacaatccgtgctcgatttcttcctgcggctgtttggtctcgtcgtctcgagcaattccaatgtggaatccagaatctcatttgttcgtggggaagcaatgcggatctgcgaggcggaaacggggatggatgggtgggttgcgtccgttgcaagcaaagaagggggaactgtattatggtagtggatggtgagatggagaattggcgaggaggaggaggagaagaaggaaggtggaaagggaagggaaagggaaaggcggtgtccaattcaccaagggaagggaagggattttcgccactagtaggggtaattccgtcacacggtacagaacagaagcggaaaagggcaaaaaaaaaaactcggaaagcaacatggggataggagagagagtagtggtggggggaggagaagaacccaatgcagcggcggcggcggcggcggaggcggcaagacggaggtggaaggagatgcgggtgcagtgtgaacgcactaaccttggtcgtcgccggcgcggggcggtgtccgggaggcgagcagaaggcgccgtcctcgccgccgctggtggacgcggccgacccggagccagagccagacccggagccggagccgccgctgtagtccagcggcgaggccgggctagcccgggcccacctccccttcttccccgccgccgccgccaccgccgacggagaccggcggcgcgaccgcttcccccgcgtcaccggcggccagatcagctcctcccgcgccgcccccttgctgctgctgctgcaccaccacggcggcgtccaccccgccaggtccgccccccgcagcgagcagatgatgcccgccgccaccgcgtcgtcgtcccccgcacaatccatcgcgcgctcgccgacgaatcccccgaccccggcgaccgtagaggaaggtggaggtggaggtgggtgggggagaagagaatggaatgggagaagaagaaaccaaagccgcggcgtggtgtggtgtctcgttccttttaaatggttgggggtggaagcggaataataaaaaaatagcccaatcccgcacccacacgacacacaccccgcacacctacgatagctaccctcccccactagcggggcccacctgagtcaccgcccactgacacccctagcccccacgtttccacaggccccacctcccagtggcaaagcggaagggaggtggggccgggttgtcagtgggtgcagggtaaagcggcgaggcgtacgccgcaaggtaaaggaggtgggaggagcggcgggtggagactggagggttgaactggaaggggagggagtactagagtagagtactggagtggggtggaggtggggcccacttgtcggtcactgggagagctgctactaacttaagcgggcgaatgcaacagtggtcgggattcgtggctcggcgcgggcaggaggaccgccgtttgtgttcgcccgtgtggggccctggtcccacctggcagtgacggtggacaggaggacctccaaagtctggggcttttaactatttgccacttttagatttggcaaataactatttgtcacccctatttcaatgacatatgtccacatgtgtctataacatgtgggtctagtgacaaaaggttaattgccacatttatatgtggcaaatggttaaatatctcccaaagtctggacgggcaagacggctgtgcagcggaatgtgtactgcttggaatactgtttagagcaaaggaaagtcattagaattttgctagtcctagtactgctgtaacaagtttgaaatgatcttgaactaaggccccgtttacttccccaattttttttttccaaaaacatcacattaaatctttggacgtatgcatgtagcattaaatatatattaaaagaaaaactaattacacagttaagggggaaatcaccagacgaatcttttgagcctaattagtccatgattagccataagtgctatagtaacctataagtgctaatgacgaattaattaagctcaaaagattcgtctcgcggtttctatgcgagttatgaaattagttttttcattcgtgtccgaaaaccccttccgacatctggtcaaacatccgatgtgacacccaaatattttcatttcgcgaactaaacagcccgtaacaatttcagctgaaacatgattttagagttgaaaaaatactaacttctttcaaaatctggtatctcaggctagctgtggacatttaggctgtgcatccacactttcccaactttactctcgcgattttctccctaactgtgtaattagttttttcatttatctacatctaatgcttcatgcatatatccaaagattcgatgtgatgtttttgggaaaaatttctggggaactaaatggggcgtaaacacaccctaaggtgtgaaaaagtttatataaaagggtaagatgattgattggtaaggtgattgttttaggattgtattttttttaaagaaaagaacggattataatctttatagggcatagaatgtactctctccgttttacgttataagacgttttaaatttagtcaaaatcaaactactatattactacttttttctatagagttagttaaacttagagtagtttgactttgatcaacgtcaaaacgtcttataacatgtaacatatgatttttttccccttaacgtgctcataggtcagcccaacatcggatttgtttgtcaattgtcataggtcagccttgttcataattgcttgttggcagattattggtccagattgtttactccactcttgtaaaaaaaagtttcttcgaacattattctgccgcatttagaccactctgttcctagttgctactcctactgtttatatttttaaagtttgttttcaaaatattaatttaccgtgttaattaatcgagtgaatcatccatttcatttctccctaacccatgctgctagaattgaatagatatatataccgggtcaaacagcgccgatgcatgcagatatctcgaggaaagttgaaaactccatgtgggtcgcttggtcaaacaaagtccaggcacacgcgtatctcttctttctcattttgagcccagattgctactagaagatcagaagggggtggcaatagccaattcgtcctagagttgaacttgtcatggtaaactggtaatggccaaagtttagttccaaagtttttctttaaactttaaactttttcatcacatcaaaacttctctacacacataaacttctaacttttctaccatatcgtttcaatttcaatcaaactttcaattttagcgtgaactaaacacacacaatgtcaagcgctagctggcgtctggagaatgtgtagtactgtagtggtctcgccgggggttgactgctgatcagatcatttgagcttttaggctctgtgtttcccattggctgtagctatttttttttagaatcttcgtattactaccttcgtcccaagacgttacaactgaataactgattacacatccttttttaaattgtaatattttgagatggatgaatatatgtccttacctatttcttaaagaaattataatattaaagatgaacctggatcaaattcatccataggatttaatttatttatagagtgagtagactctaagaatcttctcagaagctacatagtacaaacaagctgttttgcaaaaatttaagtccccaaacaaggtattaggttgagttctaaacattttgggggtgtttagatccaggggtataaagttttaacgtgtcacatcgagtattatataggatgttcgggcactaataaaaaaactaattacataatctatcagtaaacggcgagacgaatttattaagcctaattaatccatcattagtaaatatttactgtagcaccacattgtcaaatcatggagcaattagtcttaaaagattcgtctcgtaaattagtcgcaatctgtacaattaattattatttagcctatatttaataatttatataagtgttcaaatgttcgatgtgacatggtgtaaaattttttgtgtggtaacttaccctataccagtacaaccgtataatgcagagcggctttcacatgcacataggagtagcggcagtaggtgttctgaaccaaaatcgcagaagtatgcgactgacaaaagatcaggctgacacacatgaatattactacctccgtcccaaaatagtttccgtgctcaactttgatcgtccgttttatttgaaatttttttataattagcatttttgttgttatgagatgataaaatatgaatagtactttactcgtgacttatgtttttattttttttcaaaaaaatttcaaataagacgaatggtcaaagttgggcgcggaaaaccatagctgcacttattttgggacggagggttcctgtgatacattataaagtgtctagattcattgtattaggatagggttggttaattttgagacacaataagtagtgtagtaagtgtactcgtgtccagatttactgtattagaatggggttagttaactttgagacaaataataagtactgtaataagtgtactcgtagctgcgtaggcgtagaccgtgtcgagccctcactcatccggcccctgaccacgattagaccgctgagcggctcaccgtaccgtaccatttctcgcgagacccccgtacgtgtaccggtctgtactaagtacactgtacactgtttgctgctacagcgtctcctaaccgcatcattaagccattcccctttcttcaaacacgtcattaagggaggcattaaccaactgcttccattccattccatgcaatgcaaccagtacaagtttacaactacttttcggttcattgaaattaatcaaaaaatcatatgaaataattcgtactggtgcgttttgaagctgtatccatacataatttcatcgtaagggtcttggtaggattttgcatacgaatttgtggtgctattgaagtttgtgattttgtggccatgcatggatcgttcgcgtgcagaggagatcagagagtctctgtaacctgtgatctcaagttttaagacgagatcgactgagaccaagcaaatgttgcaccaagctgaggccgtgtttagttttccccatattcccaactttccattatatcatatcacatcaaaaacttttttacacacataaacttctagttttttttctaaactctcaactttcttcaaacatctaatttttttcaggatctaaacacaccctgagtcgacgagcagcgcgaattgaaaccgcggttgttatcgccgccagccacacgtacacagccagtgaccctatcaattcttttaaaaaagattaaagttgtgataagttttgttcgatttttttcagtgtttatcatggtttttatgcggttatcgtgattaccaagcttcctaccaagatacgataccgatacgatacctctactcggacctatacgatacctctactcggacctcggggatgaagccaggtcagtgtggggcagctttggctcgagctttacacctggtagaaaaatttgcgttagcatatattattaattgtaagttaaattttaaatacaaaatttatgcttcatagttaagctctatgcttaagataccccctataaaccctggagaaatatgtacgtgccctggtggtgatgggctgtccagcccatgggccggagccggacaaagatttcggtccggcccagtacaccggccttgcagatccgtaattcggtccagtaccggtatcgcgacgaaaacgatcgttattgctcaaattgttgtgaccattagttaagtacaactaatccagctgttaataagcatggcatcatttgctagtactgtgtaaacaatcaaggaaaacacaaagatgaatggtccaagttcaaaaatgaatagtgcttattgtcaattactccctctgttcagattcgttgtatgtcccatcgaagtactagattaagtctttttgggacggagggagtatttataaacagagagtattttcttccacgctaatttaagaataaaacatttatattttgttttattagcggtttaaaactcttgactagaaaacagaccacgacaaagaaaaccctccaaaattaactttaaaagttccaaattctaaaatttagctgcagctaataaactagtaataaacatacctcgaaaacattctgtaacgtacgtaccagtactacgtaagagtacacatgggtgactaatcacccgatttgacgcagtaattacacggtgacacaatctgtaatgtactttctttgtagaaacacagtacagacacggtaatctataatgtactactgctgcgtgactgcaacatcatttggtagtgacctgacaagataaagtcatcaccgagataatgtagtttcaaagcttgtactggtacccgtgattcttgatcaatgactgatagtatctcctccgtttcataaatgtaagtcattatatcattttctatatacatattgatgttaatgaatctagatagatatatatgtttagatttattaccattaatgaaatgctagaatgacttactccctccgtttcacaatgtaagtcattctagcatttcccacattcatattaatattaatgataatgaatctagacatatctatctatctagatttattaacaataatatatatatataaatgatagaatgacttatattatgaaacggagtaagttctacaatacactgcgtgtaagcatttgcaacaatcacccgtgccggccggtctgcttaagccactgcaattaatcccagcaagcaacagcctaactaataacgtgacgcttcactcgcgtcatccacaacgtaattagtagtacatatatatccaccattttgttgagtgtcagacttgttcatgtttatgtaaatttataggaaaaagaaatgtattccctcggtttcagtttgttagttgttctggcaaatctcatagtactaaattaaaaggtgtgacctattatattgctaccctcagcatctctaattatcttcccagaggtagcaattcatttttttttctgttagtactactactactgctatattagtgaagggtatgaaaggaaatacatatctaaaaagatatggaatatcagaacggcaagtattttaacaaaaaaaaaactaaatgttactccctccgttccaaaatataagcatttttttaacatagtattcgagatattactttgatcaacactatctataaaaatagaatgttttaaataaaaagagtttgtttaatgataaatatagtaaaatcaattttacataattgatatttttaattttttttatattaatagtcaaagtaaaaaatatttgacgtgacactatgtttaaaatgcttatattttaggacgaagagggtatggtaaactagaacaacatctctaaaagttttgaacgacaaataaattagaacgaagggaccttcaatattttcaacataaaagcaaatattggatttaatagaattaatttgatgttgcacgtattgttagtattatgtaccaacactaatatagtacttgactagagtagctatccacagtagtaggtcgttcaattaaatcaacaactaggcccttcattaactaattggaccatatacttatcctcccaaccgtcagacggttggagcgtatggatcaacggctcagatcgatcagcagcttagccactagcttagccagttgccgtgtgactgcttctgacagatcacaaatgcaacaaaattgcctggtcccctgtacatatgcattccattctggctttgcaatgttttgacattgctgattgtcactgccagaagacctggcaatcactcactagagtctggagaccatctgcagatgcatatgcatgatctggcctacacaaagatcacaacatcatctcaacatgttcttgttttatagtaccaaaaggtgtcacctaatcattcaggtagtattatttttactgtgctaatcacctggattgttatctcaatctagatggattggtcgaggaagcatcatagtacatgtatatataaaaattactatcaaggtgtacttcatgtgtactctgctgttgattatgattataggcgtttgagatgaaaagttgcatgtttttttctgcagtttgaagcgaaaacttgtccgaatacggcagtgttcagcgtgtacgtgtgggtcatacacccttacgaccatctgataatccaatttacaaatcgtataggagtatgtttcatattgccaatttaaattttagtctgattttacagaagaaaaaaaaacccagctacacttcccattgcacaagccacaactagagttttctgaacattttaattaacagaattgctttgttctgcatccatctgaaagaaataaaaataaaataaaatgctgattaaaccctgacactgtaaaatctaaacatgattagcgaaagagaaacaccgacagagagttgtactagtagtactacctgtggagtctcatcctcttaacaaagcctgtccgtgcgttcgaaatcgaaatgaatcgctgccgaatttaatttgggcgatcattcactaggtgacagtggagatagatggaacatttctttcatgggtgagatcgattcaatgctcagttgatgatgatacttaagctcggttttaaactccatcgagaggaacaatctcaactgccgtttgctctcccgttgaaacgccgcggtttttgtgtcgtcaggagttggtagcagctgcaaaaaagtcttaactactctagttaattactccacttatttatatgttcaaccgttatttcaaaacagcatctataacgtttaggctgtgttattcccccttcttttccgactcaccttattttctttaccgcgtgcacgtttcttaaaatattaaatattacgtttttttaaaaaaaattctacaggaatttttttttaaaaaaattatattaatatatttttttaaaaaaatatcaatacttaattaattatacgctaataagtagtaccggagggattagttcccaactcactccaacgaacttagccttagtatatcaaactagtgttcaaatccatatgagtcttacagaacctaaactaacagctcctccatcatttactcttcagcttatcaaccgtaattatcaaaatttaaatttgaaaacttaattttataggagtagttgaatttgatttttttcatcgtcatttattttctagcattgggttatataaaagtttacccacaaattgtttaagagttttagcttatgatcagacctgataagatatcgtctacattttaaggaagaccttacaacaaagtcgcgcggaacaattctaaatcgaactaaatactgtgaaaatcatgcgaatttaatggaggcttgaactcaaaatacacacgaccaaaatatgtcaaaaaatttaaactttgtacgcatgaaattcgccagttggccagagagcattgtgcactgaagatgaggaggtgggccggaatggaaggagggaatcacggagagggcacgaaaactgaagttggtgtggctctgccctgccctgcactgcacatgtactatcacccccattcaacaccaactctctctctctctctctctctctctcaatctctctcaaatgagctgatttcagtgctcaccatcccaacaagaaacaatgcactgccttttggcaactgccacatgactgtttttctcccttttttttcttcttattttcttcagagatcaaccctggtagtactagcagtagtaggagtagtagtacaaaaactacaccaatccatacagtccgtgcaccaaaagccttttgcctttttcttcctccctctcctcctcctccatttcccaagatcaagaaagaaacaggctgcttgtgcagacaaatcgttggtttgggttgagtgcacacgaggatcaagaggggaggagaggaagaggacaacctgctggtcacaatatctgcattagtttttttatctttggattccctgggttttcatggtatcttgtcagagaggcacagaggcctttgtgttcttgctgttccctttgtcttctccacttctcctcctcttcagccagcgaggtgagtgagtgagagagagggtcaatgcgatgccaccgccgccattgacgcctctctcctcctcctcctcccgcttcttcttcttgctggtgctggtgctggtgctgagctgctcgttttcggccaatgggaggactcaccggtcgccggcggcggcggcctcgccttctcctggaccggggccttcaccggcgccggcgacaccgcgggttgttccccctgctccggctccggctaccggaggtggaggtggaggtggaggcatcttctcctcgaatggcagcctcgccgtgactcccgccgccgccgccgccgcggtggcgccttctcctcccttgggtaggttggcggctgttacagttggatcaaagattgcgttttcttttttcttttttgtctatgtgttttggtgtcctgtcgcattgctgaattttgtgttctctggctaatttttttaaaaaaatttagggagaaattttatcgatgtttccttcacccatttctgagaaattcccgtgctgatttggtgggaaacccgtgttgtttcttttggagatatggggtaaaaagtgcgcccttgggatcctttggtttcttccaagtttgaacaaagcgcataactttaagtgccgtctcgtgaacttgggtacgaattggaattgaatatatgtgctcgttctttttagtatggtgaactttgcccaatcttgggaaagaaacaaaaaagtgcattctttccaaaggaaaaaagagaaacaaaagatgctccaatatatttgcctca

SEQ ID NO: 49656 - DNA, 1870 bp, Oryza sativa
tatccttgttggcttgtcttgtttgtccatgaaaatctcatagctactgaacttactactttgcattgttcagataccgcaagggttgcgttggtgccgatgctgaacaagttcaactcaatgaagactaacaagaaaggacttgtcgcgatgatggagtataatacacttgagacggcgaccgggaagttcagtgagagcaatttgcttggagctggtgggtttgggtgtgtgtacaaggccaattttgaaggaggacttgttgctgccgtcaagagatttggccacaggggacaggactgtgagaaggaatttgaggttggtgattgtttatgtccatggcctgaaatttgttcttgatgagacttgtcttgttgctaagattgtttttggttacctctgaattggcagaatgagctagatttacttggcagtattcggcatctgaatatagtgtcccttttgggcttctgtattcatgaagagaaccgtttcattgtttatgagctgatggagaatggatcactggaagcacaacttcatggtaccttctaatttgctttgttcttcatttgtttcctcagaattgtgagtatgatcaaggagaagtatccatttttaatctatttgtttgtttctaggaccatcacatgggtcggctctaagctggcacattcggatgaagattgctcttgacacagcaaggttaccatccatttttattcactttgcatgattaaatatatttttataccgttatcattgattcctatcatatgcgtctgtcaactaaattaaccaggggattagaatatcttcatgaacactgcaatccaccagttatccatagggatctgaagtcatctaacatacttttagattcagatttcaatgctaaggtatgcctgcttatcttagttcttgtcaattagaatattactgtcaatcgtaacacatatcactgatcatctttggtttgcagatttcagatttcggccttgcagtgaccagtgggaatcacagcaaaggaagtttgaagctttctgggacattgggctatgtagtcccgagtacttgttagatggtatgccctctcttttctcatgtcccacctgtaatcgtctatgtagactaactctcatgtcccacctgtaatcgtctatgtagactaacttttttctcacattaacatctaatttaattatctgcaaccgcatgaaattcagggaagttgactgagaagagtgatgtatatgcgtttggagtagtacttcttgaacttctgttgggaaggcggcctgttgagaagacagcacaatctcagtgccagtcaattgttacatgggtacccaacattctgatacttgacatgttgaatttagttcaattaaaaaacagtcattctctcgatatgcatagaatatttttaagcttcatctcctgaatccaggtggttaagttaaattttcctaatccattggcatctgacatatggaaatcaaatgcaggccatgcctcagctaactgaccgatcaaagctccctaacataattgaccccatgatcaagaacacaatggatctgaagcacttgtaccaagtaaactccctcttaatttctatctttatcctcacaaatcttttcaactaattcaatttgtgtgattcgctacttcgcaggttgctgcggtggctgtgctctgtgtgcagccagaaccaagttacaggccactaatcacagatgtactccactctctgattcccctagtccccatggagcttggagggacactgaggatttccccggaatcaccttgcgcaactcgaaagcagtctccctgttgagaaagaaaaggaatgcgtgatcggaat

SEQ ID NO: 49657 - DNA, 3686 bp, Oryza sativa
atgagtaataatatgaaacggagagaatatcgtatatttcgagacgaagagaatatatttttattttgaggaggggaaaatctgatgccaggccggcccaacagaggagaggttctgcttctccctttacttgatgccttgattcctccctttcttttcatcttctcctcctcctcctcttggctttcctttcttccgatccaagctactctctctctcctctcctcccctcccctcaccaagcgagccttctagagagagagagcttcccccggggggatcgagctcgccggaggactccacccgccgcgcctcggctgccgggagatccccccgcccgcccgccggtccgtccaacggtaagtctcgccttcttcgctcctccctgatttctcaccggcgatcgatcgatcgatcgatcccccgcgcgcgctcgagccgtcgccggagcctgggtgggtcgggaatcgcggcggcgtacggagtgagagatggtgtggtgtggtagggtagggtggatggagcacggctcgtcgttgaattaggggggaggagaaaaaaagggagggatttttatgcgtttttttggtgagggggaaatcggctgctgtctcgtgcgagatgtgctgctataagtggcaaatgtcaagtgccggattttcgttttgcgttttgccctggttggggttgggttactcatccctctactgaattggcatgtactactatttcaagctaatttgcttgttagaactatatatgttcagataccttttttgtggctgcacagtgtgtgtgagttttttttatcttaaaaactgtcattagaaggcatcatggcacaacagataagagaagtgcattgccaatgctgcaaacgggattgcggcaacgcaagcttgcagtgttgcctgtggctaatcttgatgatgctgatgatggtgatagtgtctaacataagttctgaacttttcttgtgtattgacaaaaccatcaccagcttgcatgtaattcatcttccatctgtgatagttttgtactccctagttttcttcaccatgctaatttcaatattcttgtttctgctatgctaggaattgaaaggaggtagccttcttgtcagctagtatggtaagttctctagcagaaaattgattttactacagcttcccagtttatctgccgcaccaagttaacttgtggattcggaggatctctttcttgcaatcctttgtttctacccaaagtttgatgttctaatatatctgtaataaatagtatttcgaaggctatggctaccgtggaagtaccttcgagcagacatatcgctgctaccctgcgtctttcattgacaaggtttgtctactgtcttcagataggctccatttactcatgccactggtataatgttagggtggtaaatcaggttgtttctagctttctttttctaatctaaagtatcaacataacatactgatgctatattgatatgtaaacatttcctcttttcctgtccttattgctttgtggcgttgtttttgcctctagcataatatgttgacatcctttgaactgcttaagtagaatctacttcctccgattcatattataagactttctagcattgcccatattcatatatatgttaatgaatctagacatatatgtgtgcctagattcattaacatctatatgaatgtgggtaatgctagaaagtcttataacctcaaacggagggagtagcagttaatacttctaggaaatttcttctaaaaaaagttagaggaaacaatcacatttcaagataaagcatctagtttttcattcctggatatttcttctaaaatatcttcttttttttttttaccctttgcagcctcagcttgaaactggtgacaaaagtatgctctctgttcattgattcatcatctgttaagttgattttggaaattgaactaagtattactttattttcttttcagttattatgccaccttctgctctggatcgtctaggtaagtttagttgtgttagataatctctttcttcttggaaacgcatgatgatgattcatctcgtctgctctcacaagctttccatgctctattttctggtaacttctctaatctattctatcactatgcagcatctctgcatattgaatatcctatgctatttgaagtccacaacgcggcagcagaacggacttcacactgtggtgtcctggagttcattgcagaagaaggcatgatctacatgccatattgggtatggacatgtttagaataacgttgcaattacttttatgcgattccaccaaagctaactctattactcatcagatgatgcaaaatcttcttctaacagagggggatatggtgttcataaaaaatgccaatctccctaaaggaacatatgtgaagctgcagcctcacacaacagacttcttagacatttcaaacccaaaagcaatgttagtattgcttggtaaattattttctgttcttttcttttgctatcacttcatgtcttcatatactattgtgttgtgattggatcttatggtttgactaatgagatccctgaagaacagtaacaagccatttatgccattcttgcagcttggagaaacattgcggaattactcttgtctaaccactggtgacagcattatggtagcatataataacaagaaatactacattgatatagtggaaacaaagccttccaatgctatcagtattattgagaccgactgtgaagtcgactttgctccaccacttgactataaagaacctgagcgacaaaaagctgctgttcctccaagtacagcgcctactgctggtagatttctctttatgccccgttattgatcttgatctcttccctcaaattctcttgctgttcattactttaagatttattcgttttgcacaagaggcaactgaaaaagaaccatagttcatcccctttactggacctgggaggcgtctggatgggaaggctcctaaagataaggatgtatcagcttcatcccctgcaaaacggcaagctaatgcaacaaacagcgtgcagccctcaacagcgtccacatcacagagcagttcatctcgtaaaaccacggaaaagcttgtttttggccctggtgggaaccgcacatctaaggaaacagaaaaggttggtatttttgcaatttatgcacctattggcagctgtctggaaaacgagtgctagttttggagctacttgagatgcaagaacctctagtgaccaatgttatctaaaacagctctgtcgattagagaaggcataataagttattgcttcgatgtgtttgacacacttttttttaccataatttgttttattttcaatgtaggtgcctgaaaaggaaccgaaggaggatcccaagaaagatgaaccgaaattctcagcttttacaggaaggaaatactcattgaagggctgatagccagatagtgtattatcacttatcagtatttccagagacagacatgattatggagaaggagtttgattgtttagttacctccttgaagcctcttttggttggaccagtggcatctttgaatgtttaatttctgtcttaactatgaatcatcctcgtgccagcaacggagaggcaactgatgtataaaaaaaatctattcatgcctgtttatgga

SEQ ID NO: 49658 - DNA, 1786 bp, Oryza sativa
cctgcaccccagcaaatgctccagataatttagtgattcataatctcatccagatctccacagattctgttggtttcggtgttaccctcatgagcaaaactcggtttcgtagcctgaattgcgggttttcccagcggcttctgtggatctgtcacatggaaatggaagagggctgaattgtgaacgatctgcatggcaactttgaggaaaacttcgaggaagggaaaacaccttgtttgcgtacgtttcccaaactactagacgatgtctttttttaataaaattttctataaaaaagttgctttaaaaaaatcatattaatccatttttaaaaattaaaattaatcatacgataatgacttacctcgttttacatatcttctcaatcttctcttctcctctcaatccctcccctaaaaagagcttagaagagagagttgatggcaagattcgttatgagagtttatctttagtccactgtattgtttctaatacctctctaaaatctcttattttagaatggaagcagtagtatttaagaggcgttttggtattttaaacacttacaattctaccctattaaaatattggtagtgccaaaacttatctagagtttaacactaccaacattttgatggtagggtactaaatcaaacaagccttaagttcacgacggacaaccaaatttagcttgctatgctatacttagtgaaaacagaaaaaaaaaagaaaaaagaacatcgagacatactagttaccttatgtgccgaaaggccagaagaggcggtgtgcttcaaaggatagcaaagcctctcactctactagataagatagcaaagggagaattggatgccaagagaaactaatatttacagaacagtttaactaacatcctttgcaagttacattcttttcaactggacagactttctatagaaagccatatgaaagctcagaagtgggaacatgccgaactagcagctcctgcagctgctgaaaacatctactacgagggggaacctcaaacctggtacaggatttggcgatgccatcgtgtaactaactagtcattggcgactaactctaagtttgcattctctaacctctggaggacaagcttcttctgtggagcaaggcctttcgcgatcgccacggagctcacgtcgacgaggacggtgtcgtcttctttgaagtcgcccttcaggacactgagggcgatctcgttctctaccatctgctggatcaccctcttcacaggcctagcaccgtagttagggtcaaagccgagagagccaagatgctccacagcttctggtgtgtactgcagatgaatcttctgttgcctcagccggttcttgactcggttcagctgcaagtggaatattttacaatttttttgttagatcaactgtgagaaaacctctaaagcacaattaatatttgatgctatggcacaggtgggtctattagagtagtcatgtaagaataactataagaggtttacctggatctccacgatgcgatttatctctgtggtgtccagcggctggaatacaatgtactcatctatcctattcaaaaactctggccggaatgactgccgagccatgtcaatcacttgcttcttcattatttcataaactgcctccttgctgtctgatgtgtttctaagcgtatcaagaatcaatggcgacccaatgtttgaagtcatgatgataacacagttagtaaagctgactgttctgccctgagagtcggttattcttccatcatccaaaagttgcaa

SEQ ID NO: 49659 - DNA, 6078 bp, Oryza sativa
atctgcccattcgaggcagtgatctccttcagaacagccttaagtctctcttcaaattgaccttggaatttagccccagcaagtaatgctcccatgtccaatgaaataagctgtaattttttgcatatgcatgtaacaaaataagaatggatagcacaataaattactatctatttcttcttcctttattttctcattgcattaacgaactgagaatgcattgtcctattggccagaagtattcctcttaatggatccacctgacgagaggtagatgaattgccactactcatggaaagatctcatggtatatctatcctcagctcatctggttgattgaatctgagtatgaaataaaagcaaggctactatcctagaaaatgttatgataaggacaagcaaaaaaggctaagaaattacctttctattctgtaaaggttcaggaacatctccccgcacaatacgctgtgccaatctgcacgaaataaatgcagacgaattgctcagcacatccttaaaatgacaaatgctgtaagctgtaaaaagtaacttgtattgagagagagagagagagagatagagatagagatagattttacccttcagcgatagcagttttgccgactcctggctcaccaataattacaggattattcttagttctcctgcaaaggatctgaatgcatcgtcgcacttcatcatcacggccaataacaggatccagttttccacgtcgagctaattctgtcatgtcaataccatacttctctagagcctggtacttcccctccggatctggaagcagcaccataaaaagagttatgattcctaaggttatcaaacagtcacactgggtacattttaatgctaacatgaaaaaccatctggctgaaacaaaaccattgccattggcagagtctcccctcaagttgtgaatagagagctgaacaaagagatacctctgtagaaaaacaactgcacaaaagaaagtaacaataaaggatgaagttacatagacatactctgatctgtgacccgctgactgccacgtacagcggagatagcttccttcaactcattctccccaattttgagatctctgaacagctgttgtccaaacctcttatcttctgtgaatgctcgcaatatgtgctcaacagatacaaactcatcagcatattctttcttatgcttccttgcattatccaaaattgatacaaagcttgacccaatgatcggtccacttgtatcgccaacaacctacaaatgcagcagactcattgttaacattgatgcatatatctcttaacgaattaactactacggccaatcagcactacctttggctgtctcgagatgaactcatcagtagcttgcaggacagatgtgttatctattccagctttcgaaaatattctgcgcgctaaaccatccttctgctccagaagagctttcatcaggtgctctgcttccactacttgttgcttcgacattctagctgcatcaaccgcgccgacaaccccctcccaggccatctcagtaaattctcctggagttatctgtttggtcgccgaaaaaaattacccatctattagtcagctgttgttggcaagagggaactttcccatattgtctatatatgactatatatccacaaactgcaaaccatatgttctcagttttcatagtaatcaccaagttttatcaaatctgatacatagctgttctcagttttcaccaaacctatagaatgatcagcaactgctttccttcaaggttttctaggcatgaaattgttaaacactgacacattgcacatcctaaattgcctgaaactaaacacttttgcatatgcactgcaacatgatcactgagcatagcagaacattacacatgtaaaccgtagtatccaattaatgcagtagattatcaaacatgtatcgcaaattcgcaactaaactaacagtttcattcacaatagcctcattgccgacacatgtacagcatccgcgagattgaattcaccaccactatagcaaccaactgacaagagaaaaataattgcacgggcgtagagaagcgaacccagacctgagacgacgacgaggtgctgtacctcgccgcctgcgtggggtggaacagcctccgctgcggcggcggcggcggaaccagcagcccgcctccaccgagccggcccatgggcggcgcgaaccacgcgggcctcctcgccccaccaccagcggaagcggaagcgtctccagcgagcgacgcgagggcgcggagcgggtcccggccgccagcgtggtggcgccgcgccgccgccgcggcgcgggcggcgcgcgcgagcctggacacggcggtggcgcgtgacatcgtggcgagcgggtgggggggtcaggggttcaatggcgcctcggactctcagggtcgccgggtgggagaagcgcgcgcgctctcgcggcgattttagggcggcggcggcgaagggtggcgatgcttggagaaggggcaagaagaagaagaagaaggtggagaagagaatcgaaggttggagaagcttctgcaatctgcaagttgcggattgttttgtttttgtttttgtttttttcttttttttatttaatttaactttgatcgtgttcggcagccaaaatcatcttatccggcccgtttatttccgaatcgacggtctgaaatttgggcccatatgagcagggtttccaacttgggttcgaaatttcctccctccgtttcatatctactttgaccaaatttgaaaaaagatttagtaatatttatgacaccgaattagtttcaataaatataatattgaatatattttgagagtgttagaaatattgctatatttttctataagtttgattaaacttaaaaagttcgattaaaaaaatcaaaacgatctatgatatgaaactgaggtagtacactgtacggagctatttcgtccaaaatttgcaagatttattcaaattcggtcgaaattcctccaaaatttatgtttcttcgtcccgaaatatggagaatttggttcagtaatcagttcaggctgtagttcaaaagcttctcttcagaaatctgcaatttcaatatacgcagctcaggtcttaaccggacacatgaatttttcccatcttcacaaaactgcaaaactaaaacaactacctttccaaacagcaacattctgctgaaatctcataagatgctggcattgcaactttgcaagcttgataaacaccgtcacgaaaaagattaaagagccaagagaatttcgatgattaacgagaattttaccaagcatactatattatcaggataaccggttatacctgaactaacatagttattatagtataagtcatgataaaaacacaccacatagccgtttctccacataaatttcacagactgactggccaactaataatcactaagctgaaaaaagaagccaaatgtgaaatgcacttgtgatgaaggctagccactatgaacaccactttgtgctgacaagtgagcatggaccaatcagcagccgacaccgcgaatgcagaaaaacctcgtacgcggactaatgattgaaatggaggctggctagaccagctcccagtccccatcgatgtaaggaacgccgtcgtcttcgcggtcctgcatcgatgaaagatggcgttgtcagatacatagtatactcattgtttgtacttcccagcatggcagttaacatattgattaagaaatatgtggtactgaaactaaacttagaaatctcttcagaacgaatatgaaatatttcaatacatatgttgctgtttcatactataataatatagtgcagactgcaaaggattaaaggtggtactatgcagcagaaaatatcttgaaggaatcaaacatgaacatgcttgtggactacatatgaatagagatgagtaacgcacatccatagaaaagtgagtgtttgatagactactactgtgtccagaaattttcataggtcactaaagactgatctgcttgaacaacacaaagcaatagaattctgaaacagaataccaatatagaatactcttctaaaaaataaatacaagaaagaatcataccggcctaaacatgtcaacaacaatgtcatctagaccaccactgagacccctttgcagcccagttgtccgcataagatcgtcattatagtttagctgattgctaacagcttggtgatgaatccttccatcttgcatgggagaaacaatgcccgtattcccacgatccagtgtctgccttggtacagccggattgtctaagctaaggttgggcaacgatgtgttgatgctggagttactaaatacatggctgttatttagcatgtctcttgagtttgtgctgcttccatagttgaatggtgatgtgtcctgattgaatgctattggaacattgctagctagtgatgctacttggccctgcatctcatttcccagcagcggaatctgattggatgatgtgaagcttgagacaggttcaattttggggccattcatatgcagggtggcttgcgacatgttatcattgtgaccacgatcctgaatgttggatggaaccgcagtttgccaagtattggtggttcttccaagatcaggaaactggggagactcaccaacaagtgtgctaaatggatctgcagaagatgaatgcacccgactaaggtgttgctgattgctcgactcaagaggttgcagtgatctgtttgcagttgccagcggtgcaccattcgatatgtttggaaaggagttaccagaaggaccagttagaattgttgacatctgtgcacctctgatcatgttaccattattaagccctcctaaatcattcagtgaagtgctcagattattttgggcatgtcctaactgaattggctgtgaatgcagcaaaccatgaacaccaacgcagaaggggagttcatcctagtaagaatgttgtttgcctgggtatggccagcagttgggactgtacggtatctaccatatgcgttgtagtttccaaatgaattcatgtttatgtaagcagggttccttcctccaaatgcagctgcaaggttagcctgcctgcttgcatcagtgctcaaccgtttaaggtacagccgatacttctgaaatgacaagcagagaagaaacatcagtgaagtatacttgtaggtgcaaacaagaggaaaaaaaatagctaagaaatgaataggttagcaaaactctgaatttaacactggtgaattagtacttacgattgcacaatcaatatactaggaaaatggtatgagaacataaatgttatattttgcttctcgtacaaatactgaaaaagaactcaacaaaatacagaacatgcaacaatatgaattaggaatattttagggctgtattatcatatattaaaaaaaatcctctttcagatatctgggacaataataacaataatttggtgcagtgataaaccatagtaaacaacatgatgaaatgaacggtcaaagataaggaaagaaattcgacctgcaaatgactagcaacattctccctggtgatgttctctacattcatgagatccaatattttctttggaacagcctctgaaaaaacaagcatacaaatattaacacatatgacattgaactaagaaaaatagccagccaatattctcagtagctaggttgtgagaaattatcttactctcgatgccaagctggttaacagcagccacaaactttcggtgcagctcaacagaccacacgacccttggcttcttctgtgttgatgagtctccattctcattactgttctcatcagaatcatcaccatcatctccattctcatctctacttttccgtgactgcctcttgttgcggttagcaccaatactctcaccttcattgttcattccctgtgccttctgaccagcgtcatcatcgttaccacggttcttagcatcacaattcttacgcctaatcacatgttgccatatcgtccttagctgctcaagacgcactggcttcagaagatagtcacatgcaccatgggttat

SEQ ID NO: 49660 - DNA, 26553 bp, Oryza sativa
tggttacaagaatgacacatcagatcaagcaaagcatgacttactaatgactgggaggtccatctcgaggccgacaagctcaaggagtttgaagccatccatgtccggcatgtggacgtcgctgatcaccaggtcaaactggtccttgttctccctgagcagcttcagggccgtggccgcctgaccagttgttgtcactgcaaatcacaccacatcaaatccaatcaggccagattcaacaacacaatacataggcaagtcaaaattatcaaaagaattagtactactactattttgctgcaacaaggaaaaaaggtcagcagaagataatccttacacaaccaccatgtgtgcaacccaaagaacagtagaaaggattggagattcagacagaagggttgaaattatatcgaagaaaagagaggggaaaaaaactttttttaagaggaaaggggcaaaacccgttcttgagttgacattacatggccgaagaaatagaccaccaagaacaacagaaacatctacgagtgaaactgtgaaagccaagcaaagaagaactagcgcatcaccaaaaaaaacaaaaattaaatccaagagagagagagaaaaaaaacaactatagaacagtactaaaccaaaacgaaaaaaaaattgatcgatacagcacaagctcaatccacaaccatggagagaactcgctcgctcgctcgctcgagctcgagagagagagagatggcagattagcagcatgccgagatactggcatcgaagcaggaggttctcgaggatcttgaggcaggtggggtcgtcgtcgacggcgagcacccgcatgccgaccgggaactggtctctcccgccgccgccgccgctcacaccatggcctcccaccctcccctgcctctcctccaccgtcatcttcctccaatcaatcaaccaatcaatcaaacacaaacaatctcccaaactcctccacctccaagcaacccaagaaacagcactttcttggatccttaaaaataaaaatccaaaggtcaaagcagggtgagcgagagcgagcaccaccaccaaagagagagaagtgcgggatggatgcgatgataataagaggagaggagaggagagagagagcgagaggtaggggatgatggatggatcgcggattgggtaaatggaatggattggagtgaaagagaaaaaaaaaatttcatatgcagtgcaaaggtggaaaccttttttttttatttccctcctcgcctttattttccttttacgcttcccctgtttcatgccatttattcgcctctttaaatccgtccatcaaatatggggctgtgggtcggggcgtgtttcgtgtttgtgctcctttttttgagagagtttcttggtcaccttttgaatttttactgttactgtttttgcatttatttggtggtggatatgggtcgtatgtgctttgtttaatttggacttaggtgaaatatgccgtatttgaaattcgcacgctttatagaacccgaatcggttgacatatagtaagatgatgtgcgtcactctaatgcctcttaagattctatatttcggtgtagggtttaaatatttttttccaacaagcatttatatgtatatatattttgttatgtaatcacgactttaaaataacgctagcaattacgcgacacctattcggagatgtgggtaggtgtttgtactctctttaaatctaatatcaagacaccttttgaattttattatttttcatctatttttatagtagatataagtcttatgtgtattacctatatgatttatcatatatatgcatgaaaatatgtgataaaaatatatacatgcttgaaaacgaatcggttagcatatgatttgtttacaattacgatgcctttaagatttttcattgtataggtaaggtttcaagtttcttttccaacatttgtgtatatgtatttgttgtgtaattgtggcgttagagaaaatgtactccctctgttttgggttatatgactttttagcatgctagaaagtcttatgacttgaaacggataaagtagctcgtaattcaatcccgattatctactgtattgcataggcatgtgagcccgagggtatgtgagtgatcctcgttcctcgcaattacacaactggttagggtggaaagcaatagttttggcatttctcaatttaattaattagtcatcatccaggcacctctttttctcctattgttggtgctgacgtggcttgagctggcctttgcggctggtttatggagtatataacttgattaaagtatattggtgataagattagtgatgcttgacagctagatgttacatccatgcccgtcttctcccacttaattcttcctctcatatttcttgcatgctaggcagcacgacaggatcaaagattcacagatctatatagacacgcacatatatatactatctctcatagcttggaaggaaggaaaaacattttaattagctgttgcaatcatccctaatttcttcagtttggccctagaattaaggaaggcatctaaattactgtgagatgtacaatttttttcactcaattttatcctatccaaatccttccctttgttagttttccatatagcaaaactcctaattccaagacatacgggtagagttcttttcccatgaaaaaaaatcatttaactatggataaaatttcctttttcacttttcataccctacataatctttgcatgtactttactgaaaatcttctaactgaaatagctgttgatgattttgctaactgaaaactaaagcaaaatgacctactcctattgagtattgaccttcccatattcctgcagggaatggccaatcagccgccaaaaaacccataaacaaatttgcacatgaaatagctggggttgtttaatatgcgtatacgttgtccttgcatcttatattatactgccccaagtacgtgagtgatcagcagtacattattggctcacacaccctgtgttttgtactttgtgaacaatattctttaaatttattattgttcctgcctttttaattttatatgagtattagatccgtggcaatattctaaggtatcagtacacgtcaacttgcccttaaggaatctcatcttgggcacaagagagctgtgggtgatttcttttttataaatctcatcgattatttttttgtaattaagtagctaaacacatagaaaattcgaagaccttaattataatgacaatgagaaattaaagctcgatcggatccaacaacgtgcaaattgttcgtgagaagaagagttatggtatcaaagtactggccacgataattgcgtaattaaggagggagcttgatttgcataaaaaattgtggcacacgcattacatgagaattaagaaatgtagaattaaaatatttattatacattcacaaaagcaatggacaaaacaagtgatttttgcatagctgtgtggattaattatagtatgtggtgaataaatagttgatgactaattataaagaattatatacatgtgaaaaccaataataaaatagaagtgtgtagacttcacctgctgtttgcccctataataatccaaggtatattttaaggacccccactaacccaacatatccatgcaagcaaagatgaaaatctcaaaggctagcaagtgtgctacacaaagtgccaattaagacagctcctgatctcatctcccacaactaaggcctgattttttttgtctctaattattttgtctatcttcctactcatggaccacatattctgatctgttttgttttgttgaatcctaagaccaaacccacccaaaatatgccccccatcctatatatcatacaacctagtgcttcgacaagttaatgctagctacaactaagtaggccaatgtcacatctaatactagcccatatattttgtcatgatatgtaactttggtcttgcatccatttgttggggtccctcccatatttattccaagtggcaccatgtatatataggtcttcaattcctttgtgtatatctgtcttttagctctccttacttttagcaccaacacaagtatgagaaaaaagagatatggtgcacttgaacaaaatttgaatgatggagttcactttaagtgcattgcatggtctagctcactccccccatgttgtgttatgtctccatcatgaaaagccatcttttgcccctgagtacatgtgacatattcctatatatccgaccataatagcaactgtggctttttccaaaaaaaaaatgttgttgattgaaatatttttaactattatggtgctctcatgtcatttggaaaccgaaacaaattatcagcaaggttttttaaaagcaaaaagaatatggattttgagcttgtaagttaagtatggttcaatgacatgatatcctcgttcttatgacgcctcctcttcatttccacatgtcataattcgaatacacacaattaattaacctttttaaaaaattaacatctaattcaaacggaacatatataatacacatgataactttgctagatttttcataagaattatgttgtcgatgaattttctaactacatccatctcaaaatattaaagtacaaagacagctaaaacatagtagtactatattttaggatatagtatgaaatacatataattcttgctgatataattaattaatgaagtgatggccagaaattgggtaaagtactagcactagctaaagatatctacacagccaaacctgacatgtattagtaaaaagacgagtaaatcaaataattaattaatcaatcaatcaagaaaaaaatgaatggatccagtaccttttgtttaccactctagcagagctgcgagtttgcattgacctagagagaatgcagtgctgatgagtaggagtaccaattcgtgcatcgtcactctctctatgggacacagctagctataacaacattcatgtcagattgggctagctaccaatgctgcttttgagcaccccggatgtggtactgctactaccaagaatggcctccatttcttttcctttctctaattaatctggttgctttgctttaagtttgcttctttcaagaagacactgattcctactagtatctcaaaaagaaaaagaagggggaaaaatattcagggtccataactaataaagtggtcagtattttggtgcaacatgtcagataaaattatggtcatttcctagcaaagttcagtcaagaaattactccatttttcatagagagagagagatgcagtacaatattttttgaccaataaatactgtatactcaacaagagaaaaagcagtttcactactgtcaaagctgcttctctgatctctctgctgcacatagtagtaatgttactattataatatctggaacagagcagtgctcggtttaagcctctctgattagctttaaaatttacagtgatttttatgagctactgacccagtcagccagccaggagttaatatgagccagggatcagaagttcagaacagagaggctcgtgcatggtcatgcactcacgtactctactactgtagtctactgtatctatctatgagactatggccgtattgcattttttttccttatctatgagactatgaccgtattggctttttttttttctttcgtaatttgagaatgttttttttacttggtctctatatccaaccagatatatgtagcctttttaaactaagaatttagtctatcaaataacccaatatgaaattcgctccagtggagatttgaactcaggactttggggtgctagtgtgctgctactcaggtcactgtaatcactaagctacatgcactttcaaaaataatttatgtatgaactgtaagaaatatttttatcatccttagtttacatggctaattaaattacaacggtttgtagtgataaagtatacctcgagtacgtaacgtagcaagcaatattattcatacacagagatgcacaggttaatgactagtagcactaaaaatcctttctcacataacaacacaagagtactcctactatcgtaagaaaaagttttatcagccattcagccttaattcacaaggttaaattacaacggtttgtagcaaagaaagaagaaagtatacctgtaatagtaccattgtactccctccgtactcgtaaagaaagtcgtttagaataatgtttaagtcaaaccttgggaatataaatcatgaataactcctaagttgttgagttttaaaatgtaaaaattatatgaatagatttatcttgaaaaaaaatacttttataaaagaatacatgtatcacttttcaataaatatttttatagaaacaaagtcaaaattgtgttttagagaccgtgtcgttaccctaaacaacttcctctatgagtacgaagggagcacgtaataagtctaatcggctcaaattacccttgtacaagaaacatggccattgcaatggctgcaactgtgcaaacacaggaaaagggtatcgaacatgcccaacgtagccatcatcgttcatgcgcaaaaccacaggttagtattaaaaacattaaaagtactcaaatatttttatatttgcaaaaatgttaataatacgaattatcaatatagggcctgttcggtggccattgctgcggctgcagctgcagccgctgcaacggtacatacgttgttcagatcgctatgatgcagcggcaacgctgcattgcagctgcagccacgggctgccgaacacagccatatttgttaaaaagtcagtggtgatatattatttaaaaaaaagaggtattaccaaatttttgtaagatagggtgaggaggccagtgtttggttcgatactttatcaaattttgagagtagaaacttatagaatcaccaaatgttggtagaattatgttggcaattgtatattgttcattgccttaccagagaatggtaagaagtgaataagctcgaagattttgtagaggccattactattaaacttgctcaaacgctgaaactaatctttgctattaattgcctgatacgaaattgaattccggttttgtacttgggcgcagtactactacagtacactactgctgctgcactatcccatgttaaactgcaagcaagtcagcaagtgcgcgtgtgtgggtgggcccacaaaaaaaacgaagctagagtgtgggggcccgtagcggtacgcgacaatgggtttggggggcttgtacgtgggtgggtaaagattccgtgagaagattccgcactcgaataccgcgtgtgctctgacatgtgggccccaccacccccaacgtttccgctaactaatgggtgcgctttggctgccacatttcgccatttttttttctcttttttgctatgcgcacacacgtctccagctatgctctgtttcatttcagctgctagctgctgctgcgatgaaagttttaggaaaaccctgttcattggtaatgccgttttcatctttttccacgtaatcttaatctcaaagggggcctatgattaagattgattaaggagcacctaagacgaggaagttactagtatatgatcaattgattttttcaattcttgtaaacttgaaaaatagatttgtttaatattttagtccagcttctatatagtattttttttttcacgaaactcaccgtctagcctttaaaaaacttgctaacataaatcgaggtataacctacatcttaatcagaaatgaatgggaccataaaaatgctagtagtgtacattttttaaaagaaaaacaaatgatgcatcaatgtcacaatgtggttgttttatattacaagccatgtaaccaaaggagtaaacatattgtgttagttgtaagaatggtcttataggttgtacaacagtacaaggtcataacgtcaatatgccatgcttgatacggtagcaaaagccaatggcattcatatatgaagcataacatatttcatccgagggatacttcaagttttgtaagatatgtttgtagtttaagaccgtttagagtcatttccaaaattcaagaccataaaagtgaagggataatttggacaattccatcgtaacgttacacgagttgtaaaaataataccatcataccattcatatgtgagaatggcaggcgggaccaagacagatatgtcaatgacatgtacaatggtattttctaacttcatgatttttgtgatggtaccaacaaactgtaaaaaaaagagagaaaaacttccacataaagattactagtatgtttccgcctatacaacaacagtggttgaaatacatacatttctcatgctctataacgctctaaccctaaacccttactacccccaaagtgtctttttctattgcttctccctaactccctttgtgcgcctgtgcgtgtgatatattgcccatcaccaatcatgcatgatgatgtatcgatcgttaccaaggagccagaccaaaatgtacctggcgctcacatgttggccgagatatatattactagctacatgtgatttgtgatttgtgagctatagaaagctagctagcttggcttgtgtgccccactcagatggatcaatttcacctagtggaatgtataattggaacctgcactgcacactatctattgtactatatatgttgactgatgaagaggcaagggattggtgatggctagctcatgctgcatataattggtccaagggatagatgccaacgttagacttattaataaccggcctttttttaatccttcagggtagatcttaaggtttttgttattcactattaattacttcctctgatttttaccatatgactttgcgtattgagttttgacatacattttactattcattttattaaaaacacgtaattatcatttattttagtgtgactttttataattaaagattctttaaacattacttatattttttatatttacataaaggttttgagtaaggcgaacgatcaaaacatatggccaaaagttaacaacgttatacattgaaaaccggaagggagtaattttcttcctatatgaatgtcatgtcatgggttgttaatgattttgctccatgttgcgctacgacgtgtggtcgagaccatcgttgatgcatgcgcaacaacactcaaatggctgtgttgtcaccaccaacaaccaatgccgctgtcatcccgatgaggcacggctagaggtagtaatggatctttcttctttttacaaaatgtgagggctgggctacaaagaattggactaaaatttagttcttttaaataagatatttaagggttaaggtaagttatgaaaggacccaggagttgtggcccattaccgcccctgcacatggctccatgccaaggcatcaccttccgtaggcgaggttgggcagggcatgtgctcccaattctagaagggccacattggtacatcacgagcactgtataaggggttactgctatccgttgatatcatcgacaaatcgtgataaccaatcaacaggaacaggtgaacttcgaacaaattttaccaaaagatttaacttctaaagattttatttgaacttggtcgaattgttgcgaaagttactgacagtaacgcaaatcctgaatcatgatgacgaggtatggtatggtggcgcccatatggctatttgcgatgaaatgtattcccatgacgtggtatggatctacagattacatctgcaaacaattcaagaatgacggtttctttttcctcttaccagcgaattttccacgatgtcaagtccaatttaaactaggtttcaaaaaaaaagtccaatttaaacgtacacaacagtaaccagcaaataaattaaaggatggagacattcgccggtaagggtcaaggagatcacaaacaacattcatcgatcttatcagtttcgctttgtcttcatcgttgcagtgacctgcctgtgaccaacaatggaattgtatgcattttaccccgtgtgcttgactgcttgaataatcaatcgtgcgtgactacgtgtgccgtgtacgttccagatagaaatttctgtgaaaccacgtgaaagcattcaaaatcactcgcaaaccacacgttttaaacaagatttaggtctctttcaaacaaattaaaaaaatcataggaacactagaatattttcctacgaaaataatacaatggtatcctttgaaacaaattattgtttcctacgtgaaattaatgggtcattttagagcaattctagaggaaaatgagtatgatgtctctcatatgtttttctccctcatgtatctagaatttctatgtttttcatgtgctaatcaaatggtagttttgaaaatccttagaattccactgaatatgacattatattcctacgtaatattgttcttttattactgtatttttattaatcctgcattttaaatgagcccatagatttatgctagtagtactaatccctccatccaaaaatgatcatcttatatatttacccaccaacgccaaagataatttaaactgtattaatcaaaacaccatgcatacattctcccacaatgcatgcatcgattaaaccatcacgtcaattacaccctagcatgtacgcgttctcccatgtggtattaattgtattcaaataaaatacgtgtctatatagttatataatgattaatttgaaaatttttggattctattacatgatgatcaatttgggaatgagagagtaagtgaacataacatgggaggagtggagacgatggtccccatcgtttggcttatttcctaataagccaaaacatagcttattaggaaataaaaataaatttgtgggtaaaacttttataaatatgttttttgtgacttaaaagccaatgttaaaaaagaaactacgttaaaaatatgtcaaaatcaatattaaaattaagcttaaaaatttaaaatttggttttttcttttagaggccatccgatggggctggatgaagagtagcttgcggtgagagtaaagttggcggtttgctggtttcctggaagcaatcattgcttgaggcttcttgttgaacgttcaacaagcttgtctcgagtctccacacaagggagaagaaggggaagttgcatgctgcgacgactacaatttcccacggtgacaatcatggccatggactcacgaatctccacgccacgtcggatcactctctcgtactagcagtactcctttcgtcttattttaagtgaaattatagtttctgtatctaattttaatcgttcgtcttatttaatttttttataattcgtatttttttattatgagatcataaaacatgagtagtattttactcgtgacttatatttttaaatttttttaaataagacggacgatcaaagttgaacgcgaaatttaaaaagggacggagggagcactattttttaatatattatttatctcttcaccctaaaatacatatagcatccacctaaaaacccttagggcacccacaatggttatctataagctctctacaagagatccatgtcagcatattttcctacttggaagagattaaatgaagagagagagcaaagctatctactaacatggagatagtctatagagaaaaacgaggcaatggattagagagctatagatacccatgtagacataccattgaagtggtttactattaatctagtctattattgaggtgtacatgttttatagatagcaccttactttaccattgcgggtgctcttatattttgacacgaaaaagtgcttcgacaactacgaattctcggaggttggagtagtcgttttcatctctatggtagattggtggtcgtagcattcgatctggccaaaccaaaaaattcgttccagcttcggtctttgagaaaattcggccatcacgacagaacgacatggtcgagctgaaaatccaatcactcgagtgcttttcgaattgataaattatgtcttttttaaaaaaaatatacaaagttatttttaaaaattatattattttgttaattttataataattaatatttaattaattatgtgttaatagcccatctcgttttacgtatcttttatttttcctttttcttaaatatagcgtaccttccaatatttaagctatttggtttggggaaatatccagtgaaaaccattaaataagtgaaaattcatgaaaaatatatctaaaagttttttaaattcatgaaacaattattaaagatggatataggtatgaaaaacattcataccaaatcttaagacaaactcaactttatttgagaaaaacacaaaagacaggtgagtagggttctattactattcaccacctgaaatttgtctttttttattactctataataaagttgggttcaaacttgagatttggtaagaatgtattttatgtctacacctaactctactaatttatttataaatttacaatctttgtggtctagttttcacgagttttcatttattcgatggttttcactagatatgtcctcgttcggtttcggttaacttggatcggttttcggtcatgaccagaatatatgaaggtttcaagagataaaaaaaaacttacaaataacaacaaaatttaagaaagtcctttacaacatattttgacaatcttcagactggcacatttctctagagccagggccgggataaaacacataactaaatcgactaatgcttgggattcatgtggttcttacacccgaattctaagttgttgacccttttgcttttccaacaatttgtacatatgtaattgtcgttctattagatcataaaaaaaagatgaaatttctgttttttcttctagatgaatacgatagtgtgatcgtttctcttagtgcaactggtttttttaagatgctctggaatctaattaaatagtgtaaaagaaaatagtaaacaataaataatgcaccaattcgcataattctttttttttttgaaatgactcacacaaaatagtgtgaagtttcatattgatatagtagaagaaaaatacaaaattataaccttagaggttgtaaccagggaaaaacagaaaataaacacaccccaccacctctcgttaacatctccgcatgcaaccacggagaagatataacaccaagccaactacctctaaacgtgtccgattgttgctaaattaataagggatcacaacggtccactgaatatcaactccacacatagaagatcgtcggcaagctcctggtcacatagagggattgagaaggaagaggaagataaagaagaagattcactcgtccctcacgtcaatctgattccaacttcttacttgtaacttcgtgatctcttggatgaagcggcaaaaaaggccaatccttcatcagcatcgtaagctagtaaaggtgcgatggaacggtgcaagactgctcaaaacaaagcgccatatggatgctaaaactagctcaaactagtgggtagtggctgcataaaaagaggaggagaaaagggcagttgaagctcaaaatttacccagagtttgtccacaacgaggccataaaaagagcacaagccaaacacaatccactaattttatcactctagtagcagtagtaatttacaatccgggtagagtaagagcaggtacaataatatcaggctattaaccagctataaacatattttaatgagataaatgatgagagagaagagtagcgggctacagatctaagctgtagcacggactccaagacacactgtgtgtatatgacagatgaatatattaatagtatagtaaacaatctttgtatgaattgactatatataaattggagctggtagtaggcttgtactattagacttgctctaaataaactcacaagtagtagtaggagtagctttcaccaaagccgaaggattctcattctccccgccggccgatttataaccgcagcagcagtcaaccaccaccgtaccttttctccaccttctcacgccaatttgtcgccgtaaataaaaattttaccaccaccactttctcccacgcggcggcgaggcgaccgctttgctttctccggcgcggcggccggcggctgaagcgtgggcgggggttggggcctgtgggggccccgggaggagaggaaagcggagcggttgctttgccggaaaaaaagatggagtgtagtgcggtttgctctgttgctcatatccatctcgtcttccgcttccctccaaattgcaatgcggctttgggcccaaatatggaacgggcctatgtctgggcctaaattgttcgtgggctttctgggcttccctttttcccctaccagaaagataagataacggatttgctattttacttgcgacggatttttgggcttctattttttccccgtaggattctacatcaagatttgcgttttttatattcacttatggttgcactcagttacatagaactcaccctcagttgcatggcacttacacttagttacagtacatcaaaattagattttacattttttttatctagatttacgattttcaacatgtttgtttcttttttgggtaattaatttaaaatggttcatatcaattgatcaaaaattctgcaagattcaaagctataaatatgtcgaaacattaataggtagtccactgataatggaagcaactttatttggagtatctttatcttagaggaatctagtacaataggaagagagggaaataagagtaaagtgcaccgatggtctctaaactcgtgtggatgtattatttatgttcataaactcttaaaatgtaattttagatatttgaacttatcctcggtgtcatataagttctaattggctctaaatcacctcatgtgttgatgtggcatgtaatgacagcgtctatgtgtaaaaacatcgttttcttctctcctttttaattttatttttttttcaaaattagaaaacattttttctcctctctcctctctctctttttttttatttttcctatgtgactgacatgtgggtgtcactacgcatagtggtcactgtggtgccacatcagcgcatgatacgggttagatcccgtttagacccatatgacactcagggcaagtttgagatccaaaaaatatattttaagagtttagatatctagatgatatacccatataagtttaaaaactgctcgtgcacttcgcttaataacagttcggcttgtctcctcatcagcttagatcatcactttgcttggcaatatgacaatagaggcagcagcagagggatggaaataattggtgcaggtgatgatgcgatgcaaccaaaataaccggataaagggggttaggtgtcaggatgaccacatgaatgaccgatcgagatggcataacatgataagcccatgcacacgagttaacaaggtttactcgacaattcatatattgccccccgagagtgtatgtgtgcacatatagttcttattgttatcttggttgtaatatatgcttaaaactatatttacaccatatatataacatgttggtccagtcatcagtatgacatgcaacagatacggttaaactttcattacaatatatttgtaaatctcgatgaataattataatatttatgatttaataatctaaaaagagatatcaatgttcagagtttcagaagtttgcatccgcgaaaagagtttcaaaaatttaacctagactatatttcctccgtttcataatgtaagtctttttagcattgttcatgtttatatttatatagatgttaatgaatctagacatatgaatataagtaatgctagaaagtattacattatgaaacggagggagtattatagaagatatcctttggaacagagaaaacaaatatatagaggattattcttacgggaactgaactatttcacgaaacaaaatcctgtaaaattaattcatgtattatataagggagccctagatccatgttttcaaacccgatggagagggagtgaatacatgtattgagatgaccactccagtagccttttaatttccattttaatctctgatctgatcggtaaactctcattaccatataattaaggtcgctagcaaaaatgtcaaacaagagatctaacatgatgacaccaagatcccggcatgtcgcttggtttctgccacaactttatgtcatcaaattaattactacattagatctctggagtttgaatcagctaaaggtgcttagctgcaggtttcttgcaagatcagaagagtgacatgcatcagcccaagactacagacaaagagtagtacaaaactagagttttattttccactgattatctcatctatctcatcaggtacatgtgaccaactcttaatttagtttcttaaatacgtttacagttacattaattagtatatcccgatccatttggtttatatatctatggttacttcgtcttcgctagcccgtgtgtgcacatttaaaaaatgaaaatgcatacgtgcgtgttagacatgttttttttttactagtaatggcagtataacttctggtaaacacaccaattatgcacatagtcatttttgtatgtatacatgcatcaagttcaactgcaagaaattaaaaatgataagagaaattaaacagcgtcagtctctttctctgcacgcacgtaaccaagcatgcgcacgagtgctccttcgataacgataagctatataattttgacatggatcatcatcagcttagtttagttttttttctgcggctagcaattaattacattgtaacttataagtaagagcttaattagttccacattgtgtagagtgtgtgtagattgatcttattcgactagaagatcgatttatcatttaagtttccaaaagatcaccggaggattagtttcagatgaactcgaaatattcagaaaatgatatgatatctcatgcagtcagttcgatggatcatctcctttatagttttccttttgtgtttcatttttgtgagctgttcacttctaactcatagtcatgcttagtggcccaataaccggatcgaaaaagatcattggatcaattcttttttagatcaactcgaaagattcggaaaattatatgatgtttattacggtcagggtcagtttacatagtagagcatacgtgcatggaatgatggaaagagatgccaagtaattcttggaattaaggttgtaaaattactagtatttatatacatcgatcaacacagtggggattatttacattactgcacctacagtagctgccattgaaatatgggattgggaccacccgtcaactactgctactgcaagtgcagtactgcagaggatccgtgtcccgatcaaccgggacaccagaaatgtagaagcaagaaaaaaaaatgcaggagaagaaaaagctagggtcatttccagcagcaaaaatatgtgtccatatgtgtgtttttttacaccagcaatttcacagctttagcgtcaggtcgagttgacgcgtttgatcgtctccgtcgcgcggccagtagtagccgacgtttccaccgccccaccaccaccgctcgccgccgccgccgtcgccggccaccgagatcgccggcggcgcctcgccgtgaagcacgcgcgccatccaccccggcgacgccgacacgaacgcgccgtggtggatggcgaaagacgacgacgacgcttgctcgccgccggcgcccgcgccggcgccgcgcctggcgagcgtgcgctcccgcttgtgcgcgttctggtggccgcccagcgcctgcgagctgtagaactcgcgccggcagtagtggcacgcgaacagctgccgcggctcgccgtcgtcgtcgccgtcgcgttcctcctccttcgccggcgccggcgacacgacgagcagacgaggcgccgtcgcctgccccggcacggcggcgcccaccgtgccgatgaggtccagctcgacgagcccaagcgccgcggcggccgcggccgccatgcgacggccgccgccgacgaacgtcacgtcgcctcctcctccggcgagcttgctcatcccttccatggcgcgcgctacgtcgacgaacaccaccacaccaacttaacttgagatgttgcgacgcagtgcaatgcaaggtcgtagtatatatgcaggcaaagtaccaaagtctatgcaagaagatcaagcaaatgatcgagacggagggcatggtcagctggtcacgttcacgtaacgtgacagtgacgtactccgtgtcaatgttgccattatgtcataaataagactatccgtttcacaatatatgtactatatttattatgtcctatccggtgaagaatttaagatgcggttactgcaaattactccttttaatctgccccgaactagatgtttcttttttccgaaaacgcagtacagacacggacgtttataatgcgcgcacattcacccccagtaaacgggcacacgtacaccatatccatatgagcacgtttgaaatattgacctgattgacgaagtcaccacgggcatacaaatatcatatccctatgagcacatccgaaagactgacccgacatatcttgagattgacgaagtcaccaaggactaacccgatatattttgattttgacgaaatcaccatgggacatatcttgagattgacaaagtcaccacggactaacccgatatattttgattttgacgaaatcaccacgggtgtctcgctgtcaataggtatgccgcatatcattgaaggaataattaatcgcaaatgcgagtacctatgtcaaatatagaatttgaacctggataggttggttccaacacaaggaacctaaccaattaagctttatatgcttgcaaagacacctacagatagacatgctaacatacaaatttgaattaaattggttcatgtatttagtagagatatctaagataatctcttatatatttttataggatttctatatggctgttgacagaaaattaaggctaatcttagctaggttcgtgctctaaccacctagatctttctcctctagctccaacgactggtgacgtcctaacgagttagagtttagggtctcagattttggggtgggggaagggagaagaggaaggagatcgcggggtttagagagatggctgtgggagacgacggcccaacggtccgcggtggacacaggcggacggcgaggtagcaatggctccaaagctgccaagatggaggaggggcagagggccgatgttggcgatgagggaaaatagagcttgtagttaggagatgacggttggtggtggcgtttctagcaacggggagctgtcgaagataggaaagaaggcgccgcaggggcactcgttgccgccaacttagagatgagaggggggggggaacgctgcgatgataatgacgaaaagagagaggagggttagtggtaaatggcacaaatcttaaaacaatccaatggtttagattttgcaagatttgtaatggcattttttcagtcaaacgccatacagacagtccctatcgtttagtagtttgtaagagagcaccggaggtgcagtgtgcatgatttcgaaccattacgattcaagccctacaacaacgaatatgcatgtgtgcttctaaggcctttcacagtgggcggaacttaccgtggcttcgtctcacgtggcaagaaaagtgggtggggcccatagctatactcggttctccggttcctagcaaagcaacgaggaacttcgctcgggcgcggggcccactcggggcgcgggcccacttggtgagcacgcgggcgacgacgactccgcgcccctatgggaggtcctcggccgctgcccatggcgagtcgccggcgcggctctctacttcaatcgccggccgcgtcggccacgccgcccccgatctggtcgaccggagctcgccggccaggagcggcccgcttggggtggagagggagatgcgggcggccccccaagctcagctcagcgcgacgacgacgacaccactgccgtcctcctctctccgccttctcgtcgtcgtcggttggagctgcttcgcgtcgacgtcggtggtggccgagccgccgccgccgccgccggagaggcgagctccggaagaagaggaagaggagagagcaaaatgttcggcttcgggcaccacggccaagaccagccaccccagcacgtcggcggcggcggcgcgcaccagcccacctttaatatcttctgccgccgaccaacccgcgcgacgagcaccagatcccgaccaacccgtgcgacgagcaccatatccgcgcacgggatgaaggcggcgcccttggccacgccggtcacgagcggccctaccgctcctccgcttgccgcttgccgaagatcagcccgaggacgccgccgccactgtcctcccgcaccgccgctgccgtcgtcctcccgcgccgccgccaccgtccttctcgctccgcctcctcgtcaccgcctccgggaagagggagagtcgggcgtggcagggacggcgcgcgccgccgcgggcggcggcagtgacggcgaccaccaccacagccgtagtgctcgctgacgacgggggcagaggcgacgggggcttgagcggaggcggcgagggaacgggcggcggaggaggggagagccggcgccgttgggtgacgagggaggaggaccagttggggatttggtgtcggtgaagatatttgtgggccccacaagtggtgcttgcactgtgaagagagtgtcttcatcctatgtgtcatcctgtggtaactcatatggggtgcttgcactgtgaatggcctaataaaatttcagtgaagttaatggatctataaacggttcaaatcctatgaccacgcataatcgagtgtgctttcaataaaaatttagcgaggattagacctatagttttgcaaaattttagtgaagatcaacagatctaaggtccatatcctacaaccacacacaagcggatgcgctttcagtaaaaaaaaaatgaggttcacatatctttattttcattatattttgcaatttatattttattttgttggattagtttgtacgcgtggtaaactacggacaaatattaggaaacaaagagaacagcacaacaatcatcaggcaaagcaaaagcaaacagagtttgcttccggcgaggggaaacggctcacggatggtcggctgggctgatgcaaccgagagagccgctcgtgcgggcgacttgttgcagagatgaggcaagtgatgccgacttgggcaataggatatcattgatccctatccccaactgaacaagtgtctcaaaacattccaacggccaggttaagaaattcagtaggaaaccatcatttcagagcaggtatgactgatactattgtcaaacaaaagcgaattaaaccatcattcagaaaagaaaaaggcagtggcggcagcagcagaatttgaagcctgtccacactggaatggatttgtcacctgagccaagcaggccaaagcttcttgcggtttcttgcacggttgtgctgcaagagcatgtttaataattccatgctatgtgaaggaaagcagaagaaccctgaggggtatgaagataaggaatcaacggtgataccattcatgctgtgatgtttcttgagaagtaaatagaccacacatgttttcctagttctgtaggcagttgtacaggataatcgatcgatcgaacgaacgaaccatcccctacgcgatctaggtctacgggcgagcactcagtccatccttcccttgatcactctctcctgaacctctgtgggagtcctgcattaaccaacaagccaggaaaacaaatttcacagattcagtaaggacaacgacagcattagagttttcatctaaactcccatgtttagtgtgagtgaaaaatgatcatatatggaacttacacaaggagaacataaccaccccagccactcaggcaatctcgatcaacagaagcctgcagcgcttgtgagatcgtctcgaatagttcttccggttccttcaccaaagaaaattgtgacagaaaaatgtcatgtttacagtgctcaaggagaccaaactataagtaaaataccattctgcagatagttttcatgtaaactaaccatgcttggcttatacatggactcacaagcaccatatagtgattctgaagcagtgccagaaaccacaaaatctttcgctagttccctgcttacaagaatcacctttgattagtatgaaccttaaaaatataaaacaaggcagtaaatcagcatatggtacaaagtgaaaagataggtatcatcaaatgctactgtgtttttaagaggctagagacttacagtgaagacgaaggtaggataaagtttgagaatggaatacagctatatctaaattaacagtgtgttactaagaggcttgagatttgtcgtgaagaggaaaataggaagttgggaagaatacagctatactaagttaacggtgtgactttttgtagggctgctattaaaccctacaatcaagacaaaccctcttaaatcacctaaatggctacgtatatgagcaaatgaatggaaatgacaagcataatcaaacttaacctgagattcaacttgaaaaattaagactaaactagaagtattaaatatgagattatttactcctacacacactcccaaggggtatgggttgtatgatatttatcattataccaataatacattgtttatggtaccgttgagaacttcagatcagttgaattttggacaataaatttagtaaacgactaaaatgagacgagagaatataagtgatacatacttggcaccaatgcaatccatggtacatataaatggctcatcattatctcctaatccagcaataactggttggcagaagtacggcccaaacctataccatggaaatattctataagctgtttgcatagttaagtcaatggagagagaaaatacaaaataagacgagatctgtgagtttacaataacagaaataccataggtttacaaaacttccttgtacatttgattatttgaatgatgaatgattcaaagataggatttgtgaatcacatatgatgtaaaggatgtgttaagccaaaaccaagaattttacacgatggttgttaaggatgtgcaataaccaaaaacaagaattttacacaatggcttcagcacagtgagaatcaaagctaaatagctaatatcttgccctacagatcagaggaaatcatatcaatcactagccccactcgaatagcagcaatgattctcaattttcatcaagttgatataagaattaacataatacaactaatacaaggcatgtaagaacgactttgcacaggaatttcacaattcagtaaagcaaatattacttcctactcatcttacacatgaaccagttacttagaacgcgatcatcatcatatcatcatatcttcaaacagggctagtgagcattctaacctcttctcgtagaggagcgcggagacgaggctagcgaatgcctggggcttcatgtccctctcctccctcagctggtacagtttgtgcctgaacaccagccgctggtacctgcaaacacacggcgcacatcaaaacccccccaaaaccctaactaacaagcaactcaatacgccggttctagagcaaaatccgagagttccgggacacccacagcgtctgggcgtcggtggcgaggccggagaggccgatgtagagcttgtcgtggatcttgaacaccctctggaagtcggtggcgaccgtctgcagctgcaccccgaggcgccggtcgctggcgatcgcgaagcagttcttccccaccatcgccaccacggcgctcccgttgtactcgaagatctgcagcgacacgaaccccaaatcccccgccatcgccgcggatcagacgctagggttttgtgggagcggagaagggggagggggatcgcggggggcactcaccgacatgaccggcgccgatgggctcgacggctgcggcggacggcgaggaggcggcggcggcggcgcgcggcgattccggttggtctccggcgagcgagagaaaaaaaataattaaagaaaaaaaaacaagcggcgagtgtgatgtatagagaagtgaactgtaccagatacggatacgtacatgggcccaaaatccagcccattactgataggcctgacgccgctaagaggcccagttttgtgaggcccgtataaacataagattatctcgtgggccctgcccataataagggtttacattttttgcaggccatttttaaagaaaaataaaaagataagagagattacgcaattatgctcaaatcccctgaaatttggtttgccattggatggagtggtattggagaaacatccatatggactttgtgggaaatatcatactcactccgttttttaatagataaccccattgacttttagaacacgtttaaccatttattttattcagaaattttatatatatgcataagatataaattgttgtaaaacaactcacaacagaataaataaaacgaatggtagtatgatgctggaattcatatgtattattcttctctgtatttgagcttttctgtgctaactcaactggacatgccatgttaattgctttgcttttactctactgcaatttaaaattatttgcatttcaaatggtccaacatatttgctactagtactagtacgcaactgaagcttgcaatcctcagatgcaaggacgatttgaggcgcattatacttagtactagattactagtacgacgtgagattaacttgagataatccagcatatgcacgtgaagaaattaaatgaatcagatgcattgagtacctcttccagtcaagaagcttgtacgattgtaccaactattttatactcctaaaatataggagtaataagttttagttctaattctagaaaaaaaaacttattttattttgagacataggtagtactagattattttatctttggaattgaccaatccattttatctcaaaatatagtttttttttgtttttcaacgaaattaaagaaaagataaaaagtaaatagtcggttggaagtcactgaggttgtggagatatggagtattttgaatattttatgactatatatagaccacccttgatactatagaaataggtatattttgcaataaaatgtgaatagtataagtagctatgttttagatggagggagtataatccaaagctactctaaaattttaaagtgtatttcaagacttaacaattcttggatggtaaactgataatgttctcaagcttgataagcaagaacatgaacagagagattggagaaatgaatgtactactaaaaaacacatctacattagactttatcacactaattttgaagctctcttcgcttgccgatgaatgtaggagaatatcctcctctagaattgttttatatatttttgtgatgacccaagctccacaattccatgaaaaggccaaaaaagtgtatccttttgaaatttggcagaaaattcctctaacaatcttcatttgcctttcttagaaatataatctaaataaaagacttgaacataaattaagcataacacactatacatgcatggaggttaagtgggaaaggggggatgactaagctaacagtcaattaaatttaagcataatctcttggactttttgcatgaacaactcacttgcctttcaggtagaatgagacattccagacaaagacaagaaaccgtggtgctctgccccccagcaccattgatgccaataattatacattcggtccaagaagacataaccagcagtgtcacattaatccctacttgctaaagcaggtatggatgtgtggtctccaactaacctcatcaaatactatctaattatgcgcagacatgtccccatgggtcattacactgaagttgctacaatattacatggctctttttcttgcatccaatgacaatgcaaccatatgatattatgatattgtcttgattaatttcctacctaatatgcacatgctcattagttcactttgtttttcctagccatgtatagatccttggattttgaaaagggttagttagacttggatttgaaaagggttagttaatctaccagtgattgtgattccatttgatatttgagaactgagacatatactcctgtaccagctattacctcaatgcaatatgtttcactgacgagtgggcctgctagattatactactgtaccagctaacctttagtttggtcatgttgaaaagtacattgccattgtgaataagacagcagaatagtagatgtctctattcacaaagtacagtaagtggaggtcacactactcactacacctaccaaatcattattctttgtacaatctactacttaaaacattctgtacaagactcat

SEQ ID NO: 49661 - DNA, 2177 bp, Oryza sativa
aaaaaaattaagtttgattgtgacaactgacaaatccactaattaatttgaatctttaatttcatctatatgcatgtatccctcacgaaaaagaaaccatccaacatatatcatcatcctccagagcacattggttttatgaggaaagagaaaaacacatccaaagttaatctcttatgtttccccttaaagatataatgaaagtacaacttcttgtctctgcattaacgagagaatgcacacaatcattacgctgccatgatctaataaagatgccaattgccaaaataaattagatcacatctaaagtttctctagttagcaaagtgttttttttccctggattgattattatttttgttcttccatgtatatatatatctcacttgtgtaggagagacatatattatatgccctaagattatatcctgagtacataatcacaaatgcttgctttgtccagaatatttgttggattgatgccctagaattgataggttttggcctatgttctatctaattaatttatgccacttttctcaccctaaaaaaatgttctaattaatttgatttgatatacaggatcgaagctaggtgatcttagctagtctatatagaaaacgcaaagttacacatttagaatctcatttatttaaagagtagtgttcctatatcatggtatatgtcattgtagcttggtagctaaattaattgcaatggtgtcatgaacttgacacaacataatccataattcaaggatgcatgcatgcctctaccatgcatgcatctagctaaaagctaacatggatcactaactagtggtaaacttgtaattaattaggccccattaatctccatctaggttaacacatttgctaggagagatgcaagctaatgataggacatggatgactgcagagagatgtgagagatagcattagctaggtcctacattattagataagcacaaagatatatattttatgccagggctagctttgcatgccatcatacacaagcgcacacacacacacttgttaatcctcctaatgatcaaatcaagctctcacacaagctattatacaaaaggccaccattgtttccttctgatgcttactttgcatatcacccattaaccaattacttaattacttaattgtttctcctcccatggcccccacatgtaatacacacaacctgccactctcatccctaacctgccaacctatgtgtataaattcccagctccttccctcccatctgagaagaaagcagcagcagcagagaattcatcacccagcaagatcagtcaggatcagctagctaataagctagctacaagcttgattagtcacaaaaccacaagacaattagctagaagtatatactgagatgggtgaggaggagaagatcatggcagctgggaagaagatggtgagagtgagggagttcatcatggagaaggacttaccggcggtggaggagctcgagcgcctctgccaggccggcctctccggcgacaacggcgccggcggcggcggcggcaagaagaagaagagaggcatgtcgctctacgccgagcagatcggcgacccgttcgcccgggttcgccatgctccggaccacgtcatcctggtaattagctactccatccgttccaaaatataaaaatttaggaccagatgaaatatgtcctagtacagcgaatctcgacaggcagcctgacactgtgttgttgcatgcactgtgttaatcttacagtgatgttcttgatgtgattagttgcttgggcgtgcgtaattaatgcgctgtcattggctgctttgatctgtgtataggtcgctgagtgtggagacgaggtcgtgggagtgatcaaggcgtgtgtcaggatggtgaccagaggcagcagcagcagcttgaggaagacgaagacgaagacgaacaagtttgtcaaggcggcgtgtcttcttggcctcagggtgtcgccgtctcacaggtgatcgatcatccacgccgccatggacgaccatgcatgcgtgtccaagctaagctttgtagtacgtgccatggcgatggcgatcgagctagctggtgctgacgacgacgaggtgttcggtcttttgcaggaggctcgggatcgcgacggagctggtgcggagagcggaggagtggtgcgc

SEQ ID NO: 49662 - DNA, 1979 bp, Oryza sativa
gcaggagttaaacatctaacacatgaaactaagtagaagctagataagaatgaagctaatcagaataagaccaaggagtattcacaatttctataaatcaaccgtttattgcaagatgtttaagaaaatttggtgtagtgagtatgagatgttaactaaaaacaacctttgcacggattagtggactataatcttgggaagcatctttgaacttcacctcagcaacatatttaccaatatgaattcttcttgacagggcctacaaagaaatgatcaatacatttcacagatatacactgattggaaacaatttaccattaatttgcaataatttgtgcaaattttgctttcgcgtgctgaaagattgaaagaacatatcctagtagcaactagatttatgttttttttaaagaacgaccaaattgatggaatatctaaaagaaacaataaacacagaacatgtaccttcagacatgcaaaatctaatgcaactgtttctgcatagttaccatcatctccatccacagtgaatagtggaagcaactcgttgaaatacatcttccatattgcatcattcacactgactgatgatgcaaaagagtgcaaaacctaacaacaaagcaataaaaactcagaacctcaacaatcattagtcatcagttcattgtaactaatattgtaaagcttagtatttacctttgggtaatctttggtaggaaatagaggtgaagggagatcttggggaaagaatggaacatcttctggcttttggtattgtccggcctatcagatttcacagatgtaattagattctgtagagggatgcttggaaatggtaatatgctaatatctgactgtcaacatagctataccaatgctgtattttatgttgattgattttgacagttttaataggatgctggataagatatacaagttgaaaaatagcataacaaaatttcccatttagtaaagtacaagaaaaataatagtaaatcatttatgttttctattattaataggggatggtacggttcaaactttttttctccatcgtcactatttttcccttctgatcactttcacttgttgaatgatccgtaaatggaagtgcctttaaaacacatgatttacctacacatgtagcatagccattcttttgttaatataaatctcatccgatactgtgtgtccgttcgaggtactcaaaatgaattcgtcaagccaacataagccgcaatgccgcatgattaccagaatggacatatcagcatcttaccctccgatgctatctttcaattcatcatggtacagtggagaccaaggtagataaactactgccaaaaaaacaatgtggtaacgaaatacaagcctagcctgtaagatctgtgtgactgaatttcacatacgaattcctcagccatgagtttactaatcactaaggtgactgaatagaaagattggcctcagaaatttcaccaggcaaaaaaaaatcttcctgtacaagttcatcatggctatgctacactacaacatggtataaaaaggatcgattttggtaaagaaaacgtaaggggatctagttgggcaggatactgaatcatgaatcaatggggagtcaagactcaagaacaacgagaggtggcgggcttaccttggcgtgcagaacctcggcttcccggacgaagaactcggcgagggatcggccgccggcggcggcggcggccgcgtatgccggcgcgttgcgcgggcgcctggcgcgctcgatgagggcgaagacgatggagtcctcctcccgcaccagcgcgtcgcgcaccgccgccaggctcagctccgcctcgcccatcgatgatctctcgatccgccctgtgatgactgatgagctcgcgagctaagggaaagctgctgctgctgatcctccacagctccactctgctttgccagtggtgccactctcctaggggcctctttggcttttt

SEQ ID NO: 49663 - DNA, 2093 bp, Oryza sativa
ccagggagacagtatatctttagtggatgacattgacaggcatggcaggcgcgtcagaaccgtagggttaaataaagacggtgagcgaggttagagttgaggccgtcaaatctaaaatggttagaaggtggagggtgatggtggtaacttggcgacgagaccgccataacaagaaaataatggtcgtgtaggggaacctcgccgcagtttggaggaggagaggaggtgtggatgggaaagggaagggggcaaattccaatagaacaagtctcaccccaacgaggcagataacgcaccatgcttgttagaaatcaagtggcgcatgcattgtgggacagaaaagaagaggggaaatgttactgtagctgttcaaatttgcgcaatttatatatgctgggaaaaactaactttaagtttgaatggcgtactgaggaatggatagtctcaataattagtatgcatattaataggagttaggagtaatatctacagaatcccttttgtttgtatactctaaattcgtgcacatgccctactggcatgctcatttaattccaattaaatttatatatataatattaggaataattttaggaagatagcccacttgtcttcttggcaatcataagggcattaataaggggtgaaagtttggttgaggtaagattaaacaaaaattaaatgaattgcactgcaattttgaacttgagaattagctacaggagtacattttaggatgggagtagtagctatttgttctatggtgcatttgcttgggggagttgagggcatgcgagtttaaagggataaagttattattttcttgcttagttttagagaagaataaattgcattagcggtacatgaacatgtcaagtaggtgaaatttagtgtatcaacttgtaaaatactcattttggtttatgaacttgtctgatacagtaaactaaggctaaaatggcacggtaagacccatttttatatggtgaacattataaattataaattagtagatgatgtgcgtgcttacagtatgtaggttatatttgtaaacttagtttccactttatctttctttgtttctttcccttacactattacttggtttttgtatgcaatcattacaccttattatatgtttatccttattagacacatgttcacagtgagtttaaatcaacaaaattaatcttgccatgtgattttgatgttcttcacacacaccaaacaagtttgtgcatcaaaacgagcattttacaagtccatgcatgcaatttactcttttgagaattaaggagagagcctcctactcccttcatacttatcgtagtgaacaatgctattgttaaattttaaaaactttatctataatggatttgccggctcagttttcgaagatgctcataggggtagggtttacgtacgtgcgttcatagaggtgaatgtgcgtgcgttgtgagtgtctgcgttgtactgtgtaattttaaaaaaataacatctaaaatatttatcttaaaattataaaaactagtattaaaattaattcaataaaatcatatatttattattttttatatgttgtaataaaaaatggtcaaaataatttttgaagaccaacttcttatctaaaccgataagtattatcaactcggaaggaacactttttaatatctagataatgggtgagaggtgagagggaatgccctcgatacatcttacaaatctcagttcttacttgaaatctattacatagaactctcaataattaccaatacttcagtcaaactagaggatgggacttaaaaaaaaatcaaactcatatcaattttaccaccggtaatttctctagactcctaatattctcatccaaagtcgatactccgtttaggtttgtttggcaaatgggataagaaaatagtatctcctgatattctcatctaaaatcatagccatctattcttcacacctcattcaatcctagccattcatccactttctttttttttttctgatcccacatcttataatccatttgtcaaacgtaccctctgttcgaaaatgcaaaaactagccgagatttgagaaaaaaaaac

SEQ ID NO: 49664 - DNA, 865 bp, Oryza sativa
tttccatgtactcgctcatatcaatccgtattagagcattctctgtgttgaaaaggaattcagctagtgttttccccagttcggtctttcctacacctgttggacccataaacattaagcttgctatgggacggttagggtctgataggcctgccctagaacgacggattgcattagccactgacttcactgcaatatcttggccaataaccctcttgtggagtacatcttccaatagcagtagcttttccttttcagattgttgaaggtttgacactggaataccagtccacttgctaacaatctcagcaatgtcaacatcagtcacctcttctcgaagcattgacttgcctgactgctggaattccatgagtttgttctcagcctcttcaagctgtttttgtagcgacagaagtgttccgtacttgagctcagctgcacggttcaaatcatactctctctcagcagcttcaatctccaggttaactctgtcagtctacaacaaagataagaaaatatgagttagagactatattacgtgccatggcacaacaaataacaattaaaagaacaaaccatgagcctacctcttccttgatcgatcttatgcgagtcatcaaggacttctcatattcccaatgttctgaaaggtttttctgcttctgcttcagagattctagatcagcttcaagcttgctcagtcgctgtttggaggctttatcggtatcattcttcaatgagagcttctccatttcaagccttatgatttccctatctacctcatccaattcaataggtttcgatgttatctccattttcagcttagcagctgcttcatcaactaggtcaatagctgcccatgacg

SEQ ID NO: 49665 - DNA, 2859 bp, Oryza sativa
  unsure (1)..(2859): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgccacctacatctgatttgctaattgcaactcttctagttctagcttatcatcacccaaattaattaacccttgattaaaagccaaagctattaattatattccaactccaagtaaattcaattcctccccatctagctaggcagctagcctttaaaaccatgcacaccttcaagatacccaagcaaggagatacccttgtcatccaatggaatggatgattcccttttggctccttttgttttgagataacagtacggcttataatatattctcctgtgctaattaaattagggttcatgctgagctagtactactcactagtactgatgtgagaggagaatgttgggtgacatgtataaagtcttctctgtgttgaactggacacgtttccagttttaagaggctgcttagatggctaggaaataaacaagagatggacacatggcaaacagctagcttaattagatgcctttctgtttttaatctgtattttcttcagatagtacatgtacgagtagctagcagaaaaaggtgttaagctttatttcatcattatttgggagttaaacctaatgaaagatgtactatgaataaaattaatattaattagcaatatattaagatatatacagatgagttagacttttgatgagaagcgtaaataaatatcttggggggcaccccgcatgctttcccaaataactcaacgtgatttttaatgggctaatgattcgccttatataagcatatgagagctaagctaccatatatatatatatatatatatatatatatatatatatatatatatatatatatatatatatatatatatatatatataaaattaactattgctgatagtttgacgaaaagccgtgatcttgttaaagcgatatattctcatatctatatcacccgttcttcttggtctaatacaatgttctagaagtgggtaatatgtgaaaaaagggaaaagttctctttccaagaattacatatatactatgcaaattaaaacatttgttacatgaaaaaaaagcatttcctatacaacaaaatatcaaatcatgctgtgttttttgccagaagaatttcctatacaacaaaatatcaaatgcaacaaaatatcaaatgctctctcaagaacacctaagagtttagggaatcaagcgagacacatcgcctactgcaacagcggaatgagcacccgcatcggctgggcaccgcagggtacatcggcaaggaggcaatatgggcccaagaagatgcagccgctgcagcagcgaatgtccatgccccgttttcagacatccctgaacaaagagctcgcaactgggcgcgggcaaggggtaaggtcaacccggatggctctgtcacatttgagaacaaaagagatgccgtcgtctatcaggaactggtgagttcactacttaacctaactaatttccgttcgtataaagtagaagttcgtataaatgactcttttttttctagttgggcttggttgctgaacaagcttcacaaagcaaggttgagtccgcgccgaagaggcgcgaagatgacatcctcacaaaggcgctcggaaccaaagaacatcctggccggactaggggaattggtagcgatgtgccctggaagcatggactcccgcagtacagttcccaatacaagaaacggaaagtctccaaggaagagagggacgctcgtttgaaggccgaacttaaggttgaggtcattcaagaactagaagctagcatgaacgctagggtggaagaaagggttaacaaggtcctcgccgacatgaatataccccgaggcacaacacctgctgtgcatccaactcctcgtgcacaacacgacgcgagtccgtcacagcataggagtagttgtgcatccacagaggtgctggcccctggtctcccggtcgcaccactagctgcagtggaccacatagaggtaattgatgttatctgatccatatctaataaaaaagcctttacacgttccaatattaaattcaaactttcacatatgtagggcgtagcacagtgtgtcctactggcgagggtccacccaactttcgctcccgaagtcgctgagggcatggctttcaagccctcggttacagacaaggtccacggtgcagacctgctagctgggtatgccaaggtgtccatcgatacagtaaaggacacctggtcaggctatccgctgctcgtgccccccaatgatgaaatcatgactttgggcgatgcgcacaagacgttcatacaatggcctaaagaagacatagttgtgaagatgactcctcgtccaagtcgaccgacggagcttacacctcccaagtctaagctatcaattgaggctccccgtggaccggcattgtcagtacctcattctcctggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggcagcgacatcgatgccggtgagcaaagcggggaaggtcgtgagggcgccagcccaa

SEQ ID NO: 49666 - DNA, 1196 bp, Oryza sativa
cagagctaagcctatgaacagatatctgacatgatcgcatgaacatgccaatcaattacgccgtgcaaatcgatcgatcgatcgaatgaaatcaggcgtatccgcccttccacgcggcaccgcgataggcgccgcggttgtccctccggttgttcctgaacgcgcagcagccgagggagtagacgatgacgatgaagacgaggaagacgatgcagacgacggcgacgcgcttccagtcccgcttcagggtcgccaccgcgccggccttgcacgactggcagttgtagcacagctgcgtgccgtcgtcgacccacgtgttgcagtccgggtccgacgagttggtgggcaccttcgtccagttcgtgccgctgacgtagaggaagttgcagctgctgggtggcttgcagcatccggactgcacgcagatgagaaggaaagagatgtgaggtttgatcagttcagaattgtatcaacacacaccaaaatttaccagaattatgtgcaaattctactttgtatgattacttcaaagttttcagttatatttctcatggaacatggttttcataatattgcagttatataattctttcttaacctactcatacagatcaaatggtttaaagtggatattagaaaacgtgtgctactatttcaggactgaaaatttcagacatcttccgatagaatactctgttccgatagttatcaaatggaaattttcgtgaggcagttgagttttgcgacctaaaagtttggtgaaagggcaccggaccgttgaattttgaagatggcgccaataaatttttccccttgatggtcagaactttgggaagtgttcagagaaaaggcatgctttgagttgaagaaactccaccacaagatagtctaatcctcccgttgacaatatcaccacgagtcatgaagcagtataaaatgcctagtgattcctaatctaagcattccaaatatgtttttttttcaaaaaattattctgattattcgactatgcgacaattgaatctgtatttcttgagaatgattcatattttaggctattgttttcaggtactcttataaacagtacgtgagcagtatgacagataaaaagaaacgatgtttgcgtagctaataatgcacccaaatcaccttatcagaattaatttccattagaaaaatactacccgggctgcagg

SEQ ID NO: 49667 - DNA, 1763 bp, Oryza sativa
atcaaactacttacagatttggaaactagcttcgattggggagctcccctgcattttatatggagtaagtatataaaagaaaatgtgtgccctgcgctgatgtgcttattggttcgaattgcactggtatggacgttcagaaagtgatcaagattgagtaacttttgtagggtgtttttgcctctggcgcaaacttctttctccaatcctggtgcatatcagtgaaaggccccctttatagcgcaatctttacaccactgagtgctgtgattacaacaatattatctaccatcttccttcatgaggaacttcatataggaaggtatatatttactcatttcatttattatttgggtatccatgttgttcctacttcactatacaactgcttgcttttaatacttttttttgtctgtactgttgtgtacatgaatgatcattgggttgtaatggtatcctcttgtgcagcatattaggtgcaattgcaatcatcattgggttgtacgttgtgctatggggcaaagcagatgatgcaaagagtgaggggctgaccatcctgtcaaatgattccaaaaggataactgaacctgaatgtacaggcgtcaaagttgaatgtggaaccaatctttcagtaccactgttatctggtaatgcaaatgctaatacttagacattttttcatacttgcctgtgaattgagaactgggtatttttcatactttccatcgcatggcaaatgtttatgattcaagagtccttgaccagactgaatgaacaaatggataatctggcaaaatgctcaacatgatgcttgacgaagaatcgaagattgctggaggttgctgtcaaaactgatataaccttccatgtaaaaggaaaatactgccgtcagcctgtcaccgatagagcatttcgtagttaaaacggtcgaattccttgttcaggcctccttttgaatcagggctttgtggaggaattttgtatgactcaaatgctataaaaaatttcctatcattgtacccatcaaaatcctatgaaattcttttggagtggctcaatgtatggaggttttggaggaaaattagtatgaggtcaacctcttggaaaatttcttttgagtgtatcttcctcatgcaattattgttcttttttttagcccattcaaacggttattcctataattttcatgcgttttaccatcatctgttttccatatgcattcctatcaaaatctgatatcttaaatccctgcttttcaactagtagttctgaatgcattcttactggaaactgcatcagcacaatttacacgcagtaacaatatatcaaccgatggttcaggaacttattcagagtaagtttgataaatatatacaacttactccctccgtttcataatgtaagactttctagcattgcacatgttcatatagatgttaatgaatctagacacgtatatatgcctagattcattaacatatatatgaatatagacaatgctagaaagtcttagattgtgaaacggagaaagtattatccttcaaaaggagacatatagaacttatgtccttttatttgcgcatgtagcataatctggcaagcacatttgacacaaaccagccatcaatccatcaccgccttggcattactaggacaagataagaatgggcactaccgcattagtaagactttggaacttcctaccaatgctggatttagtgaaaagcaaaaaggttttaactatgacgagattatagaaagct

SEQ ID NO: 49668 - DNA, 755 bp, Oryza sativa
actaatcacggtgaatctggtcgaccgcccataaccgcgggcacggctattcgaatagttttactctgatcagaggtgtacaactgtacccacaagacacaaccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcgttccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtagtgtattttaattaaccaacaccattgcggtggcactaatccaaagctattgccaataatcaaagtctatgctttaatgtggtccccttttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattaggta

SEQ ID NO: 49669 - DNA, 1528 bp, Oryza sativa
gagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgttcactcacaaaccacgcaggaaacctcagaaaatcaccgtacgcgacgcgggcccaagaaaaccccgacagaaaccgcgcagcagcaacaccaccaccggcg

SEQ ID NO: 49670 - DNA, 3290 bp, Oryza sativa
cagggatccaaaaaatgatcaactatctgggtgattagaaaaaacccctaaatccacctcgaattaaacctttaactccatcaaatacccctgaatccaacccccaacatgaacacccctgaagaaaaatcgaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattctgaatcagatccatacgttgggagcaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccctagcgagcgcgcgcgctctctctctcccgccggggagctgctcgtgctctctctcgccggcgagctctctctctctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcccaggccatctgctcacaggccacacggtctcatccacacagggaaatgcacgaatcatggcgcaaatcctacggatagaaaaacgacaaatattgggggtgaaaatctgttgacaaagatctagcaaaatcgatacggatcatattagctcccgaatcagtaaatcacactaaatttatcaaccatgacaattattaagttgctttctacagagatgctaggtttgcctgaggtgctatattaagtttttgataggctgctaccacgatatatatgtttagagatatatagcagttcctgaaactactaatcaaatgtgagcactgaaaccctcggcgatgacgtacggtaccatggaagacgacgtactgcatgtcggtgagggtgcatcgtgcacacggtgtccactgtcgaacaacagcttcggccggtcggggccgcacgttcacgagcgtgtacgtagccgcgctcggcgcgcgcagtctacgacctccacgacggggtggccgtcgttgtcgtggcggagaaggactcgggggcgccggaatcgtcgtgcgttatgtggtggggacggcgtgtggcgtgcgcggcgggatggcggcgcgcgcgtgccgccgccgccgcgctcccgctgcccaggaggtggcacgtacagcagcaggcgaccctggttatcgatcgatgcatgcatggctgcgagcgtgtcgacgtccgtgacgtgcaccagcgccgccgccatgcgcacgtcgtgcgtccatacctctgacgccacgatgtttcacttgagggggctcgcctgtcggaggtgttcgccacgctcatcgacctcaagtgcaacatcgtccttgctgatcagctcgatggccatttgcgtcgcctctgcctccaccccacctccaccctgaccgaccgttccggcacccgaaaactcagcgacccagctcccagcaattcgcctctgctgctacctaggaagagaggtatatgcaacccatatgtaggacccactgcccatgttttgctgcatttcacctacatatgggacccatgcgccgactcagcgaatctaaccacggtctacctgccatgtcagcccaaaccgattctcaaccaaattgatttgagtcggtttttgtagttgggagaggcgttacccgattgagggatgcaattcgatcgagggtaagacaggagggagacaatatagacttattccttaaactcggcctacaattggacgaacgtaaagtggacctttttttttctttggaataagttcaccggaggtccctcaacttaacagcgagattttttaagatcctttaaccacaaaaccagaaataggggtgggcaaaattagaccgaaccaaagaaccgaaccgaaaagaccgagaccgagactgaaaaattcgggtagttgttcggtccctaacatcaaaagaccgaatttatttcgggtatttcagttattgggctcgattaaccgaaatacccaaaataaccgaactggcccaatagactaggaggcccagtaggccagtactaagcccactaaaataaaccctagatcaccaaccctacccccagcctcccacttggctcggttccctcaccctcacagccgcactccccactcctcccgctcgcgccgcccgccttcgcctccaccgcgcctgcgccgcctccgcctccaccgcgccggcggccggcgccgcctccatccgccctcggcccactgcgtcggcgccggcgccgccctcggcccaccgcgtcggcgtcgcctccgcccgccctccgcctccctcgcgccgtctccacctccaccgcgccggcgcgtccttcaccgcctagctcgatttgcttttcagtttgtctttctgaatctgcttgatttcctagttgcatgtgcagatcagcagatgcatcatctatctattgagttgccttttgatttgtcaaccatacatttgttgtttggcttttgtgatttttttgttcagagacttctgctctcgggttagttcggtcatgaccgagaccgaaccgaactaccgaagtgctcggtcttcatttttttttggaccgatcggtcttgagtttttgatgaccgaaattttaaaaagaccgaaagaccgaaccgaatttctcggttagaccgaatgcccacccctgaccagaaagaccagaaatgtgtacccctcaactcacacaaaccgttcaaaggaggtcccataacagtatatgtgggtggtttcgctgacgtggcatcctagtcagcaaaaaaaattaaaaaagtacgtggggcccatatgtcagttgcacattttctttcttttcctttccttctcttctctttatctcagcgatgggcgggcagcgtgcgagcactgaggcacggcagccgagcgacggcgggcggcggcagctgagtgcggcctacaggcgagcggccgagcacggcggcgattagagcggacgagcacgacggcggacgagcgcgagtaacccttacaccacaacagccatggcgacccggccgcagctcgagtaacgtccattaattcttctgtcacatacagataatctggtt

SEQ ID NO: 49671 - DNA, 735 bp, Oryza sativa
tcctgcggccctttggtgggatgtaatacatcgtaatacgataaatttggactgactatttgtccagattcgtggtactagtatatgtcttatctaaccaaaactctttataggttaggacgaaggaaataaattcttatattttggtacggatgaagtacattttaacaatggcttataattgaatctaactctgatgacacatacaaacgctgttttttttttccagcttgatgggagcagctgctgtgatcaccgggttgtacgtcgtcctgtggggaaaagcggacgacatgaagcggggcagcgagccggcgacggcggcggcggcggcgaagccatgcacggattcgtgtcgcgacgtcgagcgcaccgccgctgaggagcctctcctgctggcagacgccgtctcaagcgagcagctctgattgtttacacattacgacaacactagactattttgtatgattagtaaaaacggatcgacagatctgtgcagttttgctgtttatgactagtttacctgttgtctgttccgacattcgagcggccagcaaatggcctgatttgttaaagatgtggggccgaattgccgatgccatcatgaagtatgattgatactccctccgtctcattttaagtgtaaccataaattttttttatgcccaactttaaccgttcatccattaaaaaaaatataattattgttgtgaatattactttatacgtgactta

SEQ ID NO: 49672 - DNA, 713 bp, Oryza sativa
cccaatcgtttaattgggatacatactcatgataaacgagacgtggccattccaagaagcactttagaacttagccttaaactcttttcaaagctcaatattttgataagcacctagtaaaaatgtggaaaagatggtgttttatagctcctggtttctaatttattttatataatcaagaactactaattcttatatttcatatgagaaataatttttttttcgcgaacgcgcaaaaggattgcacgtcaatatattagacgaaaagagttttagttacaccacacaatcagacagaccagcttatgctaggggaagggagaaaaagcaaaataaagaattgaagctagagaaactacggcggctaagaacaaactccaagcagcgggaagaggcctagccgcgctacactcccaacaagtccccaaaaacggcaacgccagctaaaaccacatatggctctccgaacgaatggactccagaaccactgagacgaaagagagtgcggagtcgaaaaccctagaatttcgttccttccacaactgccaagataccagaagcaccagggagtataagccggcgcggagatgctcaggtaagaaggccctggagaatggctaccaattctggaaccagctgccatgggggagagagggcagcccagctaggaggcgataacacccggaaccagacctgtcgagcgaacatgtagt

SEQ ID NO: 49673 - DNA, 4642 bp, Oryza sativa
ttcctgcagcccaattttaatttgaaacgggtatgtaaacttttgactaataaactttgggtctataaagtaatatttgaattcaaattcaaatttgaatcgggtatgcaaacttttgacttataaactttaggtctgtaaactttaggtgtataaactttagatgtatagaaatactatatataaaaaatattttaattcgaattcaaatttgaatcgggtatataaacttttgacttgtaaactttgggtctctaaactttaggtgtataaactttagatgtgtaaattcgaggtgtacaaactttaggtgcataaatttactaaaataagaaagtaatgtggtgttaaaaaaaacccacgtggaggggggatcggccctgatcatcccggacgatcgctcgcccattagcaaaaccgtctccaacccgtctatcctggccgaccaaccgggcgggtgggtttggatcctaaaccacgtcaaaagtcaaaacacacaaggtggagtatacatggacaactaggcctgcaatgcacatgcacggcacgggtccaatgatcgcccatgtccagagacggccgtcaaatactactagcagaacagcaaaaaggctgctgtacgtgcccgtcggtgtctcgcactctcgcggtctcgcgccgctgcagcgcgccgcaacttccaatcccattggctttagagcaaggataataagagcaagtataatagtgggctataagaaaactaaatggtgagtggataggagaagagatgagagagatgaaaagcgggctgtaagtttacagcctgcttaggcacaggaaccaagaaaattgtgagacagacatgtggaccatatatttatagtgaagagttaaccactatataagtgagctgatagataggctataagtaagcagctggctgtattattatccttgctctaatatagctcacttcctactactcccttcatctatttttgatagtcatatttccaaatctgaaaattttatttttgataggcatatttcaatccaacaacctatcatcttaatgattttctcgaatttaatgcatggctctctattcttccacacatgattggctatatgggctttgagaaatgtaaatattaatgaatcgtttgtttacgaggaatgaccagtagcatgcttaaatgaatgataagtagaactacttatccttggtctgtgtgtcaagatgaaatatgactatcaaaagtagatggagggagtattagcctatactaaagtcaacacatgtaatagattagctataaagttagctatgattttcttcttctatctctatctctcacttatatatttaatgtatttgtctttaagcttgtgttaagctagctcttgcatgagagccaacatccttctttttcttttttgtttacccctctcctccacgtaagattatagtaagcttatagctcactattatacttgctcttatacttcagctcgcagtcgccggctgtattaatattgtgcctgattttgcgagagttatgagagcgtacaaaccgcgcgcgctgcgccctataaacatccttccacttcttcacgtacgtacgaatcatttttcgtttcgtcagcaatggcacgcttgccttctcatcgtctcgcggctctcctcctcctcctcctcgtcgtggtctcgccgtgtcacgcggcggcggcggcggcggcggacggtgggcagaggccgactaggccgaaagccgtggcgatgccggtggtcagggacggcgcgacgaggcagtacgtggcgacgttccagcagcgaacgccgcgggtggcggtgaaggccgtggtggacctctcgggcggcgccacgctctgggtggactgcgacgccgccgccgggtacgcgtcgtcctcgtacgccggcgtgccatgcgggtccaagccctgccgcctcgtggagagcccctcctgcagctacatcgccagctgcctgggctcgccgccgtctccggcgtgcctcaaccgcacctgcaccgggcacgccgagaacacggtcacgagctccgtcggcagaggcaacgtcgtcaccgacgtgctgtcgctgcccaccaccttcccctcggccccggtccggcaagggccgctcgccaccgcgccggcgttcctgttcacctgcgggcccacgtccctgacccaaggcctcgccgccggcgccgctggcatggcgtccctcagccgcgcccgcctcgcgctccccgcgcagctggctggcaccttccgcttctcccgcaagttcgcgctctgcctcccttcggtcgacgccggcgtcgtcgtcttcggcgacgcgcgctacgtgttcgacggcatggaccactccaactcgctgctctacacgccgctcatcaccaggacgacggacaggtcgagcgaatacttcatcagcctgaagcgcgtcgtggtggacgaccgcgccgtgccgctgaacgcgacgctgctcgacgtcggcaccaagctgagcacggtctcgccctacaccgtgctggagacctccatccacgaggcggtcacgcgcgcgttcgcggcgtcgatggccacggcggggatcccgcgcgtcccggccgtggcgccgttcgagctgtgctacgacgggagcaaggtggagagcagcgccatcacaggggagccggccgtgccggtggtgttcgagctgcacgtgcagagcgaggtgaggtcgaaggtggcgccgtggatggtgtcgggggcgaacctgatggcgcgcgccgacggcggggcgctctgcctcgccgtggtggacggcggagcggcgccggaggcgccggtggtgatcggcggccacatgatggaggagatcctgctggtgttcgacctggagaagtcgcggttgggcttcagcccaaaccttggggccttcggcttgtcctgcagcaagtttcgcctcgggtagcacgtattggcatcgtaggctcgtagctaatctttctcgggcctcaaactcccaaaatctatacctgcattttgccgtcgcatgttggaataaattgctccctcctgccgtcctgcgtatctacaacccggttataccccacgatggaggtgtacactagtaaggatacactattacacgtttaaccattcatcttattaaaaaaatatataactataatttattttattgtgagttattttatcatttaaattactttaaacatgatttatatcttatacatttgtataaaatttttgaataagatgaattgtcaaatatgtgttcaaaagtcaacgatatcatctattaaaaaatgcagggagtatatattagggaaagtccattttacaccctcgaactcttatgcttgtctaaaatacacctccgaactacaaaaccggatatgatacatccttgaactgttaataccggacacttaacccccccgggctgtttttaccgtggtttttgccacgtcaaccctagccacgtcagcgcaaaacataaaatgggccaagcccatgttcacttcccctctctctctctctccctccctgccctcttcgttctcctctctctcatgaccattagcggcggcggcggtggcgcggagctgtgacggcggcggcggcacggagctgtgaaatcgacggctacggcggcggtgtagagcagcgagcgcggcggcgactgcgtaagatctaggtcggcggctgcggcgtcggcgtggagccgcgagggcggtggcagcggggagatggtgctagggcggcagcactgccccagttgcgtggacggtcgccggcggaagcctctgcgcgcagtcgccggaggtaggtccgggcgtcgtcactgcacgcgcctttggatatggctcagcagggaagaaccagctcgacacgtggtggaagcaacgacgagctagtggactgttgtgccgacggaacaagtagatggaggggcatgagcagctctggaaatggcagcaaatccagtcaaggcagaagcaatctgtcagggttatggataccacatacctaatattagttgactaaatctccgcaggacccaccacataccatgtcttatacggaaacaactttcggatataggaggagttccgcataaggaaggataaataaagttctacataaaaacgaaaatgactactcggattgtatccatattggtttccctagttctacttgtacagggggacatctatgggtataaatacaaggcctcctgggaggagaggggacacggaacaacagatcaaggcacaagatcaacatacaagccaacatgcgccaagacaagatgccagatatcgacttcagagataagtagggctagtcccctacggtgtctacagatattgtcaggagagacatagcgttgtcttttatcttgccggatgtggattcgaggagaaaggctaccctgttgtcgactatgagtcagcacttcagaccgccaagtcgacaacagttagataggctaccctaaatattgtactggtgtgattatggtgaataagagcaacgaccggcttcggccaacaggagtagggttattacctgaattcaggggcccgaacctgtataaaaatcctcgtccccatctcttttatta

SEQ ID NO: 49674 - DNA, 1167 bp, Oryza sativa
taaaaacatgtttattagtttaacctgcaaagaacgtcattcccaactagcccatttataccttctccgtgccaatctttcttcgacatggttgagagctcataccttcaacaagacaaggctgaaaaagttcggcctaaaacttattaggaaaaagtccactttaactcccttaaatatacaccgaatctaattcgtacccctcaaccagaaaaccggttaggacgactcccccaattactaaaaccggtataaattgactccctaagtggtttttgaggatggttttgctgacgtggcatgctgacttggtctattgtgctgacgtgtcagcccagtcaccaaaatacagatgaggcccacatgtaagtgataggagaaaatataaaaagcgtagggcccacttgtcagccatcttctccctctctatcttttcccccaaatcccccaaaaagaaacagcagagcaagcggtcgaggaagccgagcgcgtagttgctgtgcgggcactgcactgcacattgtcgcaggtgtagacgagggtgtggttgttgctgctcagcatcagctctggctcgctcctctcctggtactgtgcagccgcgtcgccggacccgcacggccccgccagcggcctcgcgcccggcggcgacaggtccggcaagcacttcgccgaccgcttgctcccgaaccgccccggtgctgccgctgctgccggcttgagcgtgcccctgccgcggatgagccggtggattccgaggtccgccaatagcggctccatgtcgacgtcgagcaggatgttgctcggccggacgttgccgcacgaacttcttgtcgtggaggaaggccagccctctcgccatgccgcgggcgatgcgtcgtcgctgccgatcctgcgcacagccagcacggcgccgtcgtccagcaccgccatgtacacgatgctgctgcccgccgcgcccaggatgtacgccgacgccttcagtagcgtctccatctccagctccacgtcgccgtccaccgtcaccagcaccgcgccgccgccgccaccgtccttggccttcttgccgccacatcgtccgtcttggcggcgacgacgccctccttggtggcgaaggacgccgacgtgtcagtcacctcctccgtgtcgtcgctctcgtctccggca

SEQ ID NO: 49675 - DNA, 734 bp, Oryza sativa
ttcctgcagcccaatttgctacaggtatacacccatggtacctcagatacatcatgttccagccgttgaaagaaagttgcattcattctggtgattcaaactttctggatcttgaatggctttcaacttgagacaactcaagcgatgaaaggtgtttactttggcattgctattgcatttttttttagcgttttcgactgacataatatcatcttcacagtgacagtcaatttaatttacacattttcttttgccttagtgtaggaaaacattaaggataattattagttgattctcctgtaaatttcttacccttcatgtttaatttcatatcaatctaaattctagagttcttttgctctcactgcatttccatgtaataaatacaaatatgtagtctcgtgttgtatcacttgatataactatctgtattgagaggtaaaatgaaaattatgttgccacacttcctaaatccaattaataagtgtcttctgagcttccagtatgttcactgatactgatttgaagatatcctctgaaacatttttttttaaaaaactcattaatactgatggattgtacttggacaggtccattgcaattaatactccggatgtgaacctttcagcggagaatgttattgccacaatgtcttcttttgactggtagatttgtatgatcaaatatagttgtatcatcaccatggacacattactctgatcattatgtaaaac

SEQ ID NO: 49676 - DNA, 1324 bp, Oryza sativa
ccatcgaccgccgagcgcgccgacgacaatgctatctcctgtgtcctgttttctccctgcgtgcgagtgctcgtctcggctagtcggcgacacgtcccgttgatactgtatgattttgtcccgttgccaggtggccgtgccgtgacaaaaaaaatacagtactactagtaattagttctcgtaattacactcaagtctgctgggagagtttaacatttcgagaagcagctgattagtagtcagtttttaagaatttaaaaaaaatgggttttcctgcttccggcttatagttcatttactaaaccctataacggcagcttctcagtatctagatcaaaaacttttggaggaatttataattttgagaaaagctgcagcattaaaatctccttaaaacaggcccttagtttggcatgcatctgtgcatgatgatttatttgcgagttgagaccgaatagttaatttgattgctcgatggatcatcaatccattgatagacgtcatgcgtgtctctggttcacttctcccatgacgccatgtaacgtgttcttcacacagatccctgcattcccatggtctcaaaggcgctttaatttggacctattttgtaagtgataaaaaaacagagatgttactgaaaatatgtttatggagtggctggttgatccgaggcaaactttaaggatgaacttttgctgctcatgttgagtgaaatattgtactactatactagtatggcactttcccttaaaaaagagagtgcaaaagtaataaagaacggctcgatcgtgtgcgccactgcacaacaccagtgtgctcgagaaggcttctgccgcatcctctccacgtgcactgatctttccaagcgtcgttgctccaagatttgctggtgttcatcacgaacaagacactgttcatgccgtgatgcaacttcggtgctagtagctttcatcactattacctgcagaagcgttcacttgcattagcagatgggggccagatatatcgatgcaatccaaccatttgcaaattgcaacgacctcttcgcatcctccctccgtgctcacgtctttatcagaaacatgacaccagcaaggcaggatgtgggctttacatgtgtcctaacttaaatcatttttaacttttgcaagtaaaatagttgaatatatatgctgcctgtaagttagcacgtatcaatctcctcttagaaaaaatatacaccgccgactcttcttatgtagttggtagatgagctaagctagcacaagaaaagctcgtagttaaattcctggtttggcatctgattcgacacatcacggacgga

SEQ ID NO: 49677 - DNA, 1058 bp, Oryza sativa
tgagttcttgggagcaatggcgccgccgggggtgggggtgggtgtggcgtacctgtgggggaaggggaggggtgggcggaaggggacgccggtggtggtgaccatggagagtcccaactactcggtggtggaggtcgacgggcccgacgcggaggcggagctgcgcaccgccgcggtggccatggacaagggcggcgggcgtggcaggagcaggagcaggaccgccaggcagctcacctgggtgctgctcctccgcgcgcgccgcgccgccggccgcctcgcctccttcgccgccgccgcggcgaggcgcttccggcgctcccccgctgacgccgccgacgagctcggccgcggccggggacggctgatgtacgggttcatcagggggttcctggcgctctccctgctcgccctcgccgtggagctcgccgcctactggaacgggtggcgcctccggcggccggagctgcatgtgccggaggcggtggagatcgaggggtgggcgcactcggcgtacatctcgtggatgtcattccgagccgactacatcaggaggccaatcgagttcttgtcgaaagcttgcatcctcctcttcgtcatccaatccatggaccgtctcgtcctttgcttgggttgcttctggatcaagctgaggaagatcaagccgaggattgaaggggacccgttcagggaaggatcagggtatcagcaccccatggtgctcgtccagattcctatgtgcaatgaaaaggaggtataatttagctgaattctcatcggaattttgtatactctgtagttttgtagtgtgttatgttcattcattgtgtgtgcttactatgagacaggtctatgagcagtcgatttcggcggcttgccagctagattggcccagggagaagtttctgattcaggtgctcgacgattccagcgacgagagcattcagctgctgatcaaggcagaagtttccaagtggagccatcagggtgtgaacattgtgtatcggcatcgggtgctgaggaccggttataaagctgggaacctcaagtctgcaatg

SEQ ID NO: 49678 - DNA, 741 bp, Oryza sativa
ttcctgcagccttccgagatcacggaaatttcggactgataaaagttgaaatttaaacaaaatttgattaaactttgaataaaatgtgcttaattaaataaatgaatatgtaacccgaaatttccaaaattttggaaattacgatccgaaacattgaatcccctgcgcacgccaagatcataagatcaaatgtcgactgagaattaatcaacttgctcttccgatatacgagtctaaccatgtttgatctctgtttgactgcagggcaacggtaaaccaatacgtgtactaccagggcctgcatctgggatcgtcgtcgatggcgacggccatgagcaacctgatacccgcgatcaccttcgtgatggcagcgtcagtagggtgagttcatgcatctctcaaacagatgatacacctctctgaatttctgtcagttcatgcactgtaaaacacagcaaattaaactgcatgcattgttctcttcgcttctctctgcaacggcgtatcctgtgcttgatcccttctagctagttccagaatttggttaaatttaattagttggtgtccatcaatcacgaacgggaccaagtaacacatgcatatcgtaccactcaataattgcgttctctccgagctagctactgtgtacgtacgtgcagagggaacaagaggacggatcgacataatcaccagagcacatgatcgaacagcatttgccatcattctgacctgtaaattcag

SEQ ID NO: 49679 - DNA, 1759 bp, Oryza sativa
ctagtggcatagcaatcagtctatattagccacccgtgggcagagcatagctaagaaaatttggttttgtataggcacgtgtttggtttattaccaactcctgggcatctgaggcttagtattttcagataattcatcatatggttgaaacagattatttgctttacatttttttttaaaaaaactacagtttcttaaaaagaaatttcactgtattgctcagtttattagttttaaactatttttaagtttgtttattacaaatattttatttatctttataattaaataggtagtctagagcaataattcgatcaataatctgttgtaaaatgagtcatagggtagaaccagttaccagtccaaacccatgccttgggctggtctaaaaatctacattttctttgcatctttttgtgggattttaaggtaacccctatgttgaagcctttattagaccactggtccatttgtcatataggagtatactacaacttttggtcaaaacttacttgttgtcaaggcaattctttttctgtgccccaaataagcagattctttatagatttttcaaaatataaatattctagaaaatccataatacagtttattgcggttagaccactataatgaaaaacaattatggttaacagacaatatgcgactcatacaagatttttcatttgcttaactgtatcatgatcgcacaaacaaactctttctgacactgtcataagcagtctgttttttttttgagggaataagcagttactttgtgttcttactgataatctgatactgtgatctgatccgacagactagaaaaggtggacctcaggagagtgaggagcttggcgaagatattcggcaccaccgtctgcgtcggaggagccatggccatggcgttcttcaagggccccaggctgctcaactcctcctctctgatcgtcgacctgaactttcttctccactcgtcagcgagcagcaagtgggttatgggcgccctgttcctcatctgcagcagctgctgctggtcactctggctcatcttgcaggtgccaagttcgatcgcctcactcaaccatatgcagccatgccaccaattgccaaatcttgttcagatgtaattgtacatcttggtatatatccagaactgataatcctgacaagatgtgttgtaggtgccaatctgcaagtcgtacatggatcccctgacgctgtcggcgtggatgtgcttcctgtcgacgctgcagtcggcggtgctcgtctccttcctcgtgccggacatcaacgcctggaagatccactccctattcgagctcggatgctgccttttcgccgtaagctataagctcgctcgatcgcctcttcttcaggtgatcatttctactgtgatgttgcaaacaaattaactcgataaatgttcactgccgcagggcgtgtttgggtcaggcgtgacgttctacctgcagtcgtggtgcatctcggtcaggggccctctctactccgccatgttcaacccgctctgcaccgtcatcgccaccgtcgtcgccgccgccttcctccacgaggagctgcacatcggcaggtgaaaaatcgatccatcaattggtctaatttcatgtaatggagttgttctaacgacgagatatttggttaatttgtgtcagcttgttcggggcgacggccattgttgccgggctgtacatcgtgctgtggggcaaagcagcggatggcggcggcaagagcggcgggagtg

SEQ ID NO: 49680 - DNA, 1723 bp, Oryza sativa
actaagtcggttgattattttttaaaaaaatcaaagttatagaaagaattgttacttgatgtagtgatttatttttttattaaataaaataattttaatgcctggaacacacgtacatatcgtcgttatgagccgtagctctttacgtcgaccatgatcctcaaatacttatctgagtagaagaaaacaagacagttgtaacaaaattaataaaagaagaaccaataacttttaaaaatggtactataggactttaattacttcggaatttatgattgaaatataaaagcgtgagatccctaatttttagagcaattacaatagcaaagtataagtcagctataaacacatataaagggaacgatagaagaaaaacggattacagatttatagcacatactttaaaacgttgtatgtataagaggtgagcctagatattattagtgggcagcatatacctatagggttactgtaaatgatttagatgacttttgggctcacctcacagtacactctcgttaattgtcgagcgagtagcatggagtagcgagcgcaaaagtagaaaagacgttggaaaatggagctgccgtaattaagaaggatgtcctattcccgtacgatgaggttgcgagtctcttgcgaaatccgaaattttgtctcagagatttgaagtgtgtcggtcgtgtcggaacagggtttaaggagaaatgggcttgggtggcttaagctgctggtgtgtgctccctccaagatgtggaggcatccactgttccatacttccttccatatacttccatacggtttacaacgagacggtgagtttgttccatcttctctatcgcatccgtgccattcgcccatgccccgtgagtccttggccaattctatcacctgactacctgatgacgcttttcctcgtcagcagctcagcaccttaccttttactacatgctgcacctgccggattcgcccgtcttttagatggggctgatgcgcatggtgcacacgctactggtttgccggtttctgtttggtccaatatgtggcgatggcttggaccagaccagcccagcccaacctagaagtgactgagtgagcgaggcacaagccggaataagttcactttgtgaccctcaaatgtgatcgaaatctaatctgtgaccctaaaccataaaaccggatatgtcgacccctcaactcttaaaaccggtgcaatttaactccatcagcggttttggagggtggttttgctgacatggcgtctacgtggcgatgttgactcagtcttcggtccacgtggagttaacgtggcgcttatgtgtactagaattaaaaaaatatgttcagtaccatttgtcattaaaaaaaaataaatgtggaaccactgacatgtggggccatgggccctctttccttcttcctcttcctcctcccttctctctctttttctctctctcccatttctctttgtcttcatctacaggctgcggcgggcccgagcggccgcggcgagcggaaggggaggcggcgacccggcggcggcggtatgaattgacatgccaccattagcagcaagacccaaggaagggagcaggagacgacgacgaggagaaggagcgcttgagccaccaagaactccatcccaatccctctccctctctcagctcctcacactctcctttcaccaccttcctgcgaaccaggtagtggcaaagcagagtag

SEQ ID NO: 49681 - DNA, 1992 bp, Oryza sativa
ttcctgcagcctagaaaaaacacacatctgaaaacattgaagcaatactagggttcctacaataatcctactgttggtttcacaatgtctcatatgaagacttttgctcttggcattgttgtccttgctacactagttcttgcatctgagagtcaaatttctcgtaaagacttaagcatcgaccttggtggcggtggtggtattggaattggtaccggaattagtataggcataggtggtggcgccggtggctccggctctgggtctggttcagggtcaggttctttctcaggctcaggctcgagttcaggctcaggctctgcttctgggtctggctcaaggtcgagtgctggttcaagcgtagggtcatcagctggatctagcgctggttctggagcaggctcatatgctggctctggtgctggttcgggatctggttataatcaaggtcaaggaacaggtgaaggtgaaggtgaaggtcaaggtcaaggttatggctctggccatggagcaggcacagggtcagggtatggcgagggacatggtgaaggaaatggctttggctcaggatatggtgaggggcatggcgaaggctacggtgaaggaaatggctctggctcaggatatggtgaggggcatggtgaaggccatggtcaaaggaatgcctctggctcaggatatggcgacgggcatggtgagggccacggttatggtcaaggatctggttatggtgaaggccatggctcaggacatggccaaggatcagggtcaggctatggtgaaggatatggtaaaggttcaggcaatggatatggaaatggttcaggctcaggctatggtgagggccatggctatggctctggttctggccatgggaaataagacaattaattgttgaatttgccaccatgccagtgtctataaatttatgtttgctcatggaaattctatatgtataaaaataaataaataatgaactcccgttgttaaaggtgaacaaatttgcactcccaaagatgaatgttgactgtcaagctgtcaacattcttcttgcttgacagtttcaagtgtaagggcaagcccaatgtatgtgtgaaccggggacaataaggtggggcccagtgcaggtagcaatagctaagtctctcttcacaatggttagtgtgagtgggaggtgttaaagtgggtcccggtggtcccaccatgtaaaaaaaatatcgacacctatctacaaccatggagtcattcgcgcgagaaaaaatcagcgtcctcagttcctccgcccgatccctaatttcactcgatccccaatttctctagcggcggcgcggaaatttggccgcgtctacctcacagctgctcctgcccatgccttatccggtcgccgagatctgcgaccggcgggagcacctcgccgtgccgcaactccgaccttgtgccaccatggccttgcctgcagatggcgtcgtgctcatggagcctgatggtctggcggtggtcgccttgctgaacgaggtccacgttgccgtgctcctccgcgtctgtgccttgacgagtacgcgtcgactccgtcggggtttcagggatgaggtgattgatcccttcttcttcatgttcttgcttacattccatcgggtgattaaatccatgatttgtttttggttgtgcaagtcttgccaggaagataaactatgtttgcatcatgtgaatcgttgctttcaccttcccatggatttttggttgagcgtttagttgtgcggcatcaaatcttaataaaaaaaactgagaaacaatacacttgtgctccgtcgagggattaatgcaatagtactgctgcatacttcttagcttgtgatgtagtgatgcagaggtcatacaataggctagtactaagggatcccttctcaattacgaatacaagtaattttgatgatttaaataaaaaagaaaaatacaaggttcataatggactgataaactctagttttattg

SEQ ID NO: 49682 - DNA, 2578 bp, Oryza sativa
agggctgatgtggacaagctgacatgtggggtctacgtgggtcccacgctgccacgtcggaaaaaaccgggttcaaaaccaccgaaggacctaaagtaaatgtttttgtaagttgagggatgttatatatctggttttgcggttgtgggacgattctgtaactccatgataagttgagggaccttcggtgtactttttccttccagtgttccaccgtgttatggtcaggctcctctttcacgttgggccgtcagaacacgcggcccaaataggctcgtccctctctgataatttcacagcccaaacagggccgattgtcggcctgccacattccaggccgcctaaggcctgcgtatcggaattatggactggccgatatatgcccatcgctgttacgatcgtgggcgtgaacgtgaatgcgtgatccttgattggaataagttcaactgagatctcaacgaatccgattttcgtccttcaaccggaaaaccatatataacatgtccctcaactatcaaaaccggtgcacacaaaattcctcggtggtttagattgcggttttggcagacatggcatctatgtggctagtttgactcggtcttcatttgatgtggcattgacgtggcgtttatgtggcaattcgatccagaaaaaaaaataaaacacatgggaccccatatcattttcacacacacaataaaaaaaaatggtgggacccacgtgggccccacaagtcagtctactcacccctcttcttcctcctctctccccatctcccctttcttcatctctctcttgcgctcgggggggggggggggggaccagacgcggccggcgacgacgacggcggcggagatggagaagagcggttgccggccatctctctcttgcacacgctcgccggtatgccagggagctcgaggaggggggaagggagtactaatttcactccagtagtaatgatttatgaatcaatggcgtgacgcggactagattccccttcgattatgatactcagtctcgcaggcgaggtaccgcatcctcgcactctccaacattctcccaccgtcggccgattccgacgtcacggtgctccctgactctgaccgcccggcgcgcgcgcttctttggtcacccaacaagaagcgaggagtcaacgacggtggcgcccaacgagcttgagctgcgaaaaccaccatgtgacatctggggccatcgtaaataagtgccacatagctgtcacaactcacggcagataaagatcggatcaacataccattaccatgtaggtgctaagtcaatcaaaacttctggaggacttgaattgtactagttttagaagttggaggatgcattataaccggttttgcagtgaggcatgcgaagggaactggacatatagttaagaggattcagaagtagacttttgccttgcacagatggacgcgtgcgtaggattgggccgagcatatgccgccgtaacaagttagtaaaataagttggaaaaagtccactttgactcccttaaatgtataccgaatctaattcgtacccctcaaccagaaaaccggttaggatgactcttccaattactaaaaccggtacaaatagactccctcagcggtttcaagggcggttttgctgacgtggcgttgttgaattggtcttcgtcccacgtggcgttgacgtggcactgatgtaagattagatttaaaaatatatacgtgggaccaatttgtcattcacacacaaaaattataataggatccactgacttgtggggtccacatgtcattctctttccaacctttctgcctccctctttctcccttatctctctctttctcttcccgtcggcgagcagcgcggagagcttgccgagggcacggatggcggagcagagggcggcgagggagcggagtggagggcgccaagggagtgcgcgaagccgtgaagccgtgggcggcggtgggtggagaaggccggcgtgaaggccgggcggagcggcggcatcgagagctgccagtcgccgcggtcgctcctgtcgtgtatcctacagcgaggcgacgacagcggtgggaagatcgggagccgggtgcggctgccgtggcggtacagctccacctccgtgttgatgcgatgttgttaacactccgccaccgccggtagtggcggcggcggcagcggtgggaagttcgggtgctggatgcggctaccggcgccggccaaggtcaaggtcattgggagggcgccggtgtcatgccctgaagttcccctcccttgctctaaattcataaaataaatcgtccgaagaaattgtttaatttaacctagagatgaatccctaattaataaatgcaaataataatcggaatcgacatgtggaatttttcttggattctacatgtcaaaatatgctaacaggatttttactggaattttcagagcattggaaataattttaaccaattaaaataagcaaagtgcaaatattaaatccctgggaaaatcctttttccttttttttccctctcttttcctcctttgggccgccggcccatctctcccgggctgcagg

SEQ ID NO: 49683 - DNA, 1536 bp, Oryza sativa
agatgccccaccaccgccacctcactccgtctgcctcccacgaggagcacgagaccccaaacccctcgctaaccctcctccaatgcagctcgccgccctcgcctccgacgagcccccgccgccgccgccggagcaatccccccggcggatcgtggtcgcccacaggctccccctgaacgcgacgccggaccccggatcccccttcggcttcgccttctccctcagcgccgacgcccacgcgctccagctctcgcacggcctcggcctcgcccacgtcgtcttcgtcggcaccctccccgcggaggccgcccgcgcgctgcggcgctccgacgagctcgaccgccacctcctcgggtgcttctcctgcctcccggtgttcctcccgccgcgcgcccacgacgagttctacgccgggttctgcaagcactacctgtggccgcgcctccactacctgctcccgcacgcgccggcggccaacggctacctccacttcgacgccgggctgtaccgctcctacgcgtcggcgaacaggagcttcgccgcgcgcgtcgtcgaggtgctctccccggacgacggcgacctcgtgttcgtccacgactaccacctctggctcctcccttccttcctccgccgcggctgcccgcgctgccgcgtcgggtttttcctccactcgccgttcccctccgccgaggtgttccgatccatccccgtccgggaggatctcctccgcgccctcctcaacgccgatctcgtcggcttccacacctacgactacgcgcgtcacttcctctccgcgtgctctcgcctcctcggcctcgcctacacctcccggcacggccgcgtcggcatcaactaccatggcaggacggtgctgatcaagttcctctccgtcggcgtcgacatgggccttctccgcaccgccatggcttcgccggaggccgccgccaagttcagggagatcactgaggtggagtacaagggccgcgtactcatggtgggcgtggacgacgtcgatatcttcaagggcgtgaggctgaagctcctggccatggagagtttgctcgagacgtacccggcgttgcgcggcagggtggtgctcgtccagatccacaaccccacgcgctgcggcggccgcgacgtggagcgcgtccgcggcgagacggccaagatacaggcgcgcatcaacgcgcggttcggcggtccggggtaccagccggtcgtcgtcgtcgaccgcgccgtccccatggccgagaaggtggcgtactacgccgccgccgagtgctgcgtcgtcagcgccgtccgcgacgggctcaaccgcatcccgtacttctacacggtgtgccgggaggagggccccgtcgacgcgaagggcgccgccggcggccagcccggcacagcgccatcgttctctccgagttcgtcgggtgctcgccgtcgctgagcggcgcgatccgcgtgaacccctggaacatcgaggccatggcggaggccatgcacggcgcgctcaccatgaacgtcgccgagaagcaggcgagg

SEQ ID NO: 49684 - DNA, 1530 bp, Oryza sativa
agcatatgaatcatttcgtttcagagatgtacggtttgatttcccagtatgctgagttgcttggttaaattaaacccaaacccctacatgcgttctgctttcttcagattgtattctactgtactatttggtttataaaattcctgtacatgttctgaacttttcagtgctgatctaaatgagttagcagcaagccaatacctgaacttggtccctgttgctttgagaaattatgggctattggttgcatctgctctttcttctcttctgaacttttgttcattgtcaatcgctcgtaaatcgtaaatctgtttgaattggcgctatttctgaacttgggaacataattggcactatttctgaattgggaacaggggatagcacgctcgtaaatctatttgaattgtcagtattttttgaatcttggagcaggctattgcacagtttcagtcgacatgagctttttaaaatctcatacttcagcaaactgaaaaataatttggagggtttcagtctaatgttgatctaatgcatttcaatggtagcaaaaccaaggtcacttgggtgcctggaggtattcacatgcctgaaatatctgtatgattttttttcttctttattctgaatgacccatcgtcccatcccaatattgttcccatgttaattatgtgtggagcttgttagtcagttaactcatttgctgtgaaatttaatcgggaggctcaacaacaacaccctgtctggtccattcccttctgcatcagctaacttgtcacatcttgttgtcgagtgattttaatatatgtgcacggaagtttgagatatgtgcaaattatgtacaaaatttaatatatgggcaaatttgtacacaactggagatatgaccgtttggaccacaatgctctgttttttttatcctaggctctaatctaattgttgtgctttgttaaacaccactgtctgaagatgattttcacttgaggaaaatcttcagtccattgtgacaaagtgactccttttctgaagaaattctttattttttgaagaaattcaagcatgcttgcagttttagcccagttacagtctatatgtattgtagttacatatgtaacttttgttatttctcactgtaactaactatagatatatagtccttgaaaatttatcaacgctacaatctctaatttgttgtatataattttatgctagattatattgtctgccaagatcattttatggtgcataatgctaggtgagcatgataactgacctttcaatgttttcttgcttcttatttctctggacaaaattttgtcactttcatatctctccgattgcatatcccctgatttttcagactgtaacccatcagaccctgcatgtttatattatttgtaacataatttagaacttgttataataggggaaaatatttaatgctgctgcatgagtactgaatttttttgaagaaattcaagcatgaaagctgttacagcctagttacagttcagatgtaatgcagttacatat

SEQ ID NO: 49685 - DNA, 2821 bp, Oryza sativa
attcctgcagcccagtgagatgtttttttggtaattgagacggataatatttctaacctctgcatttaatattattttggaatgatttgcaattacaccctccagttaaaaacatttggcattggaaaaactaaactcagtttagcttacaccttacgtcaaattagtttgactgaagagagaatttaatgatgtcaataactgaatcgaaatggcatgcccagctgggagcgagatcgaccgatcgatatatatatccatcgctttctccagtggagcatcaaaaaggctagcatacacatgctgtacatgcatgatgcagcatggctatctgatctgtgtctgtcggtctaagactcttagtgtctatccatctacatctaactgaaatcgcctacgttgcatgcatccatggctgtgtcctgtgtagtgtttgcatgtcatcaaaaccgcctcttcagcatacacattgcctaatgccaagaagcggcgacgcacatacgcacactttgcacaataacctctctagatatatttagctacttgcacatgtttatccacttggctactctgtctaccgctataggcagatacatgtgacatataaaagtcgagaacttttataattaatgtttgcatttcaaaaaagataaaaatccaacgcttctcgatatgataggtactacgtaaaaagtatttaagtattggtacagatatttacgtaccaaagttaaaaagataaatgcacttagttgggagaaaatggtagaattgtccctaatttaattggtaccgcataggtactagttaagtcatttactaggtcttagtgtttcttatttgcgtggtttcctctagatttatgttttgtttcagaaaacacgttagtagtgtaaaagttattgtttgtgttcttttctctagatttacgttatgttctaaagaacacgtcaaaaattatccttttaattcatttgagacttatatttattttatgcgaagagattatattgtgttttaataacataacctgttaaaatataaccgaatgtttgcatcgttgtaagttatacattttattgatttatccgtataaaacatgaagtaagcttcttccacactatctctccttgtgggtgcacccgttcaaaccctagaagaacataggaggagatctcgattcaatctcttattcaaggaatttatgaactacataaatagctaatcaactgcgtaaatatgccctagatatcttaccgatacgcttgcatctagccgtcgaccgaccgatctcatctcctcttcaaaccctcaaccatatcggtgcttctccctttgtctcctttggtgaaccagttcaaatcctataacaataatgaagtgaaagtagagaagaaaggagacatgatctttgatttttttccctcagtacagaccgaatcaatcgctaaatcaacggattatccatgattcacgcttttttattgcatcaataccaatacgtacaacaataccaatcaatggagcctagtattcaattcatatgaaatgtccatattttactagttaattactccactgccatcacattattataattttattctgtactttgtccctctcttgatcaatagttcatattgccccacctctaagtatatctaattacgccgcaaacactgtaaaaggtctcataaaagtcatgctttatacgagacaccgaaggtctgacatgatgatatacgtggcaattgaggtctactccggaaagatatgagtgttttccgtgatatgatgtgcttagagcatggccagtatttggtccataggccctattggtgggccctacagtgagaatagtatcatgtgacaatttttgcatcgtataggagtagcaaaggtcctatggatagacccactatggatggcgacaacgagttcatgatggatgcgacaacctctgatagatgagtcttctctctctctctctctcccctttaaagcaaggtactatggttgtattcggttcaaggttgaaaacggctggaacaagtcccatagtgtatagagtcggtccaatcccattttgtctcttatataacccccttcacattgaacaccgcaatgctcttagtcacgtggcatccatgtcacttctgcaagcaacacatgaatgtttttgcatgatatgctactttatgtgggcacctgtcatacgtccaattggcaagggatgattggtttattatggtgcgatgtaactagctacgctttgaaacataggcatctatcttgcgcatgtacgtcttcatatttttttccatatagtcattagagcatttgcattgttgcatttggaggggtactagaggtgagagagaaatatggagccgccctacatattgcaacattttctccaactagtctcatcaatagatccaacactagccatagagccatattcaagtggagagaacatgcgtagcccacatgtcatatccaatgtgcaacttgtaagttggagagagttatgtaggtatctaggatgatacttgtatgattggtttacacaatgcagcgattctcattggttactttatttgacatgtaccccacacctaacaccccgcatgaattatataatgtggatgcttttatatcccaagttgtatacgtacgtgtatagtatactaggttgtatttctaatgtatgtttattgaagatatctgtgttgatttgctttgatatatattacatatttcctatattcctttttttattaccatagtaattattttaatgtttatctatctcgagaag

SEQ ID NO: 49686 - DNA, 2443 bp, Oryza sativa
atgtaacgaccctcattgtttaatgccacttaaatagttataatttttttttaaaaaataaaagatatattaacatgtgatatatcacttagcaaatatacaagtttgtccgaggtatgggcctgagggtatgcggagtgaggggaatttaccttcccatcctgccacgtggtcctacagcttggccctacccccacacctcgcgaatcgcagaagcagccaggggacctcggggtgccacgtcatgcccctcgagccctcgcgccgttttgccccgagtcccccgcccggctgccatgtggaggggggagcaagcggagaagggacccatgttgtaccgctatcaatgcgtgcggcgccccaactgcccctcgccgcattaaatgcggtaggggcagacgtgcggtgccgcccgactgacgcgcgtcagtcagaaatgaccggtctgtgaccggcctgtcgccggtcgcatctgactggacgggcgaccatgcccccacgtcacctctgtccccggcggagtggaggtaggtatgacccgtccctcccctgtgtcaggcgggggacggcgctgggtcccactcaaggacgagctgcggcttagctttcaagcgaaggcacggatcaagatccggtcaaggtagggtgggtccccacccggtagaagagtagatagaggcggtgcatgtggtatccccttgagctatgaaaggaggaccttacccaccgagaaaaaggatgattccaagcagacctaagctctagggaaaaagaaggagaacgttctccggagcttagggacccttgtgattcaaccataatcccacacacaggagtagagtattacgctccatagcagcccgaacctatataatcctctcgtctacgcgcaactagtaacgttgagggcggatacacgatctctagatgcgagccctttcccccgaccgaactcacaaaaggggatctcacgatctcccgctagagaggttcactcctcgacaaagttaaaatttaacttttacaaattaaaaaagacaaattaaattgcagttagttaaattacatcccctctaaaatttagaatacccatctacatctaactgaaactgccaacgttgcttgcatccatgcatggctatgtgttacatgtcatcaaaatcgtctcctcacacacgttgccaaatgccacgaaacggcgacgcacatgcttaaaatgcatactcctacctccctagcaattgctacctgcacatgtttatcctagatgaataggacaagagtgagcagcagtccggccaagtctacttggctcttttggatgtacgctgctaccagttgttctgccgcttgctaggtatatacatccatgggaaactagctaaaatgtgacttagaagttagaagtagcggttttcgaggaggtaaatgcgtgacgtggttggcaattgggttcaaccgaagaaatatgaatgttctccgtgttatgggtgcgttttactcactcgtcatctatggtatacttctagcaaaaaaaacgtgtgttctccatgatatgatacacactttgtgtgatatatatgatatatcgagttgataagacaccattagttttttatgataaagttacattttcaaacttagacatctatcttaagcatgttttgatatgtttctttctatagtcattatatctcgagttttatgactacgatatgcttggttgtatttgtaacgctcgtttccacgaacaatatctttcttaatttactttgatatttcgtatttccttcactactttattttaatgtttatctatcttaagaagggtttgatgtatttccttccatagaaataacgcataaccgtttgtacatatctgtttattgtgtttagtcaaatctattagatatgtaatgaataaggtgcctcataacaatttattatggtcaataataagctcatccattttaaaacttgtaaacttatctctagaggtgtatcaaagcaatcgagttgatcaaaaaacaagtacaaagaaagaacttggttgcaggccttgaccggaaaccgctcttgagcagttttatcggttcgcaaaaacaattgaaaaccattgaaatttgaacaaatttggtaaaagttttgaaactaagtttggagttttttttgtaaaaaaaaaagcattgctgatttaccaagcggtttgtcaacatgagttagctcgaaacctcaaaatttcatgaaaactgatcatttttatcaattttataaatccggctaagaaataggaacctcaattcaggtatctgaattcagacgaagaggatttccaaaaacatgcgaaaatgattttctacaaacagctagttaaagtcgggcgtctgtgaaatggatttccaatggaaaattttttcataggtggctacgcaacctaccgaaa

SEQ ID NO: 49687 - DNA, 1146 bp, Oryza sativa
tgccagaggttggtttcagtagaattgtttggacattctgatcattgcaacgaggtctcgtcagatatgtcgttgtttcttctcccctttgctacatctgcatcctgcattgtcagtaacgttcacttaaaatcttcagattgccatgaacatagctgttcagacgcgcagcaggcaatgctgacagtaacatctgcatctgcttctccttaaaatattgaacaggaatatggtcttggaaaggtcaaaggtatggtaaaacaacatatttcgtcaaacacatcaggcaatgatatggtaaaacaacaggtaatctaaacataggttaagcaaaacgaaacaaaattgacaggcaaaagcaacctctgacgcacagctcatcactgtcccaagtccaacaaatctttgatttctaaagatttctccggtgcaaattgcacgtttattctgatctttctcactgtttctggtaattgctaagcagtttaagctaccattttcgcagcaagcaaggtagcttcttccccgatcgatggatgcagcaatcaatcttactcacaccggaggagggacttgatatcgaaatccgccggccgccggggagccgccgcggcgcggagccgggacgacggcgacgagaaggccaggccatggagcatgtcgacgacctcctccttgtcgttgaggtagtagctcgccatgctcggcttgttccccaccgtgcacgcaaacacctgcgccgccgcaaggagcgcggtggtggtggtggtggaagacaaagcaccgccgttcttgccgccgccgcagaggctcgcgagagccccgaacatgtcctcgtcggagcggtcgtccccgacgcacaggacgaaccccagcgcgccaccgcggcgcgccgccatggccgacacgatgcactccgccgcgacgcccttgctcacgccctgatcaagaacgtgattgatgatgaacgagcccgacggatcggatggaagatcaccggcattgccgtttggtgatcgttacgtacctgagggatcacctcgacgatcttgtaaccgctgcgcacggcgacgggctcgctggcgagcacggtggcgaggtggtcgaggagctccttggcctgcaatggcgccagcctcgggtcgg

SEQ ID NO: 49688 - DNA, 770 bp, Oryza sativa
cccagatgcagcccttggtaggtcaggttctggtttaccgtcgccctgttcgtcagaatcaatccaagattgtcgaaaacaagctcgcaaaattaactactagcagggcttcgcgcagatgagaaatcaaagcataaatactgcagagacgtgtacgtacgtgcccgagcaaagccgtcacaaacaccaagaacaagcctgtcgtcccaaggctcctcgtctccttcacttttgccctggatttctcacaagcacacaaacatgatcaatcgaacagaggagggtgatgactactgaccagctagacatgaccaaattgatcaatttaactaactatttaagtgtatcaatggttcaattgaacagaagagggtgatgatgatctgactgatgatcagctaaacatgatcgaaactgaacaatttaagtgtatatatcaatgattattgctatacctgttggcgaggagggtgatggggacgaggacgagggtgccgatggcctggcggtagacgacgaagatcacggggctgacgccacggccgaacatggccttggcccagagcgtcatggccgcgtagatgcactgcgccgccaccatcgccgcgcacggcgtccactccctcgccgcggccgcgagcatgagtgccatggtttggctatggcctattggcctagctcgatctcgatccggcagcgcagaattgatgagatcgccggcgccgcatacagatgcagatgcgcgcgcacaagacgctgggctgcaggaa

SEQ ID NO: 49689 - DNA, 709 bp, Oryza sativa
acattagcgctatacgctattagcgccgaaacccctgcgtcacgagtcaagcgcggacgcgcacttcttccttatccttcgcgcaacatgcttattcccgatccgttgtgttgccagctgcttgtcgccgcacccccggaaaagagggtggcagagccgatggaggtgtggatcagtggatgggcgcggaggttagaaaggacattggggccgacggggcggtcgtagcttgctagatctccagatcctgactgccaggggcggatccagcatgggggcggcgggctcttgagcctccactactgtcgtgaagactatgaaagcccccacgaaggtcccagcaaatttttttatcatatatagatgggagggggaactgtaactttatctagtttgtttagatctgccgctgctgaccagcgacggcggtgtaggatatggctcgaaggagtaggggattgtcggccatagctgttgtcgacctcgagtactcgacagacttgacaatgacgaacggtcaaactatggcctgttggtgcacactatggccttatgtggagcaagtgcgttcttcttcatctttttgctctactaagaaaattggatttggtcttatggttcatgtgcatgaacatacagaggaagaaaaaaaaaatccaattgtgcttaaattatgttgaatttgttttgtctatctactacttgtttc

SEQ ID NO: 49690 - DNA, 2281 bp, Oryza sativa
cagcaggaacggctgcaccgagaagggcgtcgacgcgaacgtccgcagcacgaacggcacgtgcagcgactgcatcacgtccaccacgtgcgccaggaacacgaactccggcacctcgtccacccttgcacacacccacaccacaccacaccgtccattcgtcagcttctctgcctcgccgcgggtggcgcgacacgggtctaattaaaatcgtcaagaaaaagagaaaccaagagcagattctgtacgtttttttttggccgtgccagccgccggcgatccgatacggtcggagtcgcggccggcgacagcggcatgcagcgtttaaaagcgagagacggttggatggcatgtcacggtcggggtcgctccgtcgctgtacgtaacgtgtgtagcggatagatcattacggcgaacaggacggtctactcctgtgggcacctgtcctctcaagacggatacatacactaatttggccctggtccaatcgtgcactaatcatcggcacgcatgcaaaaccttccgcgtacacatgcatcgttaattttccacaacaaacttgcttaattactaattcgagctttaacggcttgagtgattttacgataattaagaaggtattgtgagttaagagttatggaagatatcaaatttgcattaaaaatttgtatctccgaggaactgtaaaatttctctaacggcttgcggttgatctgagaaaacgcatgatgcatgcatggtgcctatcaacctaatctctcttgctttttttctgcaaagactaaaaattggttggattggaacgctccctaacggcaggtagctcgggtcgtccatgcgtcacgcaaaacgcaatcgaacagcagcagcatgtgaaatttaaggccggtgatatgcgcatatctcgtgcatatatgggccataattaaacacaatccaaacatctctctcgcgggcgatcttaattaaatttcgattcgatttgatttgattcatacctgcgctggttttcttctgcatctcccaggactgggcgtcgagggtgccaccgatgaggtcgaacagcggcatgaacaggcagaagttggcatcctccttggtgtgatggatcgtgtggtacctgcagggattcggaccagcagtcacacacacgcgcgtacgggagagaaccaatgatcaggaagcaaattaagccggtgtagttcagagatccgattaatgcgtgtgaaaaaatgcgaaaagggcatgcatccaacgcatttaatggtcgtctgaattgcgtacgcgattggatgaagacatcaaccatttgatagttcattcatgggatgaatggtgagcagtgaagtggttagggtggtcgctacccggcaagaattaattagagcagccgggaagcttaattaagctgcctgttcttagggagatagagtttggctcgtctgccggcttttgttgccttgcaagtacagcactacaggttgtttggtcgatcaggttcatcagaatcactgcatgtctctagttggaatatttgcagccagagccagtacatgttgttggtcggggggtttgtttccgttaattttgatgaagatttaaattttgggtcagaatttcgaaactgttttctgaatttgaaaaaggaattgaaatggagtgtacgtacgttggggtgtagataaggtatttgaggacggggagcgactggaagaggccgccggggaacacctcgacgttgcagtggcccatggcgcggaggttgtcgaaacccagcacgtaggcgaaggccagcgcgacggagccgtgccccgccgcgcacgccgccgccagcggcaccgccatgagcgcccccagcaccagctgctccagcggcgtcgcgaaccccgctgcgcatgcaccggcgatcaattgacggagttaattagcttcgatcgatcgccggcggcggatcggtactcgatctgtgggcggcgcgcgcgagatgcatgcttacctgtgaatggctggggcaccttggcggagtggtgttgcaagtggtagcaggagaagaggtggccgcggtggaacgccctgtgcgcggcgtagaacaggggctcggtggcggcgacgtggaggagcgcggcgacggcgaggcccctggcgtcccacagcgggaggtgccgcagcgacgggaacgcgtagaacgccgccgccgccatgtgcacctgcagtatcaagaagttgtccctgcagaagcaaaccccaacacacagattattcagctggctgatcgatcgag

SEQ ID NO: 49691 - DNA, 4496 bp, Oryza sativa
ccgtgttttggatcgtcttctcatggagtcaggacaaccttcttttccccacttttgtgtagtacgcgtacatactatcggatagtagcaattaagttcgcgtttggcgtggtgtggcggatcgatgggcgacggcgtaaccaattctggctggatagtagccacgcgtaaccaacgctagctagctagatagtagtagccacgacgtctgccgcgtgcagggttcgttcaatcacctagcgaggaaattatcctaaactgatatcagctcgtcatttacatgtcacataaatagttataaaaaatattaatttatgatatattattccacaaaaaagtaacctaaaattcaacttttacatatcaaacgaaattccaaatacccgatacgctcattcagagagcgaatatgtgatatataattcgaaattagtcttgcatgtatgtttcatcacgaaacgtgcgcgtatgcttctctccttaaacattgtcggctctttttattttttattttttgggcagccatcaatggagatagagagatcgatggagatggcgcattcaatttgcaatctttaagacaaggcattgcggcattgcctgacgacgagaaattggaaacaaattcagaaaattaattaatgtatttcacgtacaaatcacactatgcatgtataagtcaaaattcctacgttctaaacgtacttggtcagttcattccagcagtttgtaagtcctaaggattggattattactgtgcattatctgctccacatacacccctgtcgtcctcctgtcgccagagttcacaggttgaggaaggaatcatagttgagaaagcctgtaggtttttcttcgtcggcgttcctgtgccaggaggcaggcaaaaaagtaaactttgctaagctatagattaatgacgcaggttatatgggttaggccctcttcgtttcttctgaagcacaagattaaattttggatactcgtgacatgcttttcaaactgctaaacggtacgtctcgtgcgaaaactttatatatgaaagttgctctaaaatatcatactaattcatttttcaagtttataacaattaaaactctattaatcacatgttattaatacatcgttttacgtgaaacacttaatttttatcttcatcttcatcttcatctttaagaggtggtgtttgaatctcctgaagatgaagatgaagataaacatagaggagcgagggttgtatatctatagtagaaatatattcatgaatgaagtctggagtcatcatcgaattaacggtataagcagacggcaggccgaagcagagaatgagacgaaaacgaaaaaaaaaacacgatgtaacctagtacatatagttttttgatgcatcaatccacaaaagaaggtttagtgaggagtagccctaagtgcacttgccctttacattcttctctcagtttttcttttgttttgcttcttaggtcttctcgccttaactcgacggtctaatgtcggatgcatgtaacttctttcaatcttaataaaatttggtcggtgtttcttccgccgaaccggcaaaaaaaaaagaaaaccacaaaagaagatatccctaatttatcgggcgcattatccgttctcgttcatccatctaaattaaagttgtaaagcggattttctttaaaaataagaataagagttaagcacaggagcggagttacactgtggtccatggaccaccatagaaatctagcccaaggcccatcacccctatgcgttacttctagaaaaatatcaatggcaagttggcaactgttttgcttcgttttttcgctgcaacaagcaccgcgtcctttcgtttccatcgcaattgtcattcccaattttcgatcgcgcgagtgaatgagtcagcgacgacaactaaggcagtgaggcacgaacgtgtgacggcggcagccgcgggcaggcaggaagcgcgcagcgccgcagcagaccagcggcatccagcatggagcaagcagtcagcagcactcatcgccagcaggcatgcagcaccacagcacaacacggcagtaggttctcaacttctcatctccccctgcagcccttgcttctctctttctcctctaaaggccctaacagtaggaattttcctttaggttcaaacgttcaatctcatttcaattttaggatatccgattggagttgggatggtaaattgaaaccttgcaatcctgtataatcccattgtagatttgctgaaaaatgaagaggggtggagatattacatctcttttttagaaataagcaacttttagacttatttattttaagatattagtaagacctctttaattatttgatgagaatatggttgttaaattttatctctgtgtgtacgtcggcatgttacatccatagtgttaaaaataataagtttacatctatagtgttaaaaataataggttgagttggacaaccccaccttgaaaatatagtgttaaaaataataagttgagttggaccaccccaccttgaaaacctggctacgccactagttaagcagatatcctatttctttttgttgagctcacaaattaaaattaatgcagcatttgcatttcattaggagatgaaaaggagagggattaattagtgcatggtgcattgtgtccctactgtagcccgtggagccatggtgaaagctgcgccacgccattctcatcaagcgatggattcacacacgccgctgcagtagcgtgctattttttttaacgattcgtacgaagttctacttatagagaaggaaaaaaattacaagattataacctaagagggtcgtaaccaggaaaaaagaagaaaataccaccacccacacaccgacagcgccaacacacaacccgggagaaggctagcactggatcggccgccgctaagcgtgaccgaccgccataagactaataaaggagcacagacgagatcgccccctaagggatgccaaaacgacgtcttcaagaaaagaagcgacagaaaaaccattgccgccgtccgtcggggctcaaaggagccaagattgggctttcgcccggcaaccacccttgaagggtgagacagcacggcaacgccctcaagaggggcatcgttgtcgggccagctaatgccgggctgggttttcacccgccgctcaccacctgtgattcaacggctgacgcaccgatgctccatcaccactcaagctctgccgacatgagggacccctgcacaggcgtcccccgccggccagtcttcgtgcgccgaagaccgcgccacacccatcggcagctcctcctcacaccgaggtcgcctcctccatcgccggctgcgcctctcatgccaagccggcctcctccaccggacgcgcccctcgcaccaatccggcctccctccctcggccgtgcctttcgtgccaagccggcctccatctccgccgcccgcgcctctcgcgccgagctggcctccgatgccatcggctgcgcctctctgcgccaagccggtctccaacccctccttcaaacgatgccgcgccgatcagatgcagccgtctgccacgccctcggctagccgttcgaggccgccatgccagtcaccgccaccgcagccccagctaccgaaaggccctgccgcctcgccgtcgccatcctcacttcctccgccgcagccacgtccatggtcgccacggccattgccacaagccgtccgccgtcgcagcctgtagtcaccggcacccgctgtcgctgcccgcgaggccactgcatcctccgccaccgtcgccagctgccgccgcagtaggcaacgccgcgagcacagccgccaccgccaccacgggccatagccgcggctgcctcaaccgctgccgtcggccatcgccgtcgactgccgccgccgtcaccacgacggcacctcatccccgctgccggcttaggagccgacctcccgcgccacccagccgtgcctcgccgcctcgtgccgcctcatcaccgcagccggctcgagagctggcctcccgcgccggggaggccggattcggacgagggtggccggatctggccaggggacgccaaatctggtgacgccgcgtcgctgtcgtcacccttgccgacaccgtctctgcccgttgttctggtcgtctccgcctcgccgtcgacgctgccgctctccccgttgccgccaccactgggagctagcccttcgcccagctccgtcgaggccgttggcaccccagatccaggtggggtcgtgggctccaaaccgcgtcctcgggggaagaaaggaggccccgccgccgccgtccttgcggccacgcagtttccagcggcccgctcgggtggcggcgaggcgaagaagggaaggaggcggggtggtagtgctgcggtggtggcggtcgccacccgtgtcgcccctgccctagcagcgacacgggggcaagaatccttaattgcagacattatgcatagaaaagtttt

SEQ ID NO: 49692 - DNA, 775 bp, Oryza sativa
ttgcttcagggtttcgtgcaccgttcagcaccccgccttcctcggctaggccttctgttgtgccccccacaggtacttaaaaaaacaacattacttcgacaatcaatttacatacattttatgtcttagcttacaagggtcctgttgtcgatgtgtaggtttcgcccagttcgctataacgcaggccgcccacttctcccaggctgcagggtcagcgtctcaggtagctgtgtcgacctcgcactcagcgcagttctggcagtacaccgggacttcgtcacaggcagccggcacgtcgagtcagggtccaccactggaccatgctgggacctcgtcggaccgcttgctgccttgcaccttgctcttcgacatcactgacttcgacttcgcttcaggctcgacagaggacgtcattggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcatgactactttctgccgcaccgatgcagcctcctttattcgcgtggggctgcagga

SEQ ID NO: 49693 - DNA, 2969 bp, Oryza sativa
acataaaatggcatccaatggttggacatgaaggatacggggcatagccgcatagggatacatatgccatctcaaattctgaaatgtacaggttgatgagctcattcgtgcacatcgaagaacgaaaaaaaactatagattagagttacgacttacgacttatgagtagaggcctcgtagtaatcctatgttacaaaaggatgaaaagctacgaacataatgtgcacaaatgatggcaagttcgcagccccaaaccccaaacggacaaaccaaggaaaccaaaggattcaggattcaggaaaccccaaccccgctgcagattcagtttccacgcgagagagagaggccccagctaaccacacgcaactgcttggcgggagagcgagaggggagggggtccgaaccggaggggagcgccgcggctgcagggaagcgtcggggaggcggagcccagccggggcccggggccaccgccatctcgtcggcgcggtggccgcggtggttgagcggtggcggcggggcgtcgacgagcggagaactcggcgtcggaggtggggagttgcaaatgggccgggccttcgcgtgcacatccgagacttgaaaatctctcggccttaaaagacagcccatgtgagccaaatgctaattggtacggcgcgtacgctgccaaaagcccaaagcccatacggagtacgtgtgtttctttcttttcttttctttttttcttttttagcgcagccacgtttcctttttatttttttccttttttcatctcaacttttgaaaactttcaactgaaatttgaaactttcaattcagttttgaaaactttcaacttaaaatttgaaaactttcagctcgaaatttgaaatttttgaagtcaaattttgaaaactttcaactttccatctcaacttttaaaaacttttaactaaaatttaaaactttcaactcagatttgaaaactttcaacttctcatctcaacttttaaacactttcaactcaaatttgaaaactttcaactcaaaatacaaaaacttctaactcggatttgaaaattttcaaatcgatatttttggaaaactttcaaatcgtattttgaaaatttacaaaatcaattgtttttatttttaattgggaaattactgtagcattctcactaatctaccctataattcaccaactacactcttacaaacctcattcatcaaatccgatggtcaagaatgatcgaatccaatggttcgagatcgtcgtggaccctctcccttccgcacgcgcttggcacccacacctgctgcattcctcctctccccttccctcacgtgtgtcccctaatcacgccgagaaccccgtctctgccctcctctctctcgcactcacccagctccgccgatgctgcaccctcacgccgccgacgctccgccatcgcgacgccgcctcgccacccgcgacgccgcctcgcccctcatgccaaccgccgccgaccggcgccgccaccagcatcgccgattctccatcgcgccctatcgtggcctgcatcgccgatctaccccgaccggtgccgccgcccgcatcacccatctactccgtgcctccacgtcaacctccatcgcctccccgggctcgagaccgtcgccatcatcgggaagaccaatggcgccaacctcttcgcctgggatgaccgccggggcctccttgctgtcggctgctggaagcgcctgaccatcttccgccttgacaatgagaattcagctccgcattgcctattctttctcggttgtgatttgagtgtttatggctatggtttgactgttacatcatttgggtttcggtggaaattgagatggcctgttggtagtgctcaatttggagaatgggaagtatgatacgggggattatctaattaggttgaaatagatattcagtggaaattaaatcaaacactggaagagttgcttccaatcctcactgttctgttgttcttcttgataatagctgcttctagattcttgcctgatgcttgcttggttgggttttgtaaaggattaatgcctggttgtcgtgcattgtatccggcaggagtgccccaggtcagagctacttgttagtagaataattgaattcttcatgctgataattttcaggtgcttttagccacctgtagcaaatgttgactgcatgataaaaaaaactaaactttgtttacttgtgaattgttgcattacggtgatctacaaaaatctaccttttcattttatgtttgaactagcggtgtcgattttggttaaactttgacacctgaaggatcttagcttgaagataaatgtgcatctgctgttttagatgcacttggttctgtttagggaagattaactgtgattctttagttactgattattagtctttacagtctagcgtgtgaaaccgtgaatgccacttctgcgtctcattcacttgtgttcaggttttagcaaacataattcagattggtctgtttggcatagcatatgaatgattattgaagctaccagtagttgaataatactttgaccataagtagcacctcgaatattttatatgcaggattatcagtacttgtttgtgtttgttgcaccgtcttttatttttgtagccattgtctcatgatgaagcaagatcattatttgcgtttgttgcaccgtatgtcaatgaagccaaggagaccaagagcagtagttctctacctcaaaaggtagctgaatctgaaatagaattttgccttttcatttatgttatatattttcctttctgtattgagcttggagatctcaacatgatttaggatttatacatgttgattggtgaatgttagcacttatatacatgttctatttttttttcttaaagataattgcttttttttgtatttcgttgtttcctaagatgtaccaacatttcttaaagacgatttcctcacggacttgct

SEQ ID NO: 49694 - DNA, 709 bp, Oryza sativa
cgggatggggatgcgccccatcgtcttcgtcgcctaccgccaggggatcgccgccgccacgctcctcctcgcctcgctcgccgccagggggtgggacctccgccgccacatggccgtcggcgccccggcgttcgccctcctcttcgccgcctccctcgccaggtacacgaaacttacttcgtggctgattttggtacgcacacccttggatcgaatcgggcgcaggccgctcatctcccggttgattttggtcggcagcgcgacgggtctgtacttctacttcctggggctgcagctcgcgtcgccgtccatggccagggccaccaccaacctcgcccccggcattaccttcgccatcgccgccgtaatcgggtaccacttcttcatcgtccccatctccggcggcgacggcgccgccccctagtccggttgccgatttctccccctttcttgggctggattgccacgtgtcaccatgacatgtggcccactacgacggcccagttgaagttttgggctggatcgtttgaggcccattatttaagcgattctgaagggttttaatcgttcaaattgcatccgtgcgcgcgcaggttggagaaggtggatttgaggagttcgaggagcttggccaagatcgccggcaccgtcgtctgcctcgccggagcgatggccatggcgttcttcaaggggcccaagctactcggcg

SEQ ID NO: 49695 - DNA, 769 bp, Oryza sativa
atggcgccattgctacgggacaccgacaccttcaagttgccattgccgccgggcatgtcggcccctcgcgcgacgccgttgccgaacgcgtccctgagagcgaccgacacggacgccttcgatccggcgacgcacgcgccggagtaggtccaggaggccagcgacgccgacgggtgcacgccggcggcggcgaccgcgaactcgagcgtcgactcggcgacgccgaaccgctcctcgccgacgagcacgacgaagtcgccggcgcgcagcggcacgaacgtgatgttccaggcggccggctcgccggcgtggtgcgccgcgacgtcggcgatgtaggtgctgttgccccgcctgccgttcaccgtcgccgtgaacgacagcgaccgccgcgcctcgtccccgggcgggaggtcgagcggcgtgatcttgatcaccgcggtgtcgccggcgacgaacgacgacctgtagtcgagccaactgaacgcgaacgacggcggcatcggctgctgcgcccgcgccatcgacgcgcgccgtgctgctgcgacgacgcagaggaggagaagccagagaggaggcaaggacgagcgcggcgagcccatggcggccggcgttcttggccggtgtggaaggacgtggagggctgcagggtggatgaactccgacgacggtgttactgatcgcaagtttctgcaactacatccccttacaaagaagttttggcaactgcaaggcggcaatcggcctgcaagtttttgcaagggctgcagga

SEQ ID NO: 49696 - DNA, 772 bp, Oryza sativa
ttcctgcagcccatactgaatttttaaagaaatttaagaatgattccatttacaacccagttacagttagatgtacagtagttacatctgtacttttgttatttctcactgtaactgactatagatagatagctctttatatatttgtaacataatttagagtttgttataattggggaaatgttttaatgtcgcagtataagtactgaattttttaagaaatttaagaatgattccatttacagcccagttacagtttagatgtactatagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgcttttttctaacctttattggatgtgaagttatcattatgggccatgatgt

SEQ ID NO: 49697 - DNA, 703 bp, Oryza sativa
ccaaatgcatctcgtcgtaaacgaaaatatggggactaaatgccaagagcttcaacaatgcgaaaatataaatgctttctcatgcgaaatctcctacggaactgattatcggtatataaaggattggtagaaaaatatttagcaaacaatctgttgtggtcttctgcatgatctctattgatgtacctccagttgtagcctctacgtcgattagaagtaccagcttcttgtgcttgcatttgagcttgaagttcagcttcaatttgagcttccatctcagcttcaatctcagcctccataggatcattgatttcttcccacatcaacccttcaagattgtcactagagctagaatcatctgactgactagattggtttggtgactcgctggacttttgtttgaaagtgggaggaaagctgttgggatgaagttgaaggaaatgaggatgactggtcctgctgaaccacatcacctatttgtagatgatacattccaatggctagattccaacaactagtttatttagtttacaacagctctattttgcttttgcttttatcagtgctccaacagctagctcttgctttttgtcaggttttcaatagatatgtatgcttttggcagtgttccaccatctatcttttgcttttgtcaggtttacaataggcacagtacaagtgatgtaaaataagcagatttggg

SEQ ID NO: 49698 - DNA, 22049 bp, Oryza sativa
  unsure (1)..(22049): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctgagagagagtaaaacaacaagaacagatatatcaagctcttcagtgaaaatggaaacagaagaactacaataatcaaccctaatcatgacaattccattgataaaaagtaaaacatcgttcttttgcagaaacatccattctcaagttccctcttttatgatcttccccttgtgctatgtcggcaaacaagagaaacaaactaaattaaagtcttttgtttcctgtaacttttgggtagtttcagaataagatacatagctattcttctcttgagcttgaagatgaaagattccatgccagaactttcttgaccaactaattaatctggactttggtttcattccattccttattccatatgagtacagtagtacactagtactggtctcctttcctgaaaaaaaaagaggagattcagaagttcagaacaataggcaaacaaatctccaatctgtggttgacacgtcactccttcctcatggagtcaatgggggtgagcatcagcaagtcatgtgtgctgcatgttgtaggtagccttgaaggaaagcagttggattggatctcattttagtttagggcaggaatgcataagcccatttgttgtgtcatttattaagtttatactacatttcaacatatagttaatgcaaggttggagttgaaacaaactgtctccttgatcctaattcctgaaacatgtatgagattttgctcatggcatatgcccatcaggagtagtgcaccacatttacatacatagtacatgtggatgcaactcaatggaattttttttttttgatatttggattcatttgtgacccgaaaaattttacgcatattttcaatcatgttcaaattcttcagtaccatctgagtgtagattttacctgtaataattaatcagaaaaaaacctacaaaattttgcagtccttacatgtcttgattaaaaaaaacataaaacatttttgcgttggcatggatcgtatgtattgcccatttgagggttgagaccaagaaagtttcagcatcgatacactttaaattccatgttggattcttgaagcagtccattagcacaaacaggcttgtcattagtggaaacttatgtcacatgaactagtaaaactatagatccaatcatacttccatgcaaacaatgacccaatagaactcagcaaagtacagattatacaatcccaacatgaagcaactgcaactttcattcctcgaatcacagatggctgacacgactcagttatagtgcagagcacagtacaacttataatggtataacagtagagtaagatgtttcaagcaatttgtccatgcaaatcgtttattcatagtactcagttcatatagctctggtgacacccaattcagactgattgtcttagttctgtggcaccgaaattatatgtttttcgatcatatccttcatgctccagttagtgtaattattattattattataataatattattcttgtagctccagaaagcccaaccaaatgaggcctgaccatagacgtccatctgcacatcagcaaaattcgtgcggtcatcgtcgtttgcaccttgcaccccccattccgtagtccattcccctgcacatttggaaagacttcttcccactgtgtcgtcacaaaacagcctgtccagcttcaccaaggttggtcgctgttgctcattgctccaaatatatcttcttccaaataaatacatctcctttcttgctgcgaagtattcattaatcagcgattgtttctagcattgttcttgtctacagctgaggcaattaaattgaaatcccctgtaatcatccatttcccaggtcaagcttcccggattgttgtcatttcttccgggaaaagcagcttctcatcatctccttgcggcccatacactgaagataagtaccagttggactgtcacagaccaaatcccagcgtgcaccaagtccccatggaaaatatcacctttccaagcgattattaacaccccccccccccccccggcaaccccacccccaacgtgcatgcatcacggcgaaagagtctaaactagggccacaatgcttatagatcagcgaagcatctaacttaattagactcttaaaaacaaacaacagacgcaaactgaaattttgaaatacatctacttctgcagcatcttgttttatgtttctttcatttctggagaagttgtaacaagtgatgatgacatcctgtgtttcaggtgcgccactctgccctcttcagcatctactctaggtataatttgatgaggttctggatcgagtatcaatgaataaggcatttcttctttcaaaaaaaaaaaggcatttttgggcgatgaatgcttctctcggcaggatgaataggcttctcccacatgagtagatgcagctggaaggagcacaatgggtatcggctcaaggaaagcttttggctgatcgagagagtgtcaaagcagcggattgcccctgaactagagatcatccagggcaggaccttctcattggacacccttgagatgaccagcaatttcgatgcctctcttgcccggttgaacagattgtgcatccctgaccgtgttgacggtgtctcgctgtcattgtcatcttgcaacactgaagatatgtagataaaaccctgaaagaaacattgtgtcatggaatgtttgatgtataactcttttgttcttaattgatgaagcataatattgtcgatattctggaagtggcgacagaaagcttacctcctcagtacggctgattgcaaatcctagttttgtgtcacctactttaggagtgatctccagtggcatttctcctcctatggagctgtaccaaagtcgggctgccttcaccacctcagtgttatagccttggtaatcctccaacgttgcatttgacagatcaggcaacaaccctgaattgacagttgcagatgtggcgtctccaactctcgatatctgtacattatggagagtgaagattaaaaccatgtagaatcaaaccaagtcgaatcttgtgtgagattatgtgtccatgtgtaatgcatgaaattgaaatcttgtatctgcaccttggtgagaagatcatcactctgcacactcatcaacttgatggggacaccagaggcctgcgaggcatagagccatgtgttggcacgagccaaggtgacctcgaaggactcgtatagatgtgacttcatgtccaacgccatgggtaggacaagcattgagaggtagcagctagaatcaggcatgtgcaccgagtcttgcatattccccttcatggcatatgagatgtatgcatcttctgcctttcttggtgctgttgcaagtcttgtgcctccatggattgataaggcacctattttgcataggaaggtcataaaaatttctcaataaagtggattaaaatgttccaaattcatagtacatgaaatttcagtcaagaattgttcagaagagttgaatttgttaggaaaacatgcatgtgttcattttaagatgacagtaattgcaacatgacacatatcaccacatttgctcgcgaaacagccaacacattgtttaaataaccagaagcactgctaaagtaacaaccacacgagctaggtcaatcttttccagtggcatcattgacatcttggcttgacccccaaccagccagagtgctcgtgattgatgttaattgtcaatcatggtggtcgtaaatgtagctagatcaaagacccacaaatgttccaaggcagaccaaatcaccaaatcagacaacagaggcataacacatgcactagtgagtgactttgcaattcttactgggcgtttttttagtattaatctgtggtacctcctggtacctcaacactatggacataccaagaggtaccttctttttttttttcaccaaaagaggtactacctccatcccataaaaattgaatttctagggaattaaggatatattagcaggatagacaaatgactacagtaaccctatttaataaacacaatacatgcacacattccatatataaacttgattaaaaggaatgttgagacaatgggttagagatgggatggaaggaaagaagattacaaggaaatgtaatcagtttaatgggtcccacatcagtagaaatataacttttatgggacaaaggttcaaaggtaaaatttcaatttttatgggacggaggtagtactaaattttatactacagaatgtgtcaatgtggtacctctcggtagcaccttgaggctaaaaaggttctactttacacgagtacttccccaacgacaatatcaaaaaaagatatatggcatacatgttcaactcaagttggagcatggaaaagaaatgttagaataggtatcaaatataccagtcctattggagttgaaataggtggtagggggtagagttagagtcggactctgtaacccagcaactctcttaaatagggggaggcaccacaatgtaatcatggcgactacaatgtagcgtagacacgcagggagatgatcacggcgtggccatggactcgtagcggttaggagctatattggttagggaggagcgcctataatcagagcccggggatgtaggcttcggctgaacctcgttaacaaataccatgtgttcctgtgtcgtcatctggcatgtcttgggcgatcaatgactgaagcgatcgggaaggttagtcgtcgttccgctatattgactaacttttataacaagtagtatcagagcagaaggtttcagtattggatcaagaagacatgtggaggaggaaacacgaggtggggatcacgcatcagcaggagattgtcagctgtgacgatgagatcgatggcgacaacgaggacgtcgcggaggcgatgaccttgctcgcgatcagaccggcgatggcggaacgtgaccggaagacggggccgggcgtggccaaaggcgaccggagagatcggaggggtagcgtcatggacggcacgcctgacgcacgcggtggtcgtggatccgcagcggcaaggaggctagcggcgaaagggcaaaaccgacgagcgtggcgcagcgcggcagacgtgcagggccgatggcgacaaggtcgtggacagtgaacacgagggctgcgactgcggtgcgtgcggaggcatggacgaatagtacgaggtattgttctttgcgtacaacttggatggagtcgagcacatcgcatggaaatgccttcatgcgacacgatgtacacaaaatcatcatggctgcatgcactaataaagagtggcctgtgcaaggtgatcatgacatgttgtcaagcacatgcatatactacattgctgagattaaagcatgggaggctagatgaggacgttgaggcacatgggtgtatttttgcatgagcatgatgcggcagggtttttgctaggaggaagaggtacgtgagcaagggaaagcagaagagacccaagcagacacgactgttgagttggtttctgtttatgcggtcattagaaccaaaggtgtgtacttgaattgagttagactcggttgttggaacagaatccgacgggaacttgggctcggtaaagcagaacctaggaagattcgatgcagcagaactatcttaaatagagaggggagcaccacaacgtaaccatggcgactacaatgcagcgtagacacgcagggagatgatggcggcgtggccatggactcgtagcggttaggagctacttcctccgtttcacaatgtaagtcattctagcatttcccacattcatattaatgttaatgaatctagatagatatatgtctagattcattaacatcaatatcaatgtgggaaatgctagattgacttacattgtgaaacggagggagtatattggttggggaggagcgtccataatcaaagccccggggatgtaggcttcggctgaacctcgttaacaaatatcgtgtgttcctatgtcgtcatctggtatgtcttgggcgatcaatgactgaagcgatcgggaaggttagtcgtcgttccgctatatcgactaactttttttaacaagaaatgctttaactcaattgctggtttcatttcttctgtgaaaactaacttgcctaaattgtgcaaatacaagtgatttcaggcaatgtttgatgctctattcggagtgcaagagtttgcaataattttgtcaagctaacaggcaatgagtcaaaatcgatcatatcgtttcctatggaaaacatatgctgcagatcaatttgccctttaaaacgagttatggcaacatgaaggggaaagaaattgtgtgacttttacacacttattggatttgtacaatgaagaaataaaacaagatgcaaaaattagtttgaagggtggcattcctaccagaaaaaatgatcatgatcaattgtaaattggtgtggtgcaaattgagctagttttgttgataatttggcaagtggtcaaactaaattcccaagaaggtaattaaactaagaactattttggtttctaaacttccttattagtaaacacaatgactacatgcctaatggcagaggctggagatgtactccatttcagttatctaaaaaactttgttatcagtgccaagtttttgcaggaaagtttcttggacaaaagtgttaactattaaaaacaatatgagtaacaaatttatccatgcggtgacacaagatacactgctaatttccattaaaaattttgtacattcaatttctagttaaattagtgcgaaattgttgagatcttttctcccttggtaaagagaggaatttcactatgaggcagacgtaccattcaaatttgacacatccataccttttaaaaaagtcatttgattagaatagctacatctctcattttctgtaagaagctataattcattggtcgtcagctttttatcaaatgtttaggggggagtaaaataaatggtttcatagttggggaatgttttttttcttattccagaaagactctaggagtaaacgaagtcagtttcatgatcgtggttgtccatgatcagtagagacacagaaatgaattttgaatgtataattgagcaggccactctactagtttatgtacaaaatgctaatgtttctgcatatgaatacaacattgacagccagaatcagttagaagcaacggactaagaaatgcaagaagattacctagaaacttcagatgccacggatacattgatgatacagacctgacaacagcaaccatttcaccacagtaaagttagggttgaacacgtaggaatgcataggaagtcatgtagaagatcgaaggtgaagcaaaagtggattatatctttttatatggtttcctcaaaaaaaaaatcttttagatggaatgcacatacctgatatcagattgtttgtacttatctgggtcttttggtgcatactcatcatgttctaaaatcccatgttcttgctcccgtggcagaggcacaatacttccaacttgtttgttcgcatcacttgactctttatcttgagtttgatgatattcatcgaagttggcgctcatgatagcattttgttcttcctcagacccatgatctttctcttttgtcactctatcaccataaaaaatcttatccaccaactgtacgttgattctaggattgcttgggtgattgctaacagcagatgtcaatgcagactctgcgtcgacacttgcaccatgaatttttactgagatttctttgaggcctaacaagtgtccaatcctgataggtgcagtaccatatagatccccaagggcactgaaacctaacttgagcttcctgagattaggcattgcccctgcctcaaatttcagccaaggtacactacaattatacttgaagtacttgagaactgagaatcctaccttatcaaagaaaatgttttctacagatgctctgtgcacattcaaagatagagccatgagggcaggcaatcccctgagaatatcaacactgttctttacaagctcccttactgcaatctttaaaatgcataggttgccaagttctccaatccacttaggaactctgtaaaagatgcagctgtgcagcaaccactcaaatctctggagaagaggtggaggtgccaaattatcccacaaaatagttacttctgaggctcctgaagccgcaattttcttttgagaggaagaagaaactagagttagatttttcagattaccaagtcttccaagcaaagagcccaaaatttccatgtttctctctagatgtttggaaggcagtgcacagaaggtgagatgaatatcccgtacgttgttcagattgctaatgatgcccccactgggtgatgagttactactgcttgatcctagttcgctgggaggtgtcatgtggcccatcaaatcaatcagattcatatcaaaacgaagatggaggtgtaacaagcacgggagaaagataatatcccaaggaacagcagtgagtgttgtatccatctgcaacgtttctaaatattttagccctcgcatttggcttggtagttctgtgcgaatatcgcatgcaatcttcaaatatctcagttgaaatagttcagaaatcccactgaggtctaagagttcatcaccaacatgaccagataattgaaggtttagaacacgaagaagcttaaactctgtaagagaaggcatccacttacataatccaaaaaatgtaagtgatcgaacttctgatgttctgatgtttgttggtatttttgcatactttatgtcaccaaagtggacagaaagtcgacgaactttatcagaaagttccacatccttccggtaaaaatctaataccagaacaaagttctcctttacagacttgtatgcaataagatctcgtacctcatcatgaattgtacaagttgacacctcattgttgtagttgagtctgctaggttggaggaatcttctgtcaataagttcatcgaaatagctccctgcaactttctccaagtctcggccctctatttgatcaataaaaccttcagccacccatttttccacaacatcatccttgcatattttataaccctctggatacatattaagatatagcaagcatgtcttcaagtaatgaggaagattattgtagctgaggtttaatacttgccgcgttccttctatagaagaatttgtcctaaaagcagagcttaaagaattacgtatgtataaacatagatccattaagatgacaggctgacttgctaaaaggctagctaggctgattgttgctaaaggcaaaccaccacatatttgaacaattttgtttgaaacttctttgaattgttgagggcaatcacttacaaaaccaaaaaatctctgaagaaacaacgttgttgagtgctcatcatccatgggtttcatctcaaaaatatattcggtgtcataacagcaacatgttaatgcaagatcttcaacctgtgtaattattactatcctgctgctcagaattacctctggaaaagcttgattgataagatcccatacggaggcagcccataagtcatcaataataattaaatacctggcaatattttatgcatattagatacattttttcagctaatatagtaacattcatgagaaatatataaatcgaataagtaaataaatgaggaagcaagttttacaggaagagatgtaatggaaaagatgttcaaattttgacccttcctataaatgttgggttcactatagagtccaaactgttatgcaatagtgtctgtctacgtattgcttgacggtatatgcaatagaattcaaatgggccagctaaagtggccaaattggcttattatcaaaaaccacatccccattaacatagctgtaggtatggcccttgagaatatgtatccccaataatcaatggtcaacggtcattctattgagcagttttgcaagaatcattaaaaatagtaccatcattaaacagaataaataagagtggataactagtgtatgcacccctgtgagtaattgaatgaaaataaagaactcgatttcggaatgtacattagtttcagtttggataatctatatataagcataggattatatacttcaaacaaattagaatctcaagatggggaaatcattgcaattatcatagggaagtctagagacttagaccatatcctatttattctctagattattttgcttagtactccttccgtttcatattataagtcgtttgattttttttctagtcaaactttgttgagtttgaccaagtttataaaaaaattagcaatatctaaaatatcaaattagtttcattaaatctaacatgtaatatattttgataatatgcttgttttgtgttgataatcctaatatatttttctataaaattggtcaaacttaaagaagtttgactaggaaaaaagtcaaacgacttataatatgaaacggagggagtactatctatgtacagaattgatgcatggactattggcaaccaaaggatctgatgcattttgtgatggattggtttctttggcatgttccaagttctagcactgatataaaaatggacacaagaggcactacttagtaaagtataccttctatcttgaagatactccctgatgctgtcaataagcgcaagctccttataatcgtcaggtggctgcttccgctggagttgaaagaacatctcgcggaaaaccctcttcatatcaggcttccgggagatccggacgaaagctcgacagtcaaattgtcccccaattctgttgtacaacagtttggcaagtgtggtcttaccaatacctgaagatccaacaacagacaccaccttgagcttctgatcctcatcattggcgagccgctcgatgaactcgctcacccggccatcaatcactagctgggcatcttcttccccatacggcctagatggcaacatagggccaaatgacacatatctccgcctgtggtcgcagcaatccagaccatacctcccatgccgctcaatggcctcctcaacataaatcctgaactgcgacaccatcttccccatctgctggtgcctcttgagcctcttgggaagacgagcaaccttgacacggccgattctgcagacgaatctggccatggtgttcgcgcggcggccaggccgcggcgctgcgcagaactcgtcgatgtagtcctcgatgtcgtaggacagctcgcgcacctctctcatccagcgcttggccgtcgggggagggtcctccagctccgacagatcggcgaggtacgcggcgaccactccaaggtcgcctcccaggaggagcatccgatccttcacccccttgggtagcctgctgccatcgggagccacaagcagctcctccatcttcccaagaagggatcccatggctccctgtgaagcacaaatcggggcggcgaggggcggggcctccatccctgaggacggagatcgaatcaaccatggagtacagattgaagaactgggaaaatggggagaacgatgatggatatactcaccgagctgcttgtatcaagcaatatagagaaaagcaaattggatgagattcatcctggacggtatcgagaaaatcgcagcccaatgaagatacgaacccagctatcggaacttggaagttggaagagcactggtgaaggccgcagagaccaaagacggatcggcgcaagacacagcaagagcttttcgttcccgagggacatgatcatctaccttatcagcatgttttgacccagtacaatgggtcaacgtctattactttcaatataagacgctttgatatttttttaattaacttttttttcaaaatttgatcaagtgtatataaaattttaatgatatctatgacaagaaattagttcaattaaatataaactaatgtatatattgcttggtctttttttgacagagcgagtaggagagatagcaagataaccacagtcagatcgccagatcaatactacactcagcggatacaatacctaaacaagagtaggatattacctctcattgagagagtatgaacatgtctaaatccttatctccgcatccatacacttttaggtatcgagggctaccccttttattattgccgatttctagaatcaacagttggcgcaccaactaggggttgcgccgagtttcctgtcgacaagtgcgacggagccaatcatcgacgtcgttggattcaatttcgccctagggcgaaccttccactttgggagcttcgacttctttgccggcgacttaggcgagcttcccctctctaactcggattctgttactgcaaaatacgacagcccgggagatttgcttaactccagtgcaggtacaagacttgtctcaagtgtcaagagcgtgctagctgatttgatcctacaactagcaatgaaacaacaaatatagttagatgaacgatagccgatcgaccgataagccgatgtcgtatcgttagggtttagccgatgcagttaaaccaaattggctcaatctttatgatgaactgaacaaagcaaaccctaaatatgtcccatcggctataataccatctatcttgtttttatcaatcacgtttcagattgtatggtataagtcacctcttgttgagagatcgcaaccgatgccccgacttgaagcaagaactcgtcgaaaaacttaaaagaaaaaagggggcaatgcgccgaaagttgtattgattggatgttcgtccctttttacatgatcttgggtttatatttatacccaaattacaaaacctgtccattatagacacgactcaaactttcctaaagacaaaaggaaaaacaaaaagactcaaatttaggagataaaaggaaaaaaacaaaaaaaaagtccatatggcggactcttaccatatctctaattcaagccggtatcaatatcctaattaatagatataattgcgttaaatggactctatctctatacggcaatacatcagctatcttaatctaggcccaaaccgagcccaagtgaaaccgtatcggctgtcttcccatatcggctcatttgaatccgactctgcttccagccgatgcgctctctatctcaaatctgctttgattttcctcttcatctctgaatctgatgctaattttcgtggttaacaaattcaaactagtcaggaaggctcacgatcacttcaatcttgtttggtttcccgtatgtcatgaggacttgctccaagctcgttctctccaactcggattcaatccagttatggagatcaatcttggcgagttcgaatatttaatttccgatattcctgggtttttttcccttccactttatcattgttcattagattgatttctaatcaccgattaatcacatgtgatgttgcggcattattgctgtcgacaagtggcttcacctccatggttggtggactccgccgccatgggagtcttcgtcttaaccgccggccgccttcacctccgccaactagtgtttttgccttcatggctagcttataatgccaccgactagtgatcttgccttcacggctggcctattaagttgccgttgatgggcgtcttcgtcttcacagccgaccgccttcgcctccgccgactagtatcttcgcttttactactgccctattctgtcgccgactagtaatctcaccttcatggctggcctattacgttgccgttgatgggcatctttgtcttcaccgccagctaccttcgtcgctgcagactggtgtctttaccttcacgattggcctattatgcccccgctgatgggtgtcttcatcttcactgccgtccactgctgactggtgcctttgcctctgtggctgcatgatttcatcgttgctatgcgtcttcatcttcaccgcccgcctcctttgccgccaccgactagtgacctcgccttcacggctggcatattacgttgttgctgatgggcttcttcgtataaaccaccggccgcctttgcctccgctgactggagtcttcgctttcaggtcctctcgatcatctgccgttgatttgcatcctcgcctccacggttggtggactgcgccaccgccgttgatgggcaacctcgtcttcactgtcggtcgcctctaccaccatcaattggtcttctcgcctccatggttttgcgactttgccgtcattgcttgataactttatctttgccgccggccgccacaactgcttctacggttggtgtcttgaacctgtctaaattattgtcttcacatccatcaacttttagtctcatgtgctatccccttttattattatcgatttcctgaatcgagggtgcgtttggtgggaaaattataaagagggaatggaattttgagatgcggttgggggaattgaggagtgaccccttgctttttaatacctgctttggggtgggagttgggagactatctcagcccttgatcatcacaaaaaatctagacccatcgaatctctttagaaattctaggcattcctagcaaacaagggatcgagactagggtcctatttaatttgtaatcaaaacattcgaatttttgagaatttcaatccagcagagaaaaatatattatgaaggcatttgatacaaaatatttaaacttttatggattggataatcgtattgagattttgaaggatagttagtatgagctccaacctgcctaattaaataccatccctataagtttttcctgtgttctgtaaccttatattttttttaaaatcctatggtttttcatgtgttttataacattgtattttgcacttgtatttctcttaaaatcctatgtttttctattaattcgtttttttttccaatcccactttttaaaggagaataaaagaaaaaaaaatcttgcctacgaccaaggtgttgagacttgagcgttctgtctgttgcccgttgacgagcttaggaattaggattaaggtgtcaagagtcaactctagcaggcatggtttcctagagagaggtcttcgttgctgcctatcgttcttgtgtgtcctaaaaaattcgagtggagagggaagaaccagtagcgctagcgcaagcagattgtggttggcggccatggagaccgcggtgctgagcgccgtgctcagaacgctggggccgaagctctacgcgttcctccgtgacgggcacgacctgttgcggcgggacctggagcgcgacgtccactacatccggaacgagctcgccatgatcgccgccgcgatcgaggagcacgaccgccgcccgccgcccgccgcaggcgacgtgcggagcgcctggatccgcggcgtgcgcgacctggcctgcgacatggaggactgcgtcgaccgcttcgtgcaccgcgccaccggccacggcctggcctccatgggcgcccgcgccaagttcgccgccgtgatccaggagctcaggaggaaatccgaggagctgtcccgcctcagagccagttacgccgccgccgccggcgagcccagctgctgggtggctacaggatcatccgcgttgaccctgccggcgtcgtcgtctgaggcgcacacccttgcatctgacatgtggggatggacgggccccgggacgagattcttgagctgataggggaaaccagggccagctcaaggtgatctccattgttgggtttggtgggttagggaagacgcttcttgccaggcaaatctacgagagcgacgccgtcgccgcgcaattccatccacggatttgggttcgtgccgcggggaagaacgcagaggatgtcctcatggacattctccagcagctggggatgccggtacatcactgccatgccagcaatctcgttgtaaatctcagaaattgccttgaatccaagaggtaagaaaccaaccactgacatgttcaactgttgttactgtttgttaccaaatcaatctctgttgtgtgtccttcatcctacaccttttgcggcctctgaaagcaattgcttccaagaactacgagggattgaggagcactagagttgtttttcttgatttgttttatactcaacttaaacgaagtatcagaaggtacaacgtattttagtactaatctacatttcagtcatacagagtaaggtgagtacaaaaagttagccctcaagtgcagaaagaatcacatgtatgcggtatccctcaagttcagtttcgccttaatccgtgtgatagaaagccagaataggagtaaacaaaagatgtatgaattgctgtgtgcatgcattaacagttctgatttccctgtatatgcatcacgcatgtagatctggtcaccttattgatgtagtttttcagaaaactgtcctttgactctgcaccaagtgacccattctgaatgcttattttcaggttctttgttgtaattgacgacatgcagagggaatattggaacagctctttcagaaatgcctttccttctgatacgggactgagcagcattgtgatcgtaacgacggccatccagtccatagcaaatgcctgcagctctcgcaacagccatgtgtacgtgatgagaaccctgaatgaggaacactcaagacagctattcttgaaagaagcatcatggaaagattacccaccaggttcagaagcaatcctgaagaaatgtgatggtctgccgcttgctctcgtcacaacagcccaattcttgcaaagcagatgtcagcagcagcctctgggatgcgcaaagctgtgcgacaacctgggtaagcatcttgtgacagaagacaccttagcaagaatgaagcgtgtgcttgttcaccattacagcagcctccctggccatgtcatcaaggcctgcttgctctacctgggaattttccccagtggtcatcctgtcaggagaaaaactctgataaggagatggtcagctgaaggattcgtgggagcagaccatcaccggagctctctagatgtcgccatcgacagcttcgaggagctcgttaaccggagcatcatccagcctgttgatgtgagcagcaacactgaggtgaagacctgccaaactcacggtatgatgcttgagttcatcctgcacaaatccatatgtgacaacttcatcacatttctgtacggtcaggctcgcctgcctgacaagatccgttgcgtttccatacaacagaacagtggtagtaagaccagagtggattcagacattgatctgtcccttgtccggtctctgacgatcttcggaaaagcgcacaagtctttcctgaatttctccaggtataaacttctccgggttttggatctcgaagagtgtgatgaattggaggacgagcatctgaagaagatatgcaagcggttgcttctcaagtacctaagcctcggccgtggaattacagtgcttccaaaggagatcgcaaagctgaaatttcttgagacgctcgatttacggcgaacggtgattaagtttcttcccatacaagtgctcgagctgccatgtctgattcatctgtttggagtgttcaagatccaagatgctgaccagcaaatgaggaagctcaaatccttcctgacggagaaaagcaagttggagacactggccggatttgtcaccgataggtgccaaacatttcctcagctcatgaaacatatgaccaacttggcaaaggtgaaaatatggtgcgagaacaccgcagatgccagcagcagcagcaactctgatgttcacctgtcagaggccattcaggagttcatccagagaggcacagatgtgaacgatgtccgatcactctctctcgatgtcggcgaatgctcccaagaatttctcaacttctctttaggagattcatgctacctaagctccctgaagctgaaaggaaacaagatatgcaggttgccaccgttcgtcacctcgctggccgttctcactgatctgtgcctctcatcctctgatcgcctcagctctgatgttcttgcggccctgagcaacgtccgcgcgctgcgttacctgaagctgatcgcgcgtcacctggacaggttcgtgatcgaacgcggcgatctgcagagcctgcgacgcctgcacatcgtggtggtgtccatgacgacgatgagcaagcagcagccagagatccaggagggagccctgccgaatctggagtcgttccatctcctctgcaaggatctggatggcccctgcggccatggaggcatcaggatcgactccctcgggctcgggtgcctcagggagattgttcttgacgacggagttcgtgagacggcgaaggagcagtggaaggacgcggcgaggcggcacccgaagcggcccaaggtggtgttcgtcggagcgggagacgtcgtcgatcggcggcgggtgggtgctgctgctgctgccgcgcctgcagcaggagagagcaattctgcgatggcaccggcggcggtggcttcggtggtggccgccggcgacgtcaagaggccggctagggaggaatccgatatctccgccgcgctggcgagccttccggcgaagatggcgaggctgctcggcgctgcgagcatccaccagagtagtgggactcagggcgagctgtcctgcggcgggaacggagcatcacagcgccatttcagctagacagagatacagagagcatagcgtggtaacgggtaactatctctgttacctctgttccatattacatgtcgtttttagttatattctaagttgaacttgtatagttttgatcgagttacatataaaagtaaatactactccactataagagcaggtacaatagcaaattataagctagctatacacatattttaagaagataaaataggggagagaaaagcagtcggctacatatttgtagccagctatagtatggactctgagacacattgtgtgtgtatgatagatgagaccagatttaatagggtagtatgtaactgttgtatgaattagctattaaattaactatagatgatttaaagctattagttggctatactattaaacttgctctaaaacatgttaattaaaatccactataaaacatgttgttctgatagtgtatttatttagtattggagatgttaattattttttactgtataaatttgctcttaaaaataaatttgaccgagtataatactagaacacctcccgttgtggaactaaacctccaattaatgtaagcatctaggaagaagaatctttatttctttaattcagcttcacaagagaaagttacactcaacctgagtacctgacgttttatctgcgcttccgcaacgtcttatttgctcacggattacatatgactgcaagtacatacacatttccaattattaggcaacagtaattactcactaattggccttggttaggcttatttacgtgttctaattggtgataactagagacatatttaattattagtcattatttctagcttttgagagagatgatcccattctggatattccactgcatgctccagtggttgttgacgttcttgtaagtccaataggcccatccgaaggtagctcgtccataaacatctagctgggcttgtgcaaacctctgataatcctggttagatgctccctgcacattccactcagccacccactctcctgcatatataattaagcaacatatatgtatcgatcacgttcaagaacttgtaatcttcatgtataaacagtactcactccctctctaggttggttgaaagtaattgtcattttggatatggccaatattaaatttcaagaatttcgactacaaatatcttctaaaatatttttttcttctgaatatgaagaccatatatataaattaatcttaaaatacactttaataaaataatatatttgttaatatttacatatattgtagtaaaaaatactgattagaattatttctttgagaccgtgtcctccaaaacgacatttactttcaacatgaagcgagtgctccatgttgaaagtaattaaattcgctagagaaacttgcaaatgaacttacccacgaacgtcagcggcccattcggccttgtgacggtgctgagttcgtcggagcggttggtcctgacgtagtcgatgttctggtcgacggtgaggccgttgaagctgctggtgaagaggttgtagtagtggacgtcgaggacggcgccggggaagccggcggcgaagccgaggagctccgtgttgctggcggagaggcggttggacatgaccacgtacgccgtcgaggtgtacttgcggacggcgttgtagccgtccttgtagtatctcatgagagccgggagagtcaccccgggtgccagtggctcgttcaggagctccacggccaggaggctggggctactcgcgtatctgtgtagagtaatttaattatttgagagtaaagttcagcaaactataataattatttgaatgaaactatcatttcgctacaactttagttttgtgctgtatttcacaacgggtttatcatacaactatgagcaattttacggtccttgaggaggtaagtaccattttttctattgtaaatttggtatctcatggtacctcatggtacctaggtacgatgatgtaccatgaaaattttggtacctcatgatatctccttaagaaccgtagaattgctctaaaactataactgtatcccctagtggttgaaccatctttcggattgtcatatactccctccgtttctaaatatttgacatcgttgattttttagcacatatttgaccgttcgtcttattcagaaacatatgtgaaatatgtaaaactagatgtatacatataagtatatttagcaatgaatcaaatgatagaaaaaaaattaataattacttaaaatttttaaataagacgaacggtcaaacgtatttaaaaaagttaacggcgtcaaatatttagaaacggagggagtatactattattatagacttacaatcacttgcagttatttggaatgacaagcaaaaattgcagcaaactaatagttttgaaaaaaaaacttatagcttactaaaatttactgtttattttacaataagtaaattaaattaggacaaaccattcatgattaatggaaattcctcgtattttacttccgaagagataatggataaactagacaagacaaattaaacctattttgtgtagtgaattgaaatatctatgtggaataattaaaattgtgacctgtgtgtgaggaaatcgatgacttggacagtttgggcgatgttggcatccgtggtgccccagtcctgtgaaccatctctggaggcactgtgctcaaacgggttctgcgacccaggtgcagcgtgcaggtccacaatgactcccaaattatacttcctgcaatgtacatacggaggacacatgcatagaaaatctctgtcatttgtaaagtacaaccatctatcaagggactgctcattgtcctgattccaaaccaatttattcttcccccaaaatcaaaattgttggagacagagaatttaatcatacttgacttatgctggaaattaaaaaaaatgagcatatgcttttaattttgactaaatatggaacaattatacacttactctgcccatttgaatgcattatccaaggcttggagggatcctccaacgaaaggagcaggaggattggggtcgctagcaatccaccatccaactggaattctcactgcgtttagcccacttgttgatatgaacttgaagtcgctctcaactatgtatgtgcgccagtgttcctgcaaaacacaaaaaaataggatatatacttataatttgtacatgtgcaataattaaaaagaggtggcaatctgcctgttataaaaaaaatttgcatcaatatcacgagatatgtaggtaattctcatcaaaatgcaaggatttctgtgtgcttatctatatatatatcc

SEQ ID NO: 49699 - DNA, 3505 bp, Oryza sativa
ggtcatctattaaaaaacggagggagatctatttctctcatggaatacctaggactggagaaaatgtgagtggactcaaaacctaaatcagaaaccagacgggtccttgtagaaaaattaagatggttttcatcaatttcgtccaaagtacttcctggaaacgtttattcatagcgcagccattattatttgactataccagttctcgccgtacctaattattcagagacagctgtctatataattttgtcaaagaataagaatggattgaatgcatcaactgaaaaccaaacttggaagccagctagtatgtatctagatgcatggatcgttttcaagagattaagagcttttcccatcaacagtcatttcccattggactatggaagccaatataaatatcactttctgggaattgaacagctgaaaagttggtatactaaagattaattcaagttggtcaattagtcttttttttatgttcaatcttactggtttgtggttaaccaagtcaaacatattttacttcgatcataaggatatttacattaatatttcctctatatttaaatatacaatactattaactttacacgttaattatgtttgattcttgtgatttattttatcactaaagatattttaagtataaattatttatatttacactaagttttttaataaaataaatagtcaaacgttatgtctaaaaatcagcaacaatataaatttaaaatcagacggagtataacaatagcacatatatgaaaacagagctatcctcatgtttcttctcttttgccatatatatactccctccattcttaaaaaaataaaactagtacggatgtgatatatcctagtaatactccaacttagggcttgtttggaggagcttctagcagctgcagcttcgagaagctccccccaaacagtctagctttttgtctagattctgagaatctgtagttgtagaatctggaaatgaactagaagccagaagctggattttccagcttctccagattctcaccagctagcttctcagcagctgcttctcagaatcttaagctcctccaaacaggcatttcgtactaggctaattttgtttgggaaatatgtgtcataaccaacttagtatattagaatatgatgcatttcgtactaggctaatttattttgggatatggaggaagtagtcaagtaattggttctgcaatttgcatattccttttactatatttcgagtgttcagatatttaccccattcaagactatatatctttaattgtacgttttgtatcatacgtccaagtaacaagtggagctgaaatgagtttgacatgtgtcttaccctgagcacttgtgtggcctttgctttaccatatccattgcatatttggtactccccttgtagaccgcctaccctagtgaccacaaacacagaggggtcatcgtcgccccaatttgtctccccatcataatctgctgtaactgagtcgcttgtcttcgcctagcatcatcacaagagaaaaaggattcagattttgcatcaaaccaaaagaaataatcttggtaaggattagaataaatttagcaaggcatactaaaaatttattttgacttgctgaatttaattagcaatatttcgtttctatttaaattcagctacaagagatatattgtattccacctatgctatgcatccaagcaaagaaaacgagtggctatggtttgtaagggattaagaaacctaaattaatcctcaaaactaggactcaagtggaacccttaacctaccactacaaaggcatatggcttttaatcttactagttaagaatatttgctgatacaaaagagagaaaatgagtggatagataaatattgttgctacatgatggttggaaaaagaacagaacagtaatagttttatattatattaatggtcagtctttattaattgttatgaccgttgtaagtacaatcatttaatgtgtattgtttaagagtttttatcgggttctacctttacacttgacataagttaaccagtaaagaagcaaattgactaactaaccttctactcttaaatataccttctcaggttagactaaatatgtaattagtcaacaaaaaccgaaaaatgtttcaagctaatatatatagtattggtcaagcttagcgggcaagaaaaaaacaattaattttagccgtataaaatttgactgccgaacactttgactctttgatttagtaagctcgagtttattttgtctacgttgaatccctttgacccatgtaaagatagtccaaaggaacattggctcacttctctttgctaaaaaaaaagcaggaagccgtcaccatcatgctaaagtagattaattcgccctatagctagctttattatcacttaatattactaactatgtttctcattttatcacttaggacatgtagaacagttattataataacactcttagctatactaattagtgctgaaaaaaaagaaagaaataggagataaaacatcgttgctcgattaacaacgactcttatttttttaaagttaaaacttagctgcataaggatggaaagaaggaaataaagataaataaaattaatggttagaggttttgttgtctcaactgtcacatgggatgacagtcttgcatagtttaagggctcataacaggctttaactttaaacatgccatccctaactttatcacttattattactaagtactaattaactatcttttagcactacattatttgatcctccagctagcttgatctttattgatctgcatgaaatgcgctggccacatttgtcgttgtcaccaatattgttcaaagaacaatacaagccaacatgcatatggaccatgctcgcaagttggcagctatcatcagcacatgtatatatctatcccagcctaatccactactaacttagctatagctacttgttgccattggagtactattatgcaatgcaagaggtgactcttgtacagtgacatcaatcaatttttcggcgtcctaattacctgcaggaacatgccattgggtgccctgatgcgcgcgcgagtcttgtcgccgttgcgcacgatctggaacgcctccccgggccccggcgacgccaccgtcgccacgacggtgaccccgtcgccggcgacggtgacgaacaggttgtcgaacaccctgaggtcgaacgtgtcctcgtcgatcctccacagcttgaaggtctcccaccccgaggcgctcgtccggttcgccaccaggatggtgccgccgccctgctcggcgcacaggtacatgttctgcgtcaccgacttgaattgcagctgggttccatcctaaaatgcatagaaaagcgtgttctctgatcataaatgtttgatgtttagaataagatttgataagatttttgaagtttttaatcatccaaatgtacttaccaggaggtctttgtttggaatgtcgtcgaagagg

SEQ ID NO: 49700 - DNA, 21064 bp, Oryza sativa
ccccctcggggagacagagggaggggtgaccatgtcaccctcgggcccgacctccccgagggggtcaggccacgggggtgaccgcggctactcaagcctctagtcacgatacccccggtcccatgtcaccgacagtagcccccggcgttacgccagggcgatcgcccccctcgagggaagcgctcgggcgtgacgccactccttaggcccggtgacaggttgggccggtctctacaggcgggcagaaacccagcggtcgcaaatcgcgcgcatcggcaagggaaaaccgaccgacaataatgagcagcctcttcaagaccgcaacattactcgagcagcgtgcgaatcgggacgagccggttcgtttcgcctggagacatgatgatggcgcttttcacgattggcaagcgcagttaatgcgcgcacaatctgccccatctcaaccgccacggccgcacatctgccgcgtgcgctgcaaacgggcgagtggggttagtggaggcgtgggcgcgagaaacgagggggcgaggtagtgggcgcgggaagcgaggagccaggcatagcaagggtacaaagacgccaaggaagggattcgtttccttcctctcgccactcttccccttgccttcgccacttgtgctctgactcttcgtttcctgcgccctacccttgccatactcgctcgctctcaagctcctcctccgccggcgtcatggcacggggctccgcaccgctcgatggtagcgtgctgctgccttcccgcatcgtgagcgagaggcaggctgggctgccgcgccgattcatgccggaatctgccaccggccgggaggtggtcgcgctgggcgagggacgcccggcgccacactacccagggcggtccgtcttcttcctctctttcgcaatggctaggctggtcccgccattctctaattttttcatggatattctggagttttatgatctccagatggcgcacctcacccccaacgcgataatgacattggccatcttcgcgcacctgtgcgagatgtttatcggggtgcgcccatctctccggctgttccggtggttcttcaccgtgcagccggtgtcgccgccgacgatagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcctccagcgcaggcctccagctggcgggcggcggtagatctgggagacggctacgacgccgttcgtgaccgcttggcgggtctgcgatcccaggggctcacgggggccatggtgttcggcgactatcttcgtcgccggatcgcgccgctccagcggcgcgcccggggcgcctgggagtacacctggcccgaggactccatgaggacccaccaggggcgcacatgggactgggaccctgaggacttcaggatggtggtccaacgggtgctaaatctcagctccgtggaggcatccctcatcccccaagaggtcctccccctctgctgcgatccagagcgcgccaacatcctgaccatcatgcaggaggtcggggcgtcgggggagcgggccctccgaggccacgatggcgcgggcgggagccgcaggggggaacaatctaccccaggagggggtcgtgcttctgggccccgcgacgggggcccggggggcagccgcccggccgacgcccgggggaagaggaagcaggagggtaccccttccccatctcctccccgagggggcggggcggtgcgtgccagcagcaggcgcccggagggtgccgtgccgacgtcgcagcccgagggggagcgaaagaagaaacggctctgcaagatggggggaccgagccatgccgggggaacctcatctcgtctccgaggtggtcgtttagccgacctccccgcaggttcgtccctgcgctcgccgcggccgtattcattctcccatctcccaaggcgagttttcactcacccgtttctttttgtcttctggtttttcttctgcctcagcgagatcccgtcgcgcccctcccgccattccaagtccggccggtctgaggccgaggagacggcgaccgcggaagcccggaggcgggaagctgaccggcgagaagccgcggaccgcctccgggaagccgaggaggccgcccaggacgccgtccgggttcgccaggctgaggaggccgctcgggaggaggccagacttcgccgggccggggagtccgtccgggaggcagaggcggcgcgcgcacgccaggcggcctgccaagcccccgacccgactccgcccgaggcgacgacgacttccgaggccacccacgacgaggccgcgggcgcgccgctcgggcccgacccctcgggcgacgcttgggacgagccagcttcagggggcgcccccgactccggcacgtcgattggcgggccgagccgcgcggcacccacaccgaggcggctctcccctctgccttccgctgccccactgagcgcggagcccctcctgcaggccttggccgccacgaacaccacggtgctggacgggttaagtgcccagatggaggtcctgcaggcagagcgggcagagctcgacgcggcgtgggcgcgcgtcgaggaggggcggcgctcggtggaggccatggtggaggcgggccgcaaggcacaccgccggcacacctcagagctcgaggcccgtcgtagggacctggcggagatcgccagggaggtggaggaggagcgggagactgccctcatcgccaccaccgtgctcaacgaggcgcgggacgacctccgcctccaatacgggagccgggcggcggagctagagaagaagctcgacgccgctcggggagtccttgacgccgctgctgcacgggaacggcgggcggcggagaacgaggcagcgtcccggcagcgcgaagaggcccttgaggctcgcgccacggcgctggaggagcgcgcccgcgcgaaggagagggacatggcggaccgcgaggccgccgtcgccatccgggaggcaacactggcggcgcacgaggccgcctgcgctgaagaggaatctgcactccgcctccgcgaggacacgctcaccgagcgggggcgagctctcgaggaggccgaggccgcggcgcagcggctggcggatagcctgttcctccgcgaggcagcgcgggaggagcaggcgcgccgcaatctggaaggcgcccgcgccaagagggccgcactggatcagcgggtcgctgagctcgaggctcgggcgaaggagctggatgcgagagcgcatagcggcggggcggccgtgggcgacggcgacctagccgcccgcctcgcagccgccgaacacagcatcgccgagctgcagggcgcgctggactcgtccgccggggaggtcgaggccctccgcttggcgggcgaggtagggcccggcatgcttcgggacgccgtctcccgtctagaccgcgccgggcggcaagcgggcctctggggcgggcggtgcgcgaagtatgccgccaaccaggggggcctcgcccagcgcctctcagagatggccgggaccctccagcggctccccgaggagctcgaggagacgatcaagtcatcctcgagggacctcgcccggggggcggtggagctcgtactggcaagctaccaggccagggaccctgacttctccccgtgggcggcgctggaagagttccctcccggaaccgaggacggcgcgcgcgcacaggtccgggacgccgccaaccacattgtccacagcttcgacggtacggcccctcgactcgcgttcgcgcttgactccgacgaggagggcggtgacgacggtgcgggcgatggcgacgacgaggctggcgacccgggcgcgtcggagtgagcctccaggcccccgccaattttaatagcttttcctttttcttccgaggccttcgggcccccttcttgtatagactgatttaacctgtaatcaaataaagaggaaatttctgcgtcagttctgtttattgcgtatatgagacgaggatggtctgtgtcgcgatccttctgtgtcttggcttgaacaagggctcgtgcccaggtcccaacctcaaacagcgcgggtcggggctagtgcctggggagatccacgtgtcgagattggccaggccgggagcgcggtgaccgagggttatggattacccgattgtgggcctttgccgattccccctcggagttcaccacgccccggggcacggctcggttctgggccccgtttggcgatttccgccggcccgggccaccgagggcagggtcgagcacgagtgtgctaattcaagccaagattcttcaaaaggaaacaatggcacaggcatagtccttaggaaatcgaaaaaacttttattgaaatacggaagagaaaaaagataagtatatgcatgtggtggcccccggccaaccctgcacgcccgagggggtgcggggttggcccgagcccgagacctgacacccgacccccactaggggtagaagcgacgaaggtgttcgatgttccatgggttaggcaactctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcgtctctgcgaagctgatcttgatcagcctcgcaatacatggtggcccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccacgttggcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttatcgacagcgacatagagatactcgaacccgcccggggcccgcctgaacggacccaggatatcgagcccccagacagcaaacggccatgaaagaggtatgatctgcagggcctgggccggctgatgggtttgcctggcgtgaaactggcacgccctgcaacgccggaacaggtcgaccgcatcgttgagagccgtcggccaatagaaaccctggcgaaaggccttgccaaccaaggtgcgtgaggcggagtgggctccgcactcgccttcatggatatcggcgagaagctcgacgccttgttcccgaggaatgcacttcaggaggactccgctagccgcgcgccgatagagggtcccttccaccagcacgtagcgcttggagatgcgttggacgcgttcactcccttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggtgcgtccgtctcccctagggggttgggtcgcgccgacggctggacaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacctggcgcacgtaagcgtccatctgcgggtcagagcatcggtagtccttacagacctggttaacgaccagctgggagtcgcctaacaccaggaggcggcggatccccagtccagctgccactctgagtcccgcaaggagtccctcatactctgccatattgttggtcgcccgaaagtcgaggcggaccaggtatctgaggacgtctccgctcggcgaggtcaacgtgacccccgctccggcgccctgaagagacagggagccgtcgaactgcatcacccagtaggcggtgtgaggcagttgtgaggggctcgagctggcctcggggacggagacgggctcaggagctggggtccactctgccacaaagtcggcgagggcctggctcttgatcgcgtggcgtggttcaaagtgcaaatcgaactcagagagttcgattgcccatttcaccacccgtccagtaccctctcggttatgcaagatttggccgagggggtaagacgtaaccactgtgacccgatgcgcctggaaataatggcgcaactttctcgaagccatcagaatagcgtaaagcatcttctgggcctgagggtatcgggtcttggcgtcccggagggccttgctaatgaagtagacgggccgctgcacctttcggcagggccgatcctcttcgccaggggccgcatctccagggcgctcttcgtccgagaggccacgcggggcgcactcggcttctgtgccgacgacctcggggtcagagggcgacaggtgcggccttcccgcagtggccccggggccatcatgggggtcgggggcgcctggcaccatcagacaagcgggcggagggccagctccggccgtcgggggcctcgggccgccgttcggctcgggggcctctcctccctgctctctcccgggtcgagtcgacacagggtggggatgcgcggagtgagggttgtcctcgttgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaatagggatagcgccttctctcccagcctcgatatgaaccgacttagggcggccatgcagccggtgacgcactgcacatccctaagcttgctgggggggcgcatccgctctatagctcgtatcttctcgggattggcctcgatgcctcgggcagaaaccaagaacccgagaagcttgcccgtaggcacgccgaacacgcatttatcggggttcagctttatgcgggtggagcggagactttcgaaagtttccgctaaatccgagagtaaggtctcttggttgcgcgttttcacaaccaagtcatcaacataggcctcaacattgcgtcctagctggctacccaaagaaattcgagtagtacgttgaaaagtaggaccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcacttactgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggttttggacgggccgtcgcccagggcaacctccttgaccgggacttcgtcgcaggtgaccatccgctgcctcggggcggccgggacggaggtgctgagcctctcgtcgctgcccgcgggcttggacgccgcggcgaggtggtccgcgcgctgctccatacaagcaagcgcgactttgaggtcgccatggacggtgatggggccaccggggcccggcatcttcatctggagataggcatagtggaccgccaccatgaacttcaccaacgtgggcctccccaggaccgcgttgtagggcagactgaggtccgccacatcgaagtccacccgctccgtgcggaagttggcgggaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctctgaggacacgccccaacttcacattgcaaacggtgggggaaaccatcatcgcgatctgtcctccccgggcaacgcacggcgggtggtcggtctggtcgaaggtgagggcaacctccgaccatcgcgcccgccgcgtcgccttatgggtaggggccgcggccagaagctctcgcttcatggccttgaggctccagcgagaagcgtgagcgcacgctcccccatcgacggtggcgacggtggccccaggctcctggaaccccaggtcatcgtcgccatcgtcgacgtcctcggcggtggccttctgcttggcctcacctcgccggttgccggcgggagccgccggggccttgccctcacgacgctcctgcctcctctcctcctcccacttcctcgtccgctcagccaaacttttgaccacggcagtccgcgaggtcgtggagggaggtgttgtgcacggaacaccacttgccggtcgggcgctccctgctgggagcgccggcctccttctttttgtcgctcgcaggcctcccctttcgggtggcccgcgatgcgccctcgacggcgaggacgtgaccctcgtcgtcggaatgggccgacctcttcttcctcctcctgtcccgccgctctgaccgagcggcggacccgggggcggccggagctgccacaccggaaccggaggagttccaggtccaggcctcctccttgcgagccacacggtccgcgagctggaaaagctccgcggtggtctggggctccttggaggcgtcttctcgagcatgcggttgtgccgcacgccccccctgaacgcgtagatcaccgcgtgtgcggggatgcatggtatggtgttgcggacttgacagaaccgctgaatgtacgagcgaagagactcatcgtcccctcgctgtaccgcatgcaagtctgcttcttcacctgggcgcggatatgtgccctggaagttcatggtgaactgctggcacaaatcctcccaagagtggaccgacgcgggtggcaagttcattagccaaccccgcgcctgacctttcagggccatggggaagaaatttgccatgaccctgtcatcacccccggcggcctcgatcccggtcgtgtagatctgaagaaactcggcggggttgacgcttccgtcgtatttttcggtgatggtgggccggaaccttgggggccaacggacgttccgaaggctcgccacaaaggctcgacagccggcaccgccaaccggggacacgggaggctggcccccgtgcccggaccgaagtggcgctccggacgaggaagcgcccttcgttgcatgggcagcacgacgaccattgcgccggcgctcgatattgaggcgggcatccggccccccacgcacatcttcttgggtcggaggcgttgacgagggaatggcggacgaacggcgggtaacggccgccgctcgccgcgccctccgcctcgacgacctggagccggcggcggcagcgccagaggtcccggtggcggaggaccgcccgccggcacctaggcgctgctgcgtcgtcatgaccaagtcggccacgtcatccagccaacgtcgggctggagtctctggatcggagacgacgggcgggtgacgcaggagcgcgcccgcagcctggagcgcgccctggggcgtgccgccatcgccgtagacgaggaggcgacgctccccgtcttgccgtccttctccattgcccgcgggcggcgaagtcacggatctttcgacctcctcgagcgcctcctcccgcccaagatttcggcgagagggggacggtggagtacgagctcgacggcgcgggttctgctccccgtcgtcaccgctagcgctcggagagaggttgtgcgccactgcccgttcggccattttggctgagcgggagaagcttggcgcacacgaaagaggacgaggacttcgaaagacacttgcgccccctacctggcgcgccagatgacggagcatggggctcctcaccgggagaccgcgcaggcccccctgtgccggttccgccgggggcgctaagtgaggttcttcaccctcgatctgtggaaagttcgcgagagaacaaatgcgcaagacacgggcgacgtagacaggttcgggccgctgagaagcgtaataccctactcctgtgttctggtggatctgtgtgtgaaggagttacagagagctggagagcaagagtcgtctgagagtcccctcctcgtccccccttttttcggtgggcaaggtcctccttttatatctcaaggggataccacatgcaccacttctacctactcttcttttgggtggggacccaccctatcttcaccaaaacttggcttgcgccttcgcctggaagctaaatcacagcttgtccttgagtgaggctcagtgccgtcactcgcctgacacaggggataaccctgtcatttcctcattaatgggtggagatttgcaatggccgctgtccgaatgactctctgatgggatgggtcatacctacctccactccgccggaagcagatgcaacgtgggagcatggttgtctgccgatgacgtgaccggcgtcagaccagtcacaaaccggtcattcttgtccaccacgcgtcagtttagcatgccgcacgtctgcccttcttcatacaatgacttccttgccatggttgcgatgaagcctggaatgaatctggccgggactgacgtgccaactccaggagttaacacgccggctccggctagggacgagcgcctggaggctctcatcattccgacgggacggggcgaggcgtgtgacaggccgcctgttgccacctaacccgcgatctgaccggtctgtgaccggtcacacactgcgaccggtcacggaccggataagcgcgcgctgcgctgcattaaatgcggcgtggcgcgctcgtccaaaccgcaataaatgcgattaggtgagccctgccgtgctcacctaacccacacgtggcgccaaaaccacagggggtcggggcgccccagccctcggggccgaaacgggaacggcccgacccctcggggagacagagggaggggtggccatgtcaccctcgggcccgacccccccgagggggtcaggccacgggggtgaccgcggctactcaagcctctagtcacgatacccccggtcccatgtcaccgacaccgatcctcaagaacctttcagaccatatggtcatatgctagctttccagtctttatctcaattcttctatgaaattcgggtaaagtacctccactagcctagattttcttagaaaatctgcatttagcatccccaatacattactttgatttgaaagaaaacatggaattctgtaggattccaatcctgtaggactttttctatacgatagtttgtaacaaaggatgagatagtattgaaacctacgtgttagcgtttcggtcaaggagtccctactttaccagtttgcttaattagaaaggcaagtcgatgtatctacgcgattagtgggccatcacatcctcgccacactttaagccaaaaaccttacgcagagattcacatgttctcttgccgtccaattctacaattaaggaaaagctggaattgttcgagagtctggtaggtggccctagacctgctcggagacgactacgtgtcctctgctggagcatgggactatctggttttctacccatgaacaaggttgttacatcatttggaggtgagacccatatcctggcttgcccgagaactaccaagggtgttgcgtctttcatgtagctaaccatagcaagtggctcagtcctctttggggcttagcacgtggctcagtcctctccagggcttagcacgtgactgtcccataaaggaggccagtcccacacttcaagtgtgaagtgtttcaccgtgggaacccctcattagcccgggaagggctagcatgatgttctcgttagctagagaatggtggaggcgtatcttacaggatgctacgcctccatcggatgtgttgtgctggctctcgtgtctatctatattattgaatttctcgagttgtctcattgtattaacatggatagataacctatatatatatgggcatctcgttttcacactaccataatggaaacaataatgataaccttgtagatgggcccgacgtgaagtttcacaggcgggttacatcggtggctaaatcggtgtggagctcgaagggcagaaagtgatctaatgattgtaaatagtgtaatgcgcttctcagatataaaaacccaaccgggactcttagaaagtgttaggttcttcataatcggcaaggactagatctgctagctcgagagctcccagcttgtacgaacattcatctcatagtgatgtactcccttcttccctaaacttttgatgccgttgacattttcaaacatgtttgaccgttcgtcttattaaaaaacttttgtgaaatgtgtaaaactatatgtatacgtaaaagtatatttaataataaatcaaatgataggaaaagaattaataattacttaaattttttaaataagacgaacggtcaaacatttttaaaaaaaagttaacggcgtcaaatattttgggatggagggagtaaatactagtaggcttgttatccttcaacaggcccaaaccagtatagttgttccgtgttctttgcttccgagcacactcaggctcaccatctcggttagaacccctggttcatctaaactcgaggtctcctacatctgccggagctcatccctccaacattgcgaaattcataaggaatgcctcaattcatataagttaggaatgccttgatccatataagttttagaggaatttatacatgaggatcattcctgtattacttttgatccatataagttttagaggaatttaaacatgagtatcattcctgtattactttagtctagttaatcgatcattcttgtgttactcttatattataaaattatttgttttgcacttacatttctgttaaaataaaatccggggcttcctgttactccgttttctcaatcctggagacagaacaagaaatgagaacacatttgcaggagtatatacgcagggcatgagcccttgagacggaagaatggagtacgtcacgatgatgacagtgtgttgttgcctctgaatctgattgagcagtgcaggaactgcagcaggttgagcacgctgagtgcagccatcatccagaagaagtagtccagatggccctcgtcgagcttgtccgggatccacccggcgccgccgccgcgcgccgtggccgccgccaccaccctgagcatgccggagttgaggtagttggcgacggcgacggcgagctgcacgagcgccgtgccgaggctcttcatcgacgccggcgactgctcgtagcagaactccagcatgccgatgacggcgaacacctccccggcgcccagcacgaagaaggacggcacctgccacgcgatgctcatccgcgtccccgccgccgccgccgccatcgccagacgccgcgcctcgaccagcgccgagtacgccatggccaccgcggacagcgcgaggccgacgccgatgcgctgcatgtgcgagacgcccctgtccctgccggtgacgcgccgcgccagcggcaccagcgcggcgtcgtagaccgggatcagggcgaggacggcgacgacgtcgaaggtggcgagcgaggccggcggcacggtgaagcggccgacgcggccgtccatggcgacgccctgctcgatcagggtcgacgtcatctgcgcggtcaccatgaagaagccgaccagcgacgcccagaccgggaacgtccgcagcagcatcttgagctcctccacctgcgacacggtgcacagcctccatgggctcgacggcgccgccggcgcgcagttcttgtccgacaagatggcagccttgtccaaaaacctggacatcatggaaatgttaaagttaaataatcaatttatagaaacttacacaatttaacataacaagatttactacgtttttagatttaccatcataatcgaagtatatcatttatttccttttataactatggaaagtccatattacccttgattgataagtgatggcacactcatacatgataggagtcaaatcaaccattggaacttctaaaacattatggtctagaataacatggcaatatcttaaaagaatctttcttgacagtggaatttgttcctactaattcacttagtttgttctatagtaaattaaaacaggtttgactattttgtccgacaactcttgtggtaattttgatgcaatgagcaatacctgaattgataggtatgttgagttctgtagtcaccttcagtcactcctggaagctcatgcaggagtgagctatcatcaggcaagttcagcctatgatttcttacagctgcaaccagcacctgaaagacccttgtcagagggctccctcccagtttcttgtacctgtacgccctcctaccggcgatgaacatggcgaggccgaaccccaagagtagcattgggccagcaaaaccgacactccaccctatgttgtcctgaacccagacaaccacggtggacgacagcagcgagcccacgttgattgagaagtagtaccagttgaagaatgagccctttgtcacccgctccaccgggtcggcgccgtcgaattgatcagctccgaaggccggaatgtttggctttatacctccagttccaagggcaaaaaggtagagccctaggtagacagttagacgagaaatacccccattgtagaaagaagcattcaggaacaatggtgatgccgaaaccgtcagaacgatcattccctgacaaaatagaactgtttcagagttgcaaatgacacatgaaactaactacagattgtatctttcagttgctgctctgcttgttggccttacaaggatgataacaaggatggacattactactgtccagtatcttccccaatatgtgtcagccaagaaggctccaatgagtggtgtgaagaagcaactgccgatccagatcgacacactttgtgcagcattgacgttgctttcatggagcacacttgtgaggtatgtgactaagttctttgaaaccccgtagaagcagatgcattcagtgaattcaacacctaggacatgttcaggactcaataggtcagttgtgtatgttgaagaaggaagtttatgagcatcaacagaataattttgtgaacttctcagaagtacctaaaatgaagaaacatgctctccaattccccgtactctgcttcagcgcgggcttactgtcaatattaaccgttccatcgcatgtgtattttgaacattgttcctgaatgacaaatgccaaaactaatgtatgttgcacaggatttaacattaaatatatgcaaagattcgctgaagaacaagaaactgcaagaactcattttttttgtttctgtgtaacaaactgaagccaaagtggcaaagtatcaactgtacatgtcatggggtcacatggagatacaaaagtttggtacctacctaggcaaaaaaaaaaaaaagataatgggaaggttatcgattaatacctgtggaggcaggtgatgaatcagtggcctgtcctcatcagatgcctccatttgagcctctggcttcttcagcaattttgttggaagaaaaccgacgactctaagctacttgcaattaattcagtataatcttgcacctaaggaatttttcgtaagccatctatgtgggcaatgatgagataagaaattgttagaagataaataagaaattatctaacaaattgcatcacatacccgacaacacccatttgtgctgtcttggtcttctgaaaattcagtgacattaggccactagcatatcactcgcactttttctgattgattactcatatccaattctgcattttgattagcacaatcacgcaattttggtactggaagttatatatgaactctattgactacataattctgtaaacaactatttcttgcaagcaacacccttctgtcagctgggaaattaggaaagtaattatcataaaaacagaagaggacaaactgacctttttttggggggtcagaccgtcagacttcctactttctagagaaggaagcattccatgcaaatttttttgacaattattacaatctttttaacttgggcatttaaattgagagctaacccctatgtcttgtcctattcaatcttgaacacaaacacaccaaaaacctaagaaatgaagtgtcaaaacaaaattagccttgaaccatcaggtccatcccacaatttcttttatttctttgaagcaaacatccatcccacaatttaaccaggggaaaatgaccacacactactcataaagaactagtaggcttcattcaaagctgatacactttcttttttatccaaaaaaagttcaggtgcagtattaattccaaaaatgaagaaagatttggcctgcaacaagcatgcttatatctatccctaaaatcctctaaaaacatatgtaagccatcgattccagcaaaagtaccaggtggagagagagagagagagagatgagacctgaggagagtgagcgatggacgattggagagggaagggcaaaagcggcggtgggaggtcggtctgggagggagatggagatggggttggtgtggttgccgctccccaatcgtagctcacactatagcagtactagccagtagcacaggaaagccaaaagcagttaaggtgagtgagacagtagaggcatcgaaatgattccggttcttggacagcaatcaatcacgtgacggatatatttattgtggcatgaatattttattcgtatgacctaaatctgcggagaatacaaatagagggcgttcgatgttttacttgaaaaatctttttgaccgttgtttcatcgcaacttaaaaaaaattcattattaaatgaaaaatatttcagattatcaaaatggtgaaacacatgttaatcacgattgaaacatattattctcacatatgaaacatcaagcttcaagagctgaaacatcaccaaactacaagagtcatgtactaaaatatgaaacaccatcaaaacatgaagtgcaacattagctgaaacatcacatactcataaaaaagtatcggttcaaacctaattttatttcttctcttcgatgggcttctcaagtttctactacatattcatgtagagacgttattcttctactccatcgatgtgggtagccgctgctcccaagctttcttcacctcgtcgtcattggtatcaggccctcgttgtgtcatcttcgctggcgaacgacacctccaattccacataaggtcatcatctttctctagctaatcaatgagcactagagcacaacgtcggcgctccgcatggccccacaaaacccacaacctgtgcatcccaaacttctttgccacctcgtcggaagccatccctccggccggccgcgccaccatgttcattgcaccaaagcatgccgcagtaatgcccacaacatctaagggcaaaagaaccgcttgcagaaaaataagggtgaaaacggattggataatatccgatccgaatccgtccaaaacgaggatatggtatgagcttttagaaatccggcggatacggttgcggatgcggatagtatgaggcggatgcggatgcggatatggtatctctaaaatccggcggatgcggattatccgacatttttgtcgaattatccgataagttgtttcccagataatccgaaattatcaacatatataaccactctatctattgcatataacataagttgtacaaccagtgccctcattcatcaattaacaaagattttttagtctaaggcgtttatcgtctcatgtcacacacacgtagctatattttttatattatggatatcatgcgttcatgttgtttagcacttaatcatataattattacgatgggtcatttattgattattgtattattgttcattggattgctaactcaatgatgcattgattgcatatacacgtaacatccgataaatttaatccgtttccgaaccgattccgcacagactccgcaccatttccgacatccgaaacaatccgctcctcatctgcatccgtatactatccgcacccgctccaaatccgctcaaaaaatatggtttaggatatggtatgaccactatccgtccgaatccgcttcgttttcacctctacagaaaaagtcgtgggatctcatcggagacacatggcgaagacgcccccactgctcatagacgacacaagaagatagagagaatggataagaatgcagaggaagatagatatatgtagaggatgagtgggctgttgagctcttgattgttttttccccgtcagtcgactgatgcaaagcattctcggacctaagaatgtgttctattggcaactccaagcgacaattttttttaggagtttgttaccaaactgctaaataatactcccttcgtcctaaataaaatcgattcctagatccacgagacaagtttaggattaatgtaaaattattgaaggaccctcgttaactacgtccatccatcaaaactccaattctctccacacattaatttagtatgctactcgagtactttggtggaggaaaggaaaaaaataaattgcattgtgttgatgtaaaaaacacacactggtttgggagatctgcttaggtctagtgcaggtccaaaacttgatgagatgcaggcgtgctagtcagtttgatcctgcaactaacaagatatgtaaatagtagatcaaatagccgatcggctgataagccaatgtagtaatccagccgatgccgatactagttggtgccgatagggttttgagctatcggccatgcgtccaatgtatattctgacacttgatgtaaataccaatataaagacaatcggctgatgataatataatataacagtataatccagaagaaacaaattggctaacaatgatttgatagaatagaacaagcactgatccgaaggttaaagaatatatcggctggaggtccgatgtcataaaatccacaagattagattaaacaatgaaacatctgttgtcatcggctagatccaacttatatatacaatccttgtaagccaatgcaacgtccagataactcatcagctaaaaccctgatgaaacccttattggcagtcaacaaacaggctagagattatgattctaagcacgacttagtagatgaaacttaactaatgcaacactaagtatgaaaagaaacataatacctatacaatcaaacccttgactgattttcagggtgatagatacccgagctaatctaatctagtaaagcaatttagccgataccggcataaaccctaaagcgagagagccagtctgaccggcagagtccgagcccgagtttctttcgtcgggtctcaagttttccttgcttgggaaggcatgtttcgagtttcctttggtttctatcctgagttggatgtggaggagagcctgtagaaggtaagaccaacccctatataaggggataaggccggttcaattgtaaaaaatattctacaatcaatcaatcgaatcgttttttcaatattgcttctagttctagtttaatttgtccatctttgtcgatttgcaccgtaaatcgtccgctgccgctgcgagagtgcgacacctctttgtaggtttgtcctgaaaaccttccgtttgtccacgaaacgggtagttatccatagtttcatctaaatcggctccgctagccggtttagtttatgaaaacccatcttgatttagtgcttgctagattagggtggttggtgactctaggatcaccgcaaggcgtttaagatgttgcgatcgtgcttgtcaacttgttaaaaaagttgccagcacttagcactaaaatagaatggttatatttatgactcgggtcttttaacatgtcatatcttaacattagagtgcaggttccctcctctacaaaatataacatatccctctgatgtagaagctgcaaagattggtgccatctttttgtctaaggatctagtcatgtacgaagaccttggaatgttgatgcgtaccccacgtatcttccatacgatcctccggacctgcaggatctcgcatatgccctatttagtgaatttataagagtttgacaatgaccaatccctttcctcagactataatatatgacaatcttactgttgttgatattcttttttaagattacacaacaaatgcacacgcatacacaccactacacgcgcgacaccacactctcacccccgcaaatgcatcctctaacacatgctctaagacgaaaaccaatgacacattcccgatctcactaaaatcatgttaaaagtacacctgcatgtacatagtattcgtaggcatcaggatttaaaccctatgggtagagtcatgcacccacgatacaccaccacaccactggtgcttcccctactgttgttgatattgattacgaagttataaatttagtgccatgatatgccccaggtataaactgaacattatattcaaatgctcattctttagtggaaa

SEQ ID NO: 49701 - DNA, 4873 bp, Oryza sativa
tacacaatataagtcttataatacaagcatgcatctggatgcatgcttccacctggctaacagaactgatttattggccgtaattaaacaagatttacagacttattctagttcgtgttaacccgattgatacttcgttttagataatggaaaatcattattacagttctgggcttctggcctttgcattaggtgtaatgtgtattcacccaccagacagaattatggcactatttctatattttcagtgagatatacccgttcttgatcatccattccaagctccaatggttattgacgttcttgaagttccagtaagcccatccgaaggtagctcttccatatacatcaagctgtgcttgcgcaaacctttggtactcctctttggatgccccgtttaccttccactctgccgcccattctcctgcaccggaacaataacttcagtgacctattgaccgtatattcttctacaatttcaaattctcgatcatttagagaattaaaaaccttctgatgtctaaattctgattgaaaggcaatttccaacttttcaatatatgccagtcagcagagaagagggagaccgttcaagcaagaaaataggaagaggaaatcaaccagagatgttagagccacctcactacttaccaacaaacgtgagagggctcttttgcttcgtgatgttgctgaactcagccttgcggctgttcttcacaaattcaatgttttgctctacgtttaaatttttgaatgtgtcgtcattgaacaggttgtagtagtgcacgtcgatgactacgcccgggaacctactggcgaaatcaagaagctcagtgttggactcccctgccagccggtttgacatgatcacgtaggccttcgcggtgtatttcctcacgacgttgtatgcatcctcataatatttcttaagcttttctaggggtacatccggtccccatggctcgttgagtagctcaattgccagcagactcgggctattggcatatctgtagattaattaaggtgaaaaatagcgttacaagaaaatcatagatttgtatggtgtgtttaaggatgatggtgaattctgttaagagacctggaagcgaggaaatcaatgatttgcactgtttgggtgatgcttgtatcagtggtgccccattctagtgatccatcccttgtggcgctatgctcccaatggttttgtgacccaggagcggcatgcaagtccacaatgacaccaatattgtaattcctatatacatgtgccaacagttcaacaaaaagtttagttaatggtaaaaaggtggaaaatttgcttgaactttttacaagcctgccatttcaatgcacattagcaatgtaagcaccaatgtcctctttataagatgagactaaaaccatctgtgttatatttcttcacccgacatggccatcagggtaagaggtgcttattcataaataaatggctgcatggagatacttactctgcccatttaaatgcgttatccaaggcttggagggatcctccaacaaatggagcaggaggattggggtcactggcgatccaccatccaactgggattctcactgcatttagcccgcttgatgagatgaattcgaagtcactctcaactatgtatgtgctccaatgttcctgcaaaacatacaatttcagaaaatgtgatagtcattgctatgattcttcctgacaagatgtttaccaatttctacacaagatacattagtaacttttctaaagggaaaaatatgtactagtagttatcagagaaggatttgtgattataatatgtatacaaagaaatgcaattgttgctttccttctaatcattcaggaatgcttcttcagagtcccactgtcatttgttgactaataacaatttagagagggacagttcagcacagtgagactcactggcctctagttttatcaatgaatataagacaggatatataggatatattgcatcgactcaaaaaataagtcaaaaaacaaaggtttagcaacatggcagaaattaacaagccaattatcaaatccattgaagcaacatatgtaaatattagtggaggaaactttgttctttttttaatgaagccaatatgaaccctctaagatgctaactactgaaggtaaaatgcttaggttttaagggcaacacaaataattgcacaatattgtagtgtatttgcctcttcttcctgcagttctcagggaaaaagtgtttctgccattatgctttatatctacgtatactccaatagttagaacatagaaattatgaaagaacctaacctgatcggctttctttctgccaacaaccattctatagcataacagttccaaacttgtagaatcagtatacagttagtagaaaccacaaccatcttaattttttaatagctatcatgaatgttataaccgtacatagtaggctaagaatttttttctgcattgtcttacacattgcagtgagttttctgctattctccatcaaataataggttaaaaatacaagtggaggaaaagtggcctatatgtcttaccctaagcacctgcgaggccttctctgcaccatagccattacaaatctgatactccccttgtggaccacctaccatatctacgataaacactgagggatcatcattgccccagtttgtgctttcaccataatctgctgtaacagaattggcagtctttgcctaacatcaagaaatagagaagactgatcattttgagtcaaggacggagatagctagataaactactttcaattcaaaattagtgagtaaatttagaatgatcataatttagaaatgccaagtgaagtatttttcatcttagaaatctttctattcataaattttattcaaatacaagctttctgttcaagagcacacaagtaattcttcaagaacccaagcttatgaatcaactctattttagtccaggtactaacccaccaagaacctttggggtagtagggttaattcagtcagtcaaagcattacatgcccttgaactcggattaagctaatccacataatatattttaaatcgacaagttaaatgcactcacaatgcaatttttttagggaaaacttgggctataatccacctaaccagaaaaaggatggaacaaaagatacatgctaactggaatttttagttagtacatacaaaacctcgcataacctttttttttgggtgaggaagctagcatagtctaattaattttaaccctaaaccaaacacaacatgttagaaggcatattcaagcagctctagtcctccttttgtttctagagatttatttgaaaatactactaatttttgccaattgcatccaaagatgtttttatcctgtggtgcatgcctgtttaaatcacataagtgtacaaggttgtttggttcctggccgcactttgccaacatagaccaataaaatgtccataattagccctgctagcagaatatccatagtgaacattacctgaaggaagctcccatttggtgccctgatgcgcaccctattcttatcggtgtcactgcgcacgatctggaatgtttctgacagaccaggcgtagtcgctgttgcgatgactgttccattgctgtcaatgcccatgaattgctttttgaacaccctgagattgaatgttgtctcgtctaccctccacagtgtgaagctctcccaatcagaggccactactcggttggcaacaatggtttggccgccgccctgttcggctgcaaggtacttgtcctggatcacagacttgatatggagagtggtaccgtcctataaagttacatgatttttgaaacaccatgagatcactgccaaaacacaacagggaaccatccaaatggctaatgttctaactgaaggtaccatgaaattgagtatagacataccaggaggtcattgttgggtataccgtcaaatagtgacggtagaatccagccctctgtcacaagccagccgccaaggttcaccgaccggatgggtggtgatgatggaggcagattattgagggagatgtacccattcttgatcatccactccatgctccagtggttcttgacgttcttgaatgtccaataggaccatccaaaagtagctttcccatacaggtctagctgcgcttgcgcaaaattttggtagtcttccttggatgcattatccacgtaccactcggccacccattctcctgttgcaaagaagagcgcataccaaacaatgtatcagttgagcactccagcattttcaaattttcaatagatctgaccaaatataatttttttttgtcaattttgcttattgtattaatcaaatgagatcaattttgcacttctcccatatgagtgtaatgtgaaacagaagaggaagaaacaagagaaaaatgtcagtgccacatattttctttgaaagggatcagtgccacatattagtacctaccgacaaatgttagaggaacgttctgctttgtgaccgtgttgatatctgatgaacggttattccttacaaaattgatgttctgctccacagtgtagttatcaaacatgctgttatacaggttatagtaatgcacatcgataaccgcaccaaagagactgctggctactgagagaaactccgttggatcccctgacattcgagttgacaggattacataggcttgcaaagtgtattttcttacagcattgtatgcgtcttgatagtattttgttaatgtatccacaggtacatctggtgccagtggttcgttgagtaattctattgctaagaggcttgaacttttggcatatctgcattcagaggaaaaaaataagttaagaacattt

SEQ ID NO: 49702 - DNA, 6784 bp, Oryza sativa
accctggtgctgcatgcaagtccacaatgatacctatgttgtacttcctacacacacaaaatggcatatagcaatatcatgacatttgcaataaaacacaataatcacaataacagcttaagcatgtaatagtcttttcagtctgtaaaggaataatatatatttatgtccatctctataaaactcaatcgcacaaggtatttcttctctcattatttttaaatagaaacatgtgcatatgcttactctgcccatttgaatgcgttatccaaggcttgtagagatccaccaacaaaaggtgcaggagggttggggtcgctggcgatccaccatccaactgggatcctcactgcatttagcccatttgatgagatgaatttgaagtcatcctcaactataaatgtgttccagtgctcctgcaaacaaagaactttagatattgaactgcaattatgactatattttcgtctcaagaagaagagtatttttatacactacaatagtaatttatttcaaaaaaggatatgcatattgctctgttttttggcttgcccatttgacaactagaattagtaatgaataccataaataaactatgtaagtgctagcttctctttcttcgaaagatttcttcataagaaagacaataactctattcagtgaggttctaccatttctttaactagtacaaaattggaaggaactcagcatatattaattgttgaagattactattgaacaaaaccaaaaggaattgttgaaccaataataacagtgatacaaatataacactttggtttttaaggatagaaaaaacaagtgatctaaacatcgtatgcctacagttatccattcagtgtctcaacaaaaatagaatagaaacaacagtgtcacatcttaccctgagcacctctgtggcattgcctgcactgtagccattgcaaatctggtattccccttgcaagccataaatattatttactacaaagactgatgggtcatcatttccccaatttgtgctagcaccatgatctgcagtgactgaacccatggccttcacctaacatctcaaaaggagaaatatatttacaattgacgatgcagttaatctaatagaagtacgtgcgactgaaagaaaccttaaaaaaaatgatttgcataactactacacaacttgcccgctttatcaaaccaaatgcagttctcgaatagccacactgtgttgccagacacacacaataaaaaacactaacaaattaagttaggttaaaccagataaccatgataaaaaaagtttttttaagatcgactaacctgaagatttcacaaatctaacctgaagactgttttatctgaattttagacatctcccttaaaaaaaagatgaatttaagatatggtgttacatatggaaattaaaggtggctacgacatatttgcaaaagaaaaataatttgtgaataaaacttttatatacgcgttcttagcgatctaaaagcaaaggctgaaaaataaactttgataaaaaaacccaaaatcaattccaaatttaaggttgaaaatttaaattttggttaaaaagcataaacataagtgaaaagatggggctaatagcatttccataaaaacaggtggctgcagaatttccatagaaatactccctccgtcctattttaagtgcaaccatgtgtttttgtatctaactttgattgtccgtcttatttatagttttttatgattaatatttttattgttattagatgataaaacatgaatagtactttatgtgtgacttatgtttttaaattttttcaaaaaattttcaaataagacggatgattaaagttgggtacggaaaatcatggttgcacttaaaatgggacagagggagtatgtcgctatagaacttcccaaactaagtacattttcacccttgcaccgtttgcgtcctaaaatcttgtatgcgtgtaggctctgtcactagatttaaggtgtgtattacttaggtggtggctctagtccttgaacataataataatttccaccgctgcgcaaactagttaatagtatagaaatctagcacctgagctctaccaaaggtgcatgagcataatacaaccactacactaacaacttgaattaaaaaaaaatcactccttgaaactagacgattgttaaatcaatagacattcatcagtaaattgaaataatcacatatgttccgcagatattgagagaatgcatacatgatagtagcaggtaacaactagatgcacactgacaaggcatttttcgttttgcaaattaaccttacctgcaagaatttcccattgggtgcccttatgcgcatcctgcttttgtcgctgtcaaggcgaatgatctgaaatgtttcattcggccccggcacggttgctgttgcaataactgccccattgccaccaatgctcacaaactggttgttgaaaaccctgagattgaatgtagtctcgttgatcctccacagtttgaaggtctcccaaccagacgctttctcccggttggcaacaatagcactgccacctccgttctcagcggcaaggtacatattgttggtgaccgatttgaattggagctgggtgccatcctaaccaagagatcaataatggaaatataatataggacatgaaaatagctagctaattgtggtatagtatctcagcaattaggattacttatcattacgtggtagggtgagcacaaaatgaaagaaagagggtatcagatagttttggtcaatagatataccaggagatctttgttggaaatgccatcaaagagtgatggcttaatccagccctccgtcacgagccagccgccaaggttcactgctcggatgggtaacttaggctgatttagtgagatgtaaccattcttgatcatccactccaagctccaatggttctggacatgcttgaagctccaataggcccatccaaaggtagcttggctgtacacatccaattgtgcttgcgcaaacctcttgtaatcttcctcggatgcattattcactttccactcagccacccattcccctgtagcaatcaagagctcataccagacaatataccactgagtaataacatttagatagtgtcgagtgtcaacaaactatatagttttgacaaatactactcactctgttccatattgtaattaaggtgtttcgtactaaatcaaacttctctaactttggtaaagtttatagaaaaaatgcaccaacatctacaacgacatcatcaatttagtttcattcaaatgcacgatgaaatatgtcttagcttaatgttgtaattattttgcactttttctataaacttgatcaaagttagattactttgacttaggacaaaagtaaaacaccacattttggaacggagaatcacttagctattgtattattgatcaattgattgaatataattgtcgctgttgatccaatggaggagtaaagcacaccagcagacatgttagagcgacaacttacctacatatgtgagaggcccgttctgctttgtgacactcctgagctcagcagaacgatcatttctcacaaactgtatattccactccgctgttgtgttgtcaaacgatccattgaacatgttatagtagtgcacatcaaacacagcaccaaagaagccaccggcaaactggagaatctcattcgagtagtctgcattaattggattcgacatgatcacatatgcatctgatgtatattttcgcacagcattgtacgcatcttggtagtatttctttagcattccagctgatacttttggtgccaacggttcgtttagtagttcaactgccaggagacttgggcttttggcatatctgtagaccaattaagacgaaagatgagatccctttggtttttcttttccggttttaagataatgataaggaaaatattatttattgatatctttgtcagacctggatgcaaggaaatcaatcacttgaacagtttggatgatggtttcatcggtggtgccccatgtctgtgaaccatctctactaccactgtgttcccatggattctgcgatccaggtgcagcatgcaagtccacaatgacacctaaattgtacttcctgtgcacaacaacaaagatcgcttattacgtatatgacatccttttttcaatccaagctaagagaatttatttaatgatgaagaaattacggtggttttgctaaaaaaaaaaaagaaactactatactgtggtgacatggaaaagtaaatattcttactctgcccatcgaaatgcattatccaatgcttctagagatccgccaacaaagggtgcaggagggtttgggtcactggcgatccaccatccaacagggattcttacagcatttaatccatttgatgagataaacttgaagtcgttctcaagtatgtatgtgctccagtgttcctgcaaaacaaggaacaaattgagagcaaggataatagttatattgtcatagtatttcctagtttgaagaaaataatctgatttcatataggtttcgttctgcacacataaattaagggtgtctaataaacttcaattctgagcaagtcgaagcaagttttctaggccagatggtttttcccttgcaaatcgttcaaatttgctaattttgagcgtacaaatgacatggttgagtagaaatacacattacacctatctagcattgttgaaaaataactggacatgatttggattccctaaaaaaatagatttgaagggcaaagtattgttttctgaaaagttcaccaagtaaggcttggactaaccagcaccaggtttctgttcttcaccaagtattgttttggaagatttacttagaaattacgaatataccatccaaagtcacaaatgtcaaaaatgcttggtaccggcaacgaagtcgaagtcgccggccaagcctcccccactcagccgccacccaggcaccggcaacgtcgtgtcccccatgacaccacaccaccgaggtcaccggccacggaaccccttcccgccgccgccgaggccacctgccaccgaggtcgccggcgacgaagcccctccatctcgatgcctccaccgaggacgccagcaacgccgccacggggatcctctccctcgcctaccactaccgaggctgattcgccggcccagccgagctatcgagatcgatcgagcccccctccccctcccgccggcggtggaagcggagagcggcggcgagcctcggtggcaccctcgggcaaagggaacgaactaacgaagacaagtctgtctgatgtatcggttgcgagggtagaggcgtcttttcccctcagttttttttttttttggcagcaacaactaaatctaaaaatttccattcatttctacgaagtttttatgactgtagcaattacatgtttacgaattccgtgacatccagagtgcaaataaatgatattttcaacgaaatagtactctctctattctttcgtgctccattgacaactaaaattaagagtgaattacacttttggccacattttattgggtggtcctagtacgcgatcactcgctggagggagggtcaagcgataaaaaaaacgatcagcaccccctatagcgatacgctcctccctcttctcccccttcctccttccatttttcccttcctactacagtacaccacaaaatattttttaaaaaaaacaaaaagttagaaaaatttatatatagaaatactatatataaaaaatttgaatttaaattcaaatttgaatcgggtatgtaaacttttgacttataaactttagatctataaactttaggtatataaattttagatgtatagaaatactatatatagaaaatatttgaattcaaattcaaatttgaatatgatataattcaaattcaaatttaaaacggtatataaacttttgacttataaattttaagtctataaactttagatgtatagaaatactatatataaaaaaaattgaatttaaattcaaatttgaatcggatatataaacttttgacttataaacttttggtctctaaactttaaatgtgtaaacttgaggtgtataaactttaggtgcataaatttactaaaataggaaagtaatacggtgccaaaaacggaaaccaggtggagggagggagggggggcgatcgctacccgatcgccacggcgatcaattgcccattagagtttccgcattttattgtcgtagttttattttggattacgtttggtctaatctttttattttagactaactaagtttacatttgttttattttagaccacctaaaatcacttctttatcacatcaataaccttgaagacatcggttataacagctagcaaaattctccgtctatgagcaggtcgtacatttgccggagtataggtagacatggctaatgaagagagttgagatgatccaaagtgcaataagcataaatttagctagtacaaagtgaaaaaattgactagggtgatctaaagtgaaactacagcaataaaaggtggcccaaagtgcaattcactccaaaattaatttatcccttaaagactttattgctaggaattgtagctaatcggattaagatgtgtgtatttaattaacgattttgctagatatttgtcatcaaatttctccccctgatatttgtcagatgtaattacagtacaatcgtagtgtaattacactgtaacttgtatgtaattacactgtaactataatgtaact

SEQ ID NO: 49703 - DNA, 16599 bp, Oryza sativa
cagtgtaattatactacgattgtactataattacatctgtcaaatttttagtagaaaatttgtcgacaaatgtataggtggtccctttaattaacgtacaaaaagtattaattaagggcactgttattatttactaatttgtgtgagaatgtccgtaaaaaaaaattgtgtgagaatggtcagtagtatggacggtctttctagtaaaccgaacaagtgaaacatatggtgctgctttttccattgggccagttcggtttttttctattgtcatggcacatcacatgccttgtcgtactagttaggaacatcccatctgcaaactcatatatttttataaatcaaatttcaagtattttccataattcatctaacaagtggtcaagtggagctgaaccaaggattcatatcttaccctgagtacttccgtggccttcttcatgccatagccgttgcatagttgatactctccttgaagtttctccccccggtttatggcaaatactgaaggatcatcatcaccccagcttgtaccctcaccatggtctgccgtcactgaaaccgtggtcttcgcctaacatttccgaaagaaatttcgaccttttatttagtgacaaaaccctatctttcacaaaaataaatactccatatgtttcaaaatatagctaacttatacttcatccgtttcatattataagactttctagcattctccacattcatatagatttattaacatctatattcaagaatatatgtaatgctagaaagtcttataatatgaaatggagggagtattaaattagtatgaatttagattgtccaaattcatgctattaagctgtttctaattcaatagtaagttgccatattttgggacggatgaagtagtagcttaaaatggatcgaataataactgataaatcagaatttccatatttagacacactacaataatcttcatctttgtaaatgttactgccggcctctgttaaaaatacttggcgtttgactttttaaatttatgaaaatttaaataataaaacattttaaatattaagttaaaatataaaaataacatgtgcagatttgtcttgaaaattatttccatgatatcataatttgttacatttataaacttattttcataaaagttatgtcaaagttgtagcttggatataaagaaaagtcaaatgcatgtcacgtagagggagtagcgcatataggaaataatatttctaacttagactgagctagctcgtacacacaaaccatggattatttggtctaccgtcctaacagcttattcgtatccatgctatatattttgctcgcaaagcttaatctaaacatttaaacctccattccatacggatatactataaaatagattgaatggaactaacttaaggtcgtagatattatataatattatcctataaacttgttaagaagtttgagttaagacaaactcaaaaataatagggagcaggtttttcgttcatgatctcataaatatttcctttttttttaccaaataaccattatatacctgcaggaatttcccatttgacgccctgatgcggatcctgctattgtcacggtcgctgcgcacgatcacgaacgtctctgacggccccggagtggccgccgtcgcgacgaccacgccattgccgtcgacgcccacgaagtgcacggcgctgtcgtcgatcgccttgaggttgaacgtgttctcgtcgaccctccacagcttgaaggtctcccatcccgatgcggccgtccggtcggcgacgacgatgtcgccgccgccatgttcggcgcagaggtacgtgttgtggaccaccgacttgaactggagctttgttccatcctgcaacacacataagagtttcaaatatcaggttcatagttaattaggttacaaatgttgattgcacggactcaagaaatattgacaaacactcgttccgttctaaaatgttccgttccaaagagcgctgccagcgaaaatagctcatcataccgccagtgaagataaacctattttcgctggcggcgctcagaaggtaccgccagcgaaaataaaaaaatcttcggagcccgtttaattggccggcctgaaataaattttttatttgtggggggtgcctcccacccctccttaaaacattgctggcggtgtgtatattttacccgccgaggaaatattagaccaacaccatgaaaaatcgtttttctccactagagaaagagaggggaggaagtacgaggaagtcgttgtttggaatgtcgtcgaagagggacggcaggatccagccctcggtcacgagccagccgccgaggttcaccgaccggatgggcggcaccggcggtgacgagctgctcggcgtggccatggtcggtgtactatcgatcgcagctggagacgagataaagagagaggtatggtggctatagctagctagtaggcctggaggagaagagaaggagaggcacttatatagataagctgacacccacagttagctagagggcgctgagttgccattccaattaattgtaggtttagctcgccactagacaattttccatcgtcaacttggcttaattaatcaaatatgagtgatcattctaattttgtcctttgaagataagagtgtcagaccaaattggcctgcttgctatgtacttttaacagtttactaatcctctactaggtaggcacatgcgtcgcgtttaatctatataatctaatttctccatgcatgcatgtcttgacttgacttgtaagtaagatcatgtacagaaaaaacatcattgagatgaggatatatatatatgtgaatgcatggtacatcagtacacaaatatacacatatgagatgttgctctccgagttagctacattactggcagatgcatctatctcactctgcatactcaactactagtacttagtttgtgatcgatgattatgaagcattgccgctgaattaaacgaaattccacacctccggccgccggtttctcccacagacacaccggtgacccgctggctgtgtgtggacgcacgcttttgacgacaagctcgcagatctgatctccgttcaaatgcctagttacctgtgctttagctctcacacggatgacaacgtgatctggtgtgattactaaagatacgtatacaatgctaaattcaaagtttgtctaatcatggatttttcattcgtcaagtatgaaacaactcatttgatttcctcgtaaaataacttgtctaatttttattataacattcttttattacaggtaagatgttcttgaagagtgtaagggatatgcaatctagtggttgtagtgacctaagtagcaccccaatgtcctaagttcaaatctccataggatcgagcggattttagattgggtcatttgagggctaagtttttgatttaagaaggctgcatatattccctaaggtcctgagttcaaatctccataggatcgagcggattttagattgggttatttgatagctaagttttttatttaagaaagctgcatatatcggttggatatagaggctgggtaaaaaaaatacccttcttaaaaaaaaaaggtaagatgttcctgtcgacggggaatacccgtagaccggatatagagggtattggggtccgttggtacgaggatctacgtagtacgacatcaagcaaacagaagacaaggattatactggttcaggccccttggtaggtaatagccctaatccagttggtatgggattatatgatagagaccacagattacaaagggaatagcagaactcgatgataccggcgagactgtagtcgagttggtccgactagatctcccggcgacttggctcctgtaggctccagctccgtagtctgtggtgggtgtgttggcagtcgtattcgatgccttaggtcatgcctagggggtcccttatataccgcgggtcagttgatctccaagtaggactcggagatatcggacccctcacgatatggtaatgacccagtcttgtccgagtaggactccttccgtccgtagattctgcttctatcacgtgatagatttccttaacgtatactgaaactattcgtatacgcgtgggtataccgtatcggtacccatcgtacatccaaggatagagggtataccttatccgatcgggaaattcttccggagtgcgcaagagtgaggacaaagtgcgcagaaaagacctgtgttgatctgtgagggcagtctatgacctatgagagctgctagatgtaagtgggcccggcctgggagaggcgggatgttacagtttggctgctagatgtaagcgggaccgatcgggaaattcttcccgagtgcgcatgagtgaggacaaagtgcttagaaaagacctggattgaaattcattgaaagagtatttgtttgtgcgtgatatttgtggatactaggatttaaatcttgatagggggagttacgtattcacaactctatcaataaatcacctttcctatattctttgatcttgatgcttccacaagaggagcaggataatatgtgcagtgatggtggtttagactggtgtggcaccaacgtgacacattaacatagtctttgtactacatggagtagctatgtagctatgtactacatgacattaaagttgacaaaataataaggaaaagtgagacccatgtgtcatcctctcccaccttgatccacccttaaccaatttcttcgtaaactctcccctttctcctctctcctctctcctcccttccctcttcctcagctctcaagtctcaccttctagcagtagtagagagctaggttgggaggatggcagtaaggcagagccaaagccagggaaggcattagcggctcctcccctcttctttccctcgatgggttgaggtgccaaggccatcagagacgggagggcacggaaggagaaaggcaatggcctgcagatctcggcgaggaggttggtccaaaaaggaaactagcagagcgtgtaatggcaacaaccctcaatctagcgccaccgatccgagagccttgcggtgacccatcgtgctcctcctctctttctcccacgctggtgttagggactgtggaggcaggtagctggcgatggagagatcacaggagtcaacggggaggtgtatcacctagagcatgggttggttagcgagagacaagagaatgagatggggaggcgtatccagcggaagccaacaagggtgtcatcgttcggtcgtcgggactcgtgatagatttggcacctttgagttgtattgctctcccgccttcccgcaccacggttgcttccgtgcccacaactactcccactccctcctcatctccgcatctagtgaccgcctaattagcctccttgtccttgttggacccctcccaacccgcatggctccagagagcaccacctgtcaaacactaagatcctctgtgaccccatccttttcttcaacacaaccatccctaggctccgcctggctactatcccccgggtcgggccacagctctcccactaacaaggtcgttgttgcctcggcctctggatccagctcctctttcgttagtcgtggcccctagaagctagaaaccactgggagaaaagagagagatagagagaaacagggaagagaagagaggaaagggtagaggaagagaggtcactgacatgtgggccccataatcgtaccgtattattttctcacactgtaatggcatatgtagatgccacattggatagagagagccaaaatgaatcagattcggtttctcacactacttgaggaggtaaaatgagccggttttaatagttgagagagagcctttatatttagttttacggttaagagatatgaatcagattcggcaaatagttgaaggaatcaaaatggacttcagccaaaatggaccatcgtcaggttgtgatctgaactagagcatttggcaatggaataagttaacctaacatcctccctcaattgtatgccaagtctgttgaggtccctaacaacaatattagaaatatgtaccctgaactatgtaaaaccgtctaaaaaaggtcctgagacagtataaatatctggtttcactgatgtggcatcctagttagtaaaaaataaaaaaataaaaatgtggggcccacatgtaagtgagaagaaaaatgtggggtccatgtgttagcatcatctttttccttttgctgaagtggcatcctagtaagcaaaaaaaaaattaaaacaagtacgtggagcccacatgtaagggacagcccacatgtaagtgacaagaaaaaaattgtagggtccacatctttttttcccttctcttttctcttttcttttattctcttcttttctcttctcttctcctctcctctcctctcttcagccgagcggaggtggcagttggcgacgggcggcgagcagcgtgcgagagtagcggtggcagtagccgcctctttccccctctccgccggcatgaccggcatcctcaccccactctcctactgacctcatgtccccctactccagccggcttcctctccccctttccaatcgatcgcttggtgaaggtggcatcatggagcggttgtgggccttctctgcagccgacgcggctaggcaggaatgtggagcaggaggggtagagctgcgtcaggtagcctctttcgagcttctctgtcgccgtgtcgccgtactctgcgagcttgttttgggcggcggtgtccatcgcaacgccaagtgtgcgatgccggcgcggtggtgctcggggtgtggcacgccctcgtcggcttcttcctcgcctagcacgcatgcgcgctcggtgcggtcatgcatgatctcttgtgccgtctctcgtgcatgctcctcggtcctcggatctccactgctccgcctgccaaccgttggtcgcccgtgctcgcccaccatcgcccccgctctgctccaccggccattccaccctagccctgctccgccaccacctccctgccacccagctgctgacaccgtctcctcacccgcctctagtcggtgccgcctcctcgtcagcccaagccgtcgaccgtcgtcggcttgtcgttgctgtgggccccagccgacacccccacgccacctcctcaccaccccggctgcaacagccgccgccaccatcacctcatcgagggaggagagaccacgagcatgggatagactagagagcaggggaagagataaggtggagactgaggatgacatgtggggcccactttcgtttttgccacatcagcgtctagccaacacgagtggaccgggtcaaatttgccacatatagacacttggttttgctgactaaattggatggttttatatagtttagaggtgaagatttctggtattgaggataagggatgtcaaataaactcgatgttaagttgaggcacggctggtgaacttattcctttggcaatatatggacaatgaacatttgggcttggcccacgtgaatagggaaagagagtgcaagcaacaacgggggtacagtaccatggatgtcgcgtgtactccaaagtttttgttgctttggtcgcgtatcttcagtttgtaagacgtaataagaaagctcaaacgggcagacgtgaagacatcatttggatgtactccctccgttttttaatagatgacgctgttgactttttcttatatgtttgaccattcatcttattcaaaaattttatacaaatatataagatataaatcacacttaaagtactatgagtgataaaacaactcataacaaaaataaattataattacgtaaattttttaaataagatgaatgatcaaacatgtgagaataagtcaacggcgtcatctattaaaaaaacggaggtagtataaactacgagatctacgggatttagatgcgtaaataaattatgagctatttatacatgtcggcacacattgcattactaatagacaaagaaattctactctagcccaaaatttttaaactcaaattcacactataaaaacttgataaattcaattcaattttataggaatgatctattatatagagagacaactttgtacaaatttttggctatttatatatgtggagtcattttgggttgaatcatgcattcagagctaggttctgatggtttggttcggtttgatccatttatgttttgtagcgttcctaaaaatttattggactaaatttatgcatcgatgtaaggaataagtagatcgaacctaaccattcctatggctatcctgaatggtccgtccgctatttatcacaaccatgtgcggtgtgacatgatcgatcaaaatgtgtagtaacatattggtatgcaataagctatatacatcatgagcatacattccttgtcaaaaatcaattatagcggaatagttatatgatgctggatgcattcaatttactggattagaaagccaactgaattggtggcaaagtcgcaaatctcagcgccattacggctgacgctgagttttgggttgagaaaaaaaaaatagcgctccctgccacgtcggcaggagatcggctcggccgccatgctggcagggcgttaccgccaaccaccttgatgcggagacggctaacctcagcgccaacggttctggcgttgagcccgcggtcttttttttttttaagcttcaaaataaggttttgaaaacggccaatttgttaagaaaaggagcaaactaaaatgatattacttaaccactttcacatttatgcatgggtcaccacggcaggagtactataacctacaaattacgaaacttaaatttacacgtggaccatatataaaccaacccgattgtgctagttataaatggccttggagcccatccagcttggaacttagcactatttctttccacaaaatttgtacgggtctacgggaaacctagaaagtaaaatccatgtccggctgggcccttcatgttacagataattaatatataattaattaagtatattaaccagtataaacttaataaatatatttatttaattttttaaaaccacttcgatatagaaagtttttttttaaaaaaatataccatttagtaggcgaggaaaatagctcactccatttatacaaatgaaagtagcgttaggctgcgtctggcagtagcacaaagattaaaactctcttgtttttgtgcgcgcgcttttagaaaaagttgcttgacaaaatcaaattaattttttttaagaaaattcgaaataatttacatatcttcttaatcttaatatctccctttcatttttttttaaaaaagttgagaatatacgtaaaacgaggtgatgcattaacgcataattatattaactattttaaatttcataaatagattactattttttattttttagagcgaaaagctcttctatcattcaccaccagtgaaaaggtgaggtggccacggaaaaagtgcaaaaccgcgtcgggttggggtcctcctccagcagtagcacggcgagcgaggtatggctgtgtaatcccaccgtccaaaaactcaattttaacgtttgaccgtacgttttatttaaaaaaattataaaaaaaattaaaaagataaatcatgcataaaatattattcatattttatcatctaataataattaaaataatttcatataagaagaggtggtcaaacattggacaaaaaactcaagaattaagggtgtgtttggataataggaaatgagaggtggaattgggattaggaaataaataaagggttaggattaaatggatgacgaagaatgaatggttagaatttaaagatgggttggaaatcattttccttagatatttgccaaacactgcctaagtcttttgagacggagggagtagctgtgtaggtaagcgaaccgccggtgcgcgcatacggggaatacgggaaacggcgcatgtgatcctccgcaccgacgctgccgccccagctgcactgcagcagtcgacggcccgtgaacggggctggatggatggaccggcaaacgtccaaagccgcacgaaatggcgatcgctcctactgtcatccttgcttttttgagaacattgctactccatccttgctcacattgaatttgaacggatgcgtgtcgctatcttcatcaaatccaatttgatttcagggagatatatgcttcgtcctggacggaaatcttcggcgagagcacgagacattctcatgttctaatgccttgtttagattttaaattttttcttcaaactttcaacttttccgttacatcgaactttactacacacacaaacttccaacttttatatcacatcgttccaatttcttcaaacttccatttttaacatgaaactaaacacagcctaaaggtcatacgtgaacttgtatctagaccttctccactagtagcgtaggttagcttgtgtacaatgtcaagtatttagaaataataactttttaagttatagttaaattaaaaaagaatagagggagtagtatatattatttagcatcacttgattcaaactaatacatgacttatggcattacaacatgtaagacaatagacgagaatatcattctttttatcaacttatacgtacagtatcttgaacttaacatgtgagctacaataatataaaagttgatggcttataccattttaaaccaaaacttgcctaccaaatatttggtaactttggtatatgcttcatgtttgaattgccaccaactttttaccaaactcgtgtttggcgcaaccccggttctcaaatccacaggagatttgaactttgtacagtttaaaattttagatttcattaaaattggaagaaaatattttatccaaatattatcaacgtaattgtgtgtcagggttacgaataagacataccttctatcctagaagtcataaagtatgcggatacattatatcttcaagtaaacggaaaggatccatttgaattaaggaaattgatgagtccttacgaaaataatatctacgaacaggggatatcagagtcctacttataggggataattaatgacgttgtcatatcgtgcggggtctgttgtctccaagttctacttggagaccaaggtgatctgcggtataaatagataccccctgagaggtatagggcatcgaatcttagtgcaagacacccgccaccacataagcaatccggaggacttgaagccaattcatcgatagatctcgtcgaggctctctcgacaagaatctcgtcggtaatcttggagttatgttgttctctgtgtactctgtggattcttctataatcccatataaactggattaagaatattaccttgtgaggtgcctgaaccagtataattcctatctttttatgtgctcgatgtcgtatcgtgtagatcctcgtaccaacataccccgatacccatagaatacggtccgtgggaatcccgtcgacattataaatttatagagttcaagaaaacttagatccagtgttgtgctaaaacaatcttaatatgacttatatttacaatatcttattaaacattgcttgtgttaaaacttagccaaagtttaacagtagacaaccaaaccgacactaagtatatctttaagagcgagtaagtaataactttggtatatggcgttattccacatttcctaagttcgaaaactattttgtaataatacacgtaagttcaaaaactatgtctacaacattcaacgttacaatgtcatataacctcacaaattattgctgctgtagcggttccaatcgaaaaacatcaaatttcgtcttggagcaactcgatagattatggagaaaatctcaaacccctaagtagaatcataaaaaaaagaatgcgagagaccagatcagataaagagtctatttgagagagtttatggtcctgtagtttcctatctggccttaggttataagtcctcagctatttgtcatcttgcttaaaactgtaatctttctcagactgtaatcttttatgaattaataaagctccttgtattcgtcgaaaaaaaaagctttctcaaaaaatttagattttcgttcaaattaaaaaatatatagtcaaataaaaataattgtacgatagaaaccgagaaacccaatttgttagattttcagaaaatgattagcaacgagctttgcctttgattctcctgggtcctggccatcaccgactcaccgtgcggtgctcgcacccccacaaaaccggtcacatgctgcgcataaatccatccaccccatcacgcgaccccacacgaccattattcctcctcctctctggagtctagtctcctctcctcactcctcactcgccccactccgccgcttcactcgcgagctcgtcgttggcgccggcggcaatggcgtccccccgcgcgctctccctcctcctcgtcctcctgggcatggccctcgcgtcgttcccctccgccgcctccgcctcccgcgacctccgcccccgccgcgcgggcttcgtcgtccgcggccgcgtctggtgcgacacctgcctcgccggcttcgagacccccgcctccacctacatcgccggtaactaaaccacacttactccactccctcccggtctgtgtacggactcggtcccccgtcggtgagccgggagctcagcagttgtagcctgcagtaggatctcgcttaatgctgaagttatcactctgccaccgtgtgttgtgtgttcttgcctgcaggatgccagcattggccttttttctgctggtggttagttattttcagatcggcttgcggaatgtggagtttgttcgagtagatctgcaaatctaagctaagtgacgtgcgtgtctagtataaatgctagaacctatggtttggtagaggtgctagatctttagattccaagaccggaactgccgaattcgagtctgcaatcttcggttggagaaactgttttgaacatttgttcaaataccatccagatggttacggaaatttctcaaaaaaattgtcagcattcatacaacatacatgtaccactccacagattcttgagcctggacttaactcgcacatagaggaatagaagacaaattcggaagtatatgaacagtacctatactattcgcaccagacttgagtcttttttgtgtagtgggtggtgggatctgcgcaagacggtactgatttagggtgtgtttggttctttgccaagctcaaaccataccaaaattctgggaatggcaaggttgtgcattgccaaaaaaagaagagatggcaaggttgctcatttggtttgttgccaaatcttttgaaatgtgcatgggaatgaacaaaacaagcccttagtttcaaggtggtgctgaagggtaaaataatataaacatcttaaggctcattaccttcaggttggatggtccctcagaagattaaggtggtgtttggatccagggacttaactttagtccatgtatttagacactaatttagagtattaaatatagactacttacaaaactaatacataaatgaaagctaatttacgagacaaattttttaagcctaattaatctataattagagaatgtttactgtagcatcacataggctaatcatggattaattaggctcaatagattcgtctcgtgaattagtccaagattatggatgggttttattaatagtctacgtttaatatttataattaatgtccaaacattcgatgtaatagggacttaaaagttttagtcccatctaaacagggtctaaacatgtgtgatcacaggctgtgtgctgatggatctgctactgaacaaactagacctgtcatgaatcagtttgtaaccatggtttccctccagatttccttcactgaatcatttataaccatagttctgaaatcaagcaacaatcagttgtctcatgggttagtgctcggtttcttctagccatactagatggaaatttttgggtactgaactatgccgactttcacaaaatgctgggctggatcaacattcctgactatgaaaagtttagagccatgcttgtaatacctgccaaaatgttgcatgtgtttcatatattccattctccaagcctgttctgcctaatgtattgcatgattcattgttgtatcaactatcaagggctagaaactctgcatatttgtaaaccgaagtgtgacatccatggctattttactcaacatttgcaatctagatgaccaaggttttgcattatgactaaagtaacaacttttaagataaaccaggtactgtggggtctggtgcacttttatgtgaaaatacatggttacgtgaacctgcaagacatcagttacaaatcttatctgcaaaaatgttgtcaatttgtggttgctgctatgtgctacattaggaaataaggaaaccacaactgggctgtagaataagggaaccatattaatttgagcagaatttttttattaaatcataagctaactcttgatgacataatagaaactaaatgcatgtttttgataacctctgcaacgcctgatggggtttaagtcagcttgcaatttttttagtatattatagtcacataggtgactaaattcttatcagtacctttctatggctaaatatttgtatgttgactttccttctatccatccatccacaggagcgaaggtaaaggttgagtgcagatcgaaatccactggcgccaagacatgcagcttcgagggccagactgaccacactggcacctacaacatccctgtcaacgatgagcatgagcacgagctctgcgagtctgtccttgtgagcagcccggacgcaaagtgtggcaagattgttgctggacgggagagggctcctgtcttcctcaccaacaacaatggtgtgacatctaatgttcggttggcgaacgctctgggcttccagaaggatgctcctcttgctgcgtgcgcacaaatcctcaagatgtacgaggaagtggacgaccgcgtttgaaggatgtgagttatgtatcaatattcgtacgttgttgaaatactctaagaagacttctatataccttttactgagagcaaaactatcagcatcagatgttgcgtgcttgataagttgtgatatagcttagcacttgagtatgttatatgtatgttcgtctgcagctgaactgcaaaactcatcagttactaaatcgacatgttgtgctttctatcaggcaattcttctgttatctagtatgtgtgcaattgtggttatgcattctgaaatggttttgacctaagctacctgatgttgcttcagagggctggagcgccaaagtttggttgattggttaagttttgccgtttcgtaatatggatgatgacccaacaaaataacaaactgcctttgatatatatatgttcctttcttgttgagattgccaagctgcctaaactttatgaaatactggtttaaacatgtaatcaacaagggtctgttagcttaattaggataggatagcttccttttacaagtacataaatcattgtattattggaggctacaggaagcagttggtcatgtgaataacagtttcttctctatctcaatgagctacagttagggcaacaacaatgtatatagcaaaagtagtccatatagatgggacccacatatatggactataactattgttatcttcacaatgtatatagatagcaactagtattaggaggagagaggaaatagagacaaataacatattttattctatatgggcaacctatatgctgatgggtagcttttgctattttcttactatggactagttccacaatgtggtgaggtagctgaatgaaatattttattgcttatggactagttctagactatattgtggatgccctcgttacatgttgtcttctatctgtatgtgaaggtaaacaaaactattttagctaatccaaactcaattcgcattaaaagaacacgaatgagatatactcttttttttctggaaataataggagaggaaagaatgaagaagataacaagaaagaaaaataaaggacactgcacgcctcagttggtcagtggtcaccactaaattgagaaaaggagcattctattagcgtataattaattaagtatgacctattttttttaaaaaatagattaatatgatttttaagcaactttcgtatataatttttttttaaaaaagacaccgtttagcagtttgaaaagcgtgcacagaggagtgagttagtaataactatgaataccgaattcagccgcccctaaacaacttattaacgctgacaacacctgaaaatctgcgtttgtgccgttgtgtacatatatgtcttccacgtgagttggaaaaaaaacaagacacctaagggatcaggaacgatttgcacaattagttacttagcaatttcctgcgcatgagttttgacagacaaaactagttatcataaagtgcagtctaaattaattaattggtttggtttgagcccaacatcattaactataccgtataaacaaaaaacaaacaaaaaa

SEQ ID NO: 49704 - DNA, 4044 bp, Oryza sativa
atgggtggattgagaataaattactgaatcaacaattatgcacacacgaacaagcggacttcgtacggtggaaaaaggaagaaaagagtatcgtgcttttaaagtagtagagaacgtagagttagctctaccttacatggagaaaaccacaaaccactagtcatgcttctatttcttttctaggccatagtatatttgggtccctcaaactctcctccaagtctaattttcttccatgcatttgaaagaaaaaaaagggtatgatgcaatttaatccaatatttagagttattttttagcttaattaggacaagctttgattaaaaaattttaaaatcccaatcataaaataagtttataaagtctaataagttcatgttgtcataatagtgtttttaggcaaatctacgtatacaagtttttttttaaaaatatgcatttaaaaaattattgattataaatgttaaaacttaaagtcaatcctgcgataaaaatcaaataacttttaccagagtagtgcccgactacctgtatggctgtattacataggaggccttaacagtttaccttctctggtgaaaatctatgcttggattggctgacgcctgtctcccatttctgtcctctcccctaaactttcctccgtttcttaatccttatcctcccatctctttattgttatttaatcacacttttacgcttattaattaatctacccgctgaaaaagcgcagccacccgtggccatcaccaaatctgtcacgacatgacgcgagcctaattaaccacttcgtacactgcatgattagccgtcccctaatccgtcattagcctcttaatctttaatttattttttttggcctcccgaactagccgtggccactagtttgtgcaaattgttaacaaatccagctccgccctccgttgaagggtggccacaggattcgtttaaaaagtttatcgcctctccggtgtttaaattagtttttttttggcttaattttgacctgatcgagattaacaaggttatcaccacacatataatgcttgcaatgcttggttagattgatgagccgttgtgtggagatggaccaacctaaacggttttttgtagcgacaagtgcaacgcattctcattattttttttcatttttttggcttctgtcattttcttgtggattagttcattattacaagaatgtgaatggatttggttatggctgcattgtgcgcattatttatgaaggcatagacagatttgttaaatataagtgctctacagattatatgtattattattaatgcgcaaacttgtagttaattaacacatagcgttacttatcttttacatttaagtagtgtatgaatttctacgtttttaggtatgcaatcagcgggaatgttatatatgcaattttatgattagttttgttgtccattcagtaagaataagtgatatttcaagatatatttattactcaatttacttattagtctgatagatcttgtccatatcttaacgaattttaagatactatatatctgattcaggagtggaaattagattgctttggaacttttggttatcgagaatcttggtccactcatgtttatcattagattacaaaatcgatcgtttcttatgatataagataacaggtattctaattaatctattcacactaggtataggtaacagaacaaaaaagtagttatttggctatctttattggtcaaagtattggaggttcctgttcctttctatttcatgaaaagttcatttaccactttattcttttttcctgctctacataaactgaaacgtttatatatcctggatatacattttttcctttattgtgtggctccttgtgcagattcttcgctctatgcgtatccattgtactctataaaatttcatagttacagccacctagtatctcttttgactaataattgaaccgcacacgtgtaaatttataccatacatcttttatatcaagaatacgtttcaaccgatgagttatcatgttgctccacacatttttttatagaaaaaaaaaccctatgggttggtatgctcaaaagaaaaaaaaatccaaaacttgcaactcttgcaaaattgcgacatttggttcgaagatgaccctagaattacaacatatagcatatttttccctttctacttgctaaaaggatcaaaaatcatcatggagatgcattattaaaataacacggagagaatataacaagtgaacaaaaagaggggggatttttaatttgcattgccttttggctttctgtacgcctggctgaggatgaaacgatgaactgttggcctacattccttatgctgacacattgatggatcacgccatgtccaatcaaattgcaaaccgtcgaccagaaaaggtctccctgcatcaaatcaaattgtaccggcggcttctacatcaccatcgcatcactatttgctcacacttatttttttctttcttggtatttgatttcattcttccacgatcatataccttggacttaaaccaacaattttggaactccatggaaagcaagagttttgtacacgtacctccgccctaaaatatactactccctttgtcccaaaatataagtattttttgccactgacatggtctctgagatgttactttgaccaacaatatttataaaattaagatgttttaaataaaaagagttgcattttatgatagtttgtttaatgataaatctagtaacatcaattttatatgtaatcttttttttattattattaatagtcaaagttaaaaatgtttgacttgtcactatactaaaaatgcttatattttgagattgagggagtagctattattaaaatatacttagctacctagtaactgtattttaagatggagggagtagaactttcacaaaaattagtagttcaattctgacccaataaacatccttcaaaatttattcatccatcgtcataattttaattatatgcacaaaaatgtttttttaagaaaaagtgataataattaaagtgataaaatatgcttttcatccggcccaagcttcattgacaaattgtcttgaatttgtacagtacagcatgtgccaatatcatctgaatgaacaacacattgtacttgtccatatcgaattcaatattgaaatcataggacaacaagtacatggaggaaatttgtgcaaatagaaaaaaaatcagcatgcaaaaatacaacttgccatgaaaaaaaaatcacatcattcgtcgtcaggttcttccgccattggagctccatttctcagccaatccccagctcacacgtgccaactcttccacatatgttggttaggacagtggacacgtggcaggagaggtgccacttggcactttcccattgggtgagatcactactccctctctgcctataaaaacaccatggagctagatagcaagctttgcttattcactcattcaacttccaaattaacacgattcttcttgctgcgtttgctgatcgatcgcaaggtagaagaagaagaagaagaagcagccatggatcgccaatggcgttgcctcgctgctgcggcttctactagtggtaatagtaagcttcctccgctgccgatggcgctgggcggcgccgtggagtacgggcagctcgtccatggcgcggcggcgcccgtggcgccgttcttcgtggacgccgagcagcagagcctgtcgccggcgacggccatggttcttggcgccgggtggtataactataaccttgtcacgccgtcgcaggcggcgcagctgcaccaccggctgcgacgggcggtgggcgcggcgccgtgctcgatgaagcggtgcggtggcatggcggcggcggcggcggggcggcttgcgctggtggggccggcgccggtgcatgcgaagctgtaccgcggcgtgcggcagcggcactgggggaaatgggtggcggagatccggctgccgcggaaccggacgcggctgtggctgggcacgtacgacaccgccgaggacgcc

SEQ ID NO: 49705 - DNA, 2357 bp, Oryza sativa
attttgtttgttgatatatgtttcattacttgttcaattcaaattttgcaggccagaattaatctagtatatatatgctggttgatcatggtactttacatgtcatgtttatcctcagccatcttccttttactatggcgtttgtatactatatattagccatgtgattccaactcggtgttgacctttcttaatacatactccctccatcctaaaatgtttgacgccgttgacttttttaaaaatgtttgaccattcgtcttattcaaaaaatttaagtaattattaattcttttcctatcatttgattcattgttaaatatacttttatgtatacatatagttttacacatttcacaaaagtttttaaataagacgaacggttaaacatgtttaaaaaagtcaacggtgtcaaatatttagggaaggagggagtataatatatagacatatcctctgatcatggagcttagatatgtatatctagcacttgcataaaagcaagacaaacatatgccattagcttataagtctcccccccaaaaaaaattatttacaggtcaacctgggccatccactcagttaaaatatagtggacaccaatagagcttggacaaacaaaccctctccattacattgtgtatatctttatgttgtcaaatccctgatagttttttagttgactttgtttttaattaagggtgtgtttagttcgcgaaaaaaaaatttgggtgtcacatttggacgtttgaccggatgtcggaaggggtttttggacacgaataaaaaaactaattttataactcgtctggaaaccgcgagacaaatttattaagcctaattaatccgtcattagcacatgtgagctacttagcacttatggctaatcatagattaattaggctcaaaagatcgtctcgcgatttacatgtaaactgtgtaattagtttttattttcatatatatttaatgctttatgtatgtgaatttttgggaactaaacaaggcctaaacaaggcctaaggtcatggtaacatgcaatccaagctgaagaacattgactatgactgcatatatgcaaaaagctccaccaccggctgcggtgggcggttgtgcccatttgaattcacattaacgggcggaaggtgaatcacaagcaggagcaactgcatatgtctgccagggatggcattggcatgatccattgatccgtggaaatctgtgcggcttatatagaagttgatttcaatagagagaaaatttgcccccaaaaactttcagttcgagagttgctcagttctcctctgttttttatccatttgctctgttattgctggatttgatacagtactatcttaagatgttcgatatgccgcctttgccaacaagtggtatcagacctccatccagcgacgtagagcgtgttgaagacgagctcggtgtcacagatcagggtggtggcccaacgagaacgatgccacaacagcgcgtcgttagaagatgctttgtctcattgcgtttttttttttaatgagacaactatcatttcggcccgtattccataacgagtcagctcgagctggctcgcaagctcaatgagccaagcgcaatcaaaagaagcacaacactcattaggccaacaacccacttgacggcccaggcacccaacccaattctgcaataggcaaaaaaaaaaaaagaaaaaaaagaaacactctgaagctaactccaaaaagaccagcgacaatcagttcgcatcgtggcattgtcattgtgcccccatcggctcctctgcagcttgcatggcggccctggcacctttgcactccactcatcgggagcgatggtgcattgcagagcatggctacgtaaaaccaagcaatggtgacgatggagtcaaagcaacacgtgctccacgactcatgtcgtcacgcttgttgggctcacttccccaatcgtcacccaatgcgccgctatcccccggcgtcatcatacaatgcactcctcttgttgctctcgctggccagcacactcctctcgtcgtgtccattaccgtctcattccatgcccctatccgtgtttgccaaagaggaggaagacaaggtggaagagatgaaggaacactggctcgcaagctaaaacaagctagattgaaaaggggaacgtgggcatcaccgcattgacatcggattgggatggacttaggcttcgtcgaagcggctgaatcagtgagctaatttgtttgacgtaaaacgaatgtagcatatgattaattaagtattactaataattatatattttaaaataaatttatttgattttaaaaagaagagtaaagtacacggccagtccttaaa

SEQ ID NO: 49706 - DNA, 25279 bp, Oryza sativa
  unsure (1)..(25279): unsure at all n locations
ctctatctcatttctctatttccacatgctgctagctgctgaccaccacgcgtgcatgcatgagccatgcatggcggcggcgggcaagcagctcacagcaccttaccaagaatcgccccgccattgctgcttccgttgccgagcatgctgctattccagaaccctggggtctcatggccaccgatgacgccgcctccgccaccttggttcttgccgtggtcgtactgatgatcgccgctgctgtttgcgtcgctagccgtggcgctcgccaccagcttcaggtcctcgaacgggaacaacaacctgccccaccgcgctctcttgcaacccagcgctgcacgcgccaaacaccctggagctgccgcctgcacccgccatgcgtgtcctgggagaaaccgagcgcagtctgagcttgttgctgatgctactgtggcggtggcggcatgcggaactcgccaagatggaaccccacaactgcatattccaccggcatccctagcggccccatctgaggcagaggaacgtagtagccgatgctcctcagcaactccatcgccgagaacacgcgcccacgctgcccctgccaccggcgccgttcgccgccgccaggttgcctccggggttgcacatggtgctgctcttcaagctcgggaatgccgtgaactccggtgactgcagggcatgaccatggtgatgagggaacgccaggttgaggtcctgcgcgccctcatgcatcagcttcgggttcttagccgccagccccacggggaccgagccggacaccgccgcggaggtggaggcctacgcggccgccgacgacaccatgaggacgacgagcgcttgttctcccgtgccgttgccgtcgtacgcgcctccctcctcttcatcgttgtcgtcctcgcggccgccgccacgtctccaccgccaccccaatcgacgctgcaatcgctaaccctagaaatcacacaggaggaggatttcggggagaatggttggatcggaaatggggaagccaagatgtgggggggctaaaatgcaaatatgctgcctccgtggacggccacgtaagccagtcaacccggtcagaggtgctttggacctaaatgattcacttaaacaagatcgtggacccgaatgacgattttcctagatcatgtatctaagtgaaacctcgcttcaactttaaggaccggtcgtgtgttttactctaaaaagaaatttctatatatatatattatttttcacgaaaaactcaatttagcagtttgataagcgtgttcctgataaatgaggaaatagtctagctcaatggttctttgtaactcacctttatcccattcagaaacaagctgcgtttttttcatcggatgggttaggtcgaacccatttctaaagtgtttaatttgaggatatgtgagatgggttgatctccaaaggggaatatttccctaatattcgtgttagattcacacctcaaaatctaagggtccaattcaacccacctcctctctctccctcgaaaaaatggaaccaatccattcttaatgccaaatagtaaaactatcccattaaaaaatacggatgattttaacccatttcacctgatctctaaactaaacgcacacaagtgttctctttcaaggatggatcacgtgaagctacgaagagctagagctctagccaatggatgattttaacccatttcaccttatctctaaattaaagcattgctagttctctattatttttggacgtattgacgatcgaaattggtctataacgaccatcaatagtatgcaggtgattacttgttccaattgagagaaaacactagtaagaaagcacaactccaaccaatcagaggagagtacacgaattaaagggcccacacaaggaggagaacaacctaaacttgaggacgcaccaagcggtgaccctgacagaaaacggcgcgaacaggatcggccgaaccctggctggctcccctcggcctcagcttccacgtggcgacgattactgatctcctgaagtaagtggcgtaagtcccaaggtaggaaaccaccatctaatgtcggttgtggataggtggaggtttgagaggagctggagggagaatattcccttagcatccccactctctcaagtcacttccacaccataaataggcctccactcctcactctcaaacacacaccaaggtagaaatcaatgccacattccaaaggtgaagctctctgcaagcgcacagataccgttgtagctttcacccaagagtattccagggtgtcatatccgcagggaacgtgtgtgaactagttttctaactaaattacccaaggacacaacataaatggtaggtgaagatatgagaggaattccaatggcttacttatcttagtttaagttaaagtaaaattctatcaattgcttcgggcaccggcttacccctgatctgccaaggagactctggccttatgatgtacccgaacgtggaggattacgaaggatggacatggctatcaccaccagtcatctacctctacaacccgtggggcacacaaaaaacaatggtaatctctagcctagacaccacatctatgctattaattactaccttaatctcagtacaaagttaagattaatgtactctaccgaagcagcgcaatgaacccacaacgatgagaatatatcttacttaaataagaagagtgaataccataatgaatacttacttatactagaaaaaatgtccgtgcgttgcaacgggtaagatgtttttgaatccattctttggcccaacctgcaggtggagccgtgggtctccatcttctacctccacgagatggtgccatgcacatatgatgtttgagctgattctccccatcaaatctggccgaatgtttttcgatctcctaaaattggtttagggcttttgatctactcgatcttctctttccattttttccaaaattggagcgaacaaaactcgggatcaaaacggttgaggaagcttactggccggccatcatcgacgacactggccggccatcatcgacgacagttaaatggagattaaatccgcccaagccgaattgtaggggaaaatcatgggaaaaatgatgagggatgagtggagaatcgatttttgtaatcaattagaggaggaaacgcatggggaggcagattgacatggcgacggagctagggttcggcctagcgaaggaaaaacacggattggtgacagccaacgtgattaatttatgtaggactaacaatgcacttcttcttgttgctgggtgtaacaattttgttcagttttaatatttctaattaatgtaatttaaattagctggacttataaattttttacccattagttgaaagggtaagttaacctgaggtaaccaaactctaatatatgcaaccaaccaaacaagattttccctcatgtgcattcatccaaccactataccattgcatccaagatcaactgatctaaccagccaaacaacatcaattgtacacacttatccatgacacggtaagccaggatgatccatacgggctatgctagactagtgcagataaacaaacacatcttagtggttcattccttgtgtatacataaaggtatatagtttaaggaaacatagtagccaagggaacctattaagctgctaactaacggaagaaaaatctgctaactaagggaagaaaatcttttatagttaaagaaaaaaaatactgctagcttaccacctaaccctctagactaactcacaaactatagtaaggattatactaacaaattattcttttgtggaaaataatatatatttttttatgtagctagctagctagaagttctccttgaatattttgtcaatgcaatctaaagacgcatatggtcatgatcttcaatcacttttaagacctacatttaatatcttgtattgaagatgtcacttctcgcgttgtagattagcatctaactgaagacatagattctcaatattgaataaggtataggatatttccaactagaatcaagtatctgagatcaccttcaggtatgtgccacttagcatggtaatctccaccacaaacacattagttatatcaatattaacatatatacctaaaagagtgaattaattttaagaccaaggacaatcatatgcagtgattctacatatactgagtggataatataaatggataaaatgttgttttttgattgtttcgaagaggtgcatcttcaatgtcatcagaaaactcgagcatccacagtgacaaaaggatgtaatgctgcctagcttattatcctcaactattgtcatcgacgaactcgatgttaatgatgcaagactcgtgagcatatctctattttatagcccacagatttttaaaatcaataaaaagcataaagtatgataggttgatatattagaaactaaattgcatgttagttctaacactctacgaatacacaaaataacataatcttacatacttacaaatccatcataataataacgttacatacttacaaaagaaaagaaaacagcagcggaattaacggtctagcgatggcttcagctccactcccacaggcagctcaactggggtataagccaaatggtcaaactttaaggacgaatttttccgacaaaaatgatttgtgaaaatttctcctttcttccttatctagaattctttgcaaatcgtttcattgtctactctcctctctctttcaacttgagtagttctaaaactagtggtggaaacttgaagatattgatgtggacaatttatggaggtcagtcaagtggatcgaggaagaaccgaagtgccaagtggtcaagatagagtgaagtttggaacctatcttagaacctatgccgccaaagtgtctttgaagaatagttagtagggtagaacgcttgttgtttgctttgtgtgtaggtatggttgcatttccatcattggagaagttcattgatgagtgtgtgactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagttccgggcacttaagcaaaaggatcgtaccgtggcagagtatcttcatgagttcaatcgtctggcacgttatgctccagaagatgtgtgtactgacgaggaaaggcaggagaagttcttggaaggcctgaaggatgaactgtcagttatgttgatctcccatgactatgttgattttcagcagctggttgacaaagcaattcgacttgaagacaagaataacaggatggataaccgtaaaaggaaaatgattgtattccaggaggcacaggatagtagccagaggcagcgtatcaagccactccaaattggtgaatctttttctgcaggtcaagaacagtcacaacaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattatcggagttatggaataagatagactgcagtttacctatgcccttttctttctagccgttccgaatctcgggacgagattctttgtaaggggggtagatttgtcacatcctgattttcgtttcaggatttataaattatttaataaattattaatagaatttatattaaatgttcattaatttacaagtgaagttaaatgtgggaaataaaatttcctaaatataaagcatggatggatttaattttttattaaattctccatgattaagtcaactctctggaatattctcggatttttcggagctcaattcctaatttttaatcttacaaagagcatttcagtaattacccacatattaaattaatcattaaatggtctaattataattttgttaagtactttgagtgtccaagtattttcaagatttttcttggaattatttgagcataggaagtattcttaacaattcaaagatcatttcagtgattaatttaattggaaaagtatttaaaatccccttctccttttcgggccgaaataggaaaagttcagcttctatcctcggcccattctcccttcctttcggctggccttatccctcctccaaagtctgctttgtgtccctttttcaatcgggccaagaagtagaagcccagcaaaaagtctagtttgcctccctgctacagtgtcatcttcaatctccagccggctggagacagagcccgagccagccgcacagtacctgtatagccgcggttttcccctccaaatctgacctttccccttgtgtttttctaaaattagttgaggggaaatattcctcttatcctcctctatctttacctccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgtgccgtcgcctccgtcgtcgccgccggtcgccgtcaccgccgtaaggtgcgccgaggtgtggagaagcccggccgctctctccccgctgtcgccggtcaccggagccccgtcgccgccgtcgaccgaagccgtgccgccgctagacctcgtcgccggccgtcgtcgttcgtcgtttggttcgagggtgagtaccgttgggttcgtctcgtcgtcctctacgtgttcatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatggattatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctttcacaataattatggatgttataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcatatgcttattcttgcaataatcaatcaacctcagttgaagaaaaaggatccagaaggagaagacgtttggcttataccccagttgagctgcctgtgggagtggagctgaagccatcgctagaccgttaattccgctgctgttttcttttcttttgtaagtatgtaacgttattattatgatggatttgtatattaaattgtcagtttgtgtacctcggctgattcctggacgaggattttatgcacaaataagttcggaaattactagtgaatttccgggcgtgacacgccgtcacagaagatcctaggcgctatccttcgtccatgttgtgctgcccaaccaggaacagccacgcgtcccgcgccgtctcctagcctcagaacttatctgcatcctcctactttgcaccaatagccaattgacatgttgttgcctcgatcccttgcgtcgtatggctccagcatgagtgcgtccacaggcgaggcgagacgcctctcccgcacccccactttgtcgtgcgcccatcaatctgaggcactgctgacggtcgttatagacaaattttgactgtcaatatacccagaataaaggagaattaggaatgcttgcatgcatatttgtttaagaataatctatttccgacaatttccgatcgccacaaccatcattggcagcctatttaaggacctcactctctccattccaaagtgcaccaagaaggatcaaatccaagaagctctctagtttatttacattgttctagtgctagtggagtaggatagaatagtttctttagttcttcaagtcttcaggagattttgggtatgtctctagtagcttttccttctattttaagacactcattaatgaaatattcttctttatatagttttggtcttatacttcactcatattattattcagctgccgactttaattagttcatatttatcttgtaataattatgtagctagcttactggaaatatgcaatggtgttggtttaatgttcatttatatgattgctctgtgtcatttgcaaagatgtagagtagtatttagtaatgtaagtgctgtgcttttattattagataccattaaatggtgttatatgccacgggtctatagaggtaggccactgatgggagactaggactttcccaaaaagaaaaacaatgcaatgccgtttcaggaaaagaacggaaacggtcccgcgaactgacatggatacggttcgtcatgcaaaacaaaatcgcggactgagaggggagtgaattgggcacaattcatgaccaaagcaaaggaagaaaactattagcttgacacttttaccttagcaacattgcctccggtgatctgatatttaatctccggtgacctaagtcatgttagtgattttcggagcaaagagaactcgaaaaaaaaattatccctgacaattccaattattaaatgtattattagctggggttttctcctggttaaccaaagcaaattctcgaggccatttatttgtgatttggaacctaaggaaagggaaaactccgggcgtgacaatagtttagcaatatgtcctctttagattaatattgtggccaaggaaaatatagaggtgttttaacaaatgttagtgtttcttgaatatctacgcttgctatctacattttacttccactaaggcaactatggatgatttttgttttggaattatatgtgatgaccatttcgtgcaagtgaaatagatttaaacttcgtgttttgcagagcacatgaacttctactgcacacatggaaggagctagttgtatacacctcattggtgatgatgtaaatgctattttcaattgatggccatgacgggtatatttgaagtattgttggtgaagacatcgagtcctttttatacgattactgtagctaacgtgggaaacgtgtattgcacgtacacaaattactagtatttgttaagctggcaatatgtatgtatatgataaggcaaactaatactggttggtaggtttcatcgcatgctcactttgcaaaagtccgtaactttacgggcccctttgattcaaaggattggcaaaaggtttcataggattcaaattcctatgaaatgtttcttacaagaccctttaattcataggaaaaaaagaaggaaactataaatgtattcatatgcttcactttcatagaaaaatagcaagaagtatgacctatttgtaaatttcttttctttttgtatggaactatcaaagaggccatgtcctattttttggttatttatagtcccataggattaacggaattgctattcgtcttgcgacagatttgtggctcctgctgatctttcgttttttgcgaaaccgcttcacaatatgtgcattgcatatatgttatggtgatatactgatatatagctcccgccttctcgttcaagcaaccattcagaaatttcggatagctttagtatatgtcttttatatgtcagatgccagcattttgcaaagcaaaaatgcctcatacgccaaatgagatttcgtcatcggatgaatctggggttgactactgcaattctaattccgaccgtgaaccgtgcaactacactgtaagtggtctgtaactaccctttaaatgatactccctccattccataatataaggcacaaccactttttttagatgttccataatataaggcatacatgcatgcatgccattaactatgacatattctccattaaattactactttttaaaatccttcactctcacatactctaactctattggatgcatgtattatatttattaggatgattcaaactacaatatgataataattatttcttggttttgggttaagggtggttgtgccttatattttagaatggagggagtatgtaactacgtagaaaagtggtatgtaactattatgtaattggtatgtaactacactataagtgctccgcaaactataagtgctccgcaactatcctatggctgcgttcgtttgtgccggttaggggtctatccctctggcacggaaaacagaatagcttattgtcgcataattaattatgtattagctaaaactaactttaaaaatggattatgattttttaagcaattttcctatagaatttttttacaaaaaacacataccgtttagtagtgtaaaaagtgtgcgcgaaaaacgagggagtgaggttggacagcctataactagtattaactacattgtaagttatctgtaactattatataattggtctgtaactatagtgtaaaagcaatgtgaactgtaactacggtgacctgtgcatggttctgtttttttcttttttttatggtcgagcaagttgctatctgtgtgttatatgggaggataagttgctgtctaagtaagttgcatcttcttcgcgaaaaaaaaaagaaataaatgaaagtaaattatgcctcacataaaaatattttatataaaatatggaaatttttagaacaaaacatgactccatggcccaatggataaggcgctggtctacggaaccagagattctgggttcgatccccagtggagtcgtatcatttttttttattttttcctaacaaagtagaattcggctttgtgccaagttggccatgtatgttttgatattgctatacacaggatttttttttcttcaaggtggtatttgtgtattcagaaattcttgtcgttgttcagcaacttgacaaaaagtttgtacggtctaatctattttactttctttttagaggagaataatcaataaaaaatacgccaaataattaagaagagtgaggcctcgaacccagatcatctagctcatcaccttatgaagctagccagaagatacgtgggcgtttctcgaataatcaatcaattatctcccatcccaaccaagacctgactagcctcttttaagatcaaacaaaacactccccgcaaaaaaaaaaaacaaaacacgtcaaacacactacaacgctacaatggcaaatttacttgcaaattacatagaaatgctacacccagccccattcaaagctaggcatactcttgaatcattaatacaaaccgaggaactgaaattcatcgatcagtcgaaatcatccccctcttctccatatggagttatggacaatacaatacccattcaagggagtccaaatgttcttataatccgcaacgtaatctttagtgctatggtataaaagcgcataattaaccatggaaaatgccaaactcatcgttatcaagtaagatggggcagcacacgcgcacgccacgctcgtcctggattccggcatcgacctccgcgaagatctcagcgatcgactagcgtggtcggggagaggacacggaagttgtagtggtgataggttgatccaaactcgtcggtgcttatccttatatatatctctgtcgaatccgaagtctaagttaccatgggcacttctaaattgctagaaaattagagtcatatgaaaacaaaaggaataaaaatcttcgagagcatgcacttctggaagattccattttgcatattccaaatactcttttctcttttgcactatttcatttgcaacactttaacaataacaataaattcccatcaagttcctaactaaagtcaacaaaagaatatcaaaacgaaaaaaataagtagcccttctatttccttttgaattgcttgagaatatgtctagaaatttactgataacttggaatgatcacatctaataaatcacatacacatagcgagaacttttatccacttctccatgtttgagagaatgcaagaaacaaaatgagtccaatactgaatatatttgaaaagaaattagattatctaccttctatgcaccacttataaatctatagaaaattatactagttctttcatatgaaaaatttagaatatgtttcatatcaaaatattatgaattctgattcttagggttaataagaaaatatcgatatgtcataggttaaataaaaaactaactggccttcaccaattattttatattatgcaaaattgttgtattctaaaggagaatatgaattgcgaaagaatgctagtaggtccaataggaataggtaaggtgccgccaatcgatccaatcctgaggttagactcatgagagctagccaagggaattttgtggtttttcagttaaagaaatatattattacatgttaatttagaaattaataacccatcaagtggtccttctaagtatcggtagaaattcaatgggatataactaactccatgaaaaaatttcttaacttttgtgtatgttaaacatgacataaacaatatacattgactaattacaaaattacttaacaaacatcttataaaataagaaatataataagaaagtacagaaggtatgatatttatactttgaaagaaaaaaataaatataactttttaagaacaaaaaatgacacataagtatgagctatttgctgaaattaaacaaaacatatattattttagattttttataaggatgacaataatctatctatctattatatactaaaagttcagtaagcttccttaaaacactctcaagatgccacgtggcttcctaaaaaatgctctcaagttgtcatgtggtgccaataaaatctatcccttgatttttacttaattctatgggtccaatactataaactactaggtgattccctacgctttgttgcagaaattagtaacttctattttttaaaaaatcaagctaaaagtaaaaaaaaaattagttattaacaacaaataaaactgatttgtcaaactattttaagagaaataaatttagtagactttgtatgaaattatagatgaaatatgatgtcctgtactttgattatatggattatatggatgaatatatgttaagtattataaaaatgattgatatatatgttaaaaaatattgtgaaaaagaatgtgaaggaagatgattggatattgatgtgtagaactcaatgaattatagatgttattgcatgcttgtataagtttatatgtaattattgctagtggataatgagatggcatgtttgtatgttgagctttagaattagtgggttataactttatagtaagataggattagatttgattaaatctaaaacaaaccagagatacaacgtcaaagtttgtctttgttcaatcgtatacgtccatagcagcacaacggttggattaccactactacatgatatattttcctagacgccaccccttttgtttccatgtggtccataagtagaaccacacgggaaaatagggggaccgacgccgggttgtcccccgcacgagaaaatacatttttccatgcgggcatcttaatccgaccgaataggatcactacgccagattctcacacctgtggcggcatatctgtgacggacataagtgctggtcagtgatgagggtcacctttgacgggtcctacaacatgtcatcatcggtgagccatccggcggcgacccatcacaggtaactagtcacctgtgacagtccaaaaatggaacccgtcaaaggtgagttaaagtcacctgtgacgggccaaaaatatttagcccgtcacagctaactagtcacctatgacggtctaaaaatagaacccgtcaaaggtaaggtaatgtcacctgtgacgggtcaaattttgtgtgcccatcaaagatgataaaaaaatcgctctcataaccctcccctcttcccgtgcaactgtatcgatcgatccttatcctctcccaaacacagatagccacacagggatccttatccttatcctcttctctttcaatcactccccccctctctctctctctccctcccaaccctttctctcttcatcggcggagggcactggcgccggcgggtgcgcgggccgtagggggaggcggcaccggcaggtgcgaaggccgaaggcggaggtggcccgggcgggtgctggggccggatgtggaggcggcaccggcgtcggcgccagttggaggccaggagctcggggttgccgcctccttcgccggagataaggtcggcctctctctgtccctttctccaattctctcgacttctcctctctctctctctctctctccttctctctctttgtgcagcggcggccccatcgagccaaagatgaagacaacgccactgcccaacgccatcgacaagccccgccatccatcgctgcttatctccagtcgacgacgagcttctgcatccccacctggcctccccttgacagccccagcaaccatgaacccgggggctctagatccggacaccctgaactcgaaggtcgcggatccagccatcccgagtttgggtgctccagatccgtccgcgaggaaagcagtccgccgtccacaccactccgcgtcgtcgaggtcaacctgccgaggggagagcaggcgtcggctatccccttccaccccatcgtcggtagtcactgcctcctcatctattttacttagtttagtactaagcagaagtcaccctttccttctcttgcgtccagatctgagcttgcagtcaaccgattctagcatctcctgtggctcctgtggctaaatccttgtccaaggatgcatctagctttaaccccaggcaaaaatcacgagctactggatcattaattagatgatctttgtgtactagtattttgtttggatagtgggcatgctgtttcgctttgttttcttgttctatttaagttgatgcatcactagatatgtttttattttccttattagacctcttaccagaagtttttttgggtgtgttcttggatactctacaaattccccaatttctatgctagctgaacaaattagacgctagttctttctacaaatggtaagcttcctctgctagttgatgtatttccgtttctttcacataatatttaactactgacatgcatatggatgactatcaaggatgggtgaaaggctaatgaatactaatctgaggtaaacttctctgaatgatgtcattgcaggcactgggggctgtactcatgatctaattgtaagtttgtatgttataccatattcgtcaggctcagaaaccaaaagaaggaaatgctatgttcaagtttgtgtcacttaggctgtatttctcatttttcagtatgttggcattgaagtatgattctttgtatttttgataaccctgtgtgcatattaatgagcacggcatgaagtatgttctcttcttttctggatttatttgtggtgctttgaagtatcggcttggctcaattcgagaacttgcaatgcatgtgtgtgaatgtctatggattttcggtgacaacatggaatgcatgtgatgttagtttgaaacttttaatgcaatgggctgaaactggagacatatatattgcatgtgtatgttctgtttttaattccagagggcatgtctagcaaatcctagggctaaccaacatttagaaattatttttttctagatgtaagctcatcactgacggttcatatcgcaaaagcctgtcacaggtgaccataccagtgacggctttgcacatacatgccgtcacaagtgacacacctgtgacggtttttactctttgagccgtcacaagtgagtcatctgtgacgggttgcaaaatggcatgggttagtgcagacacttatctctgacggaccgtagagttctagcccgtcagaggtgactgtcatcagtgacggtcttccacccatcaaaggtgactgtactcaccagtgaccactgatcactgaccaagcccaaagccgtcagaggtgagggtttgggcccgtcacaggtgaccttgtccagtgtagtggataatcctcattatcccgtgcggtcgacttaagaggaccgcacggaaaaatcaattttcgcgtgcgggcatattaagtggaccgcacgcgaaaatacatctccctctcactcactttaaaattttcacacctctccctcttactcacttcaaaattttcacacatctccctctaactcatttcaattttttcacacctcctctcccttcctttttgttttcactcccctctctctcactttcctcctctctatctgtctcactttcactcctctctctctctatctctctctctctctttctcactttctcttctcctatcctctcctctccgcaggaggcgcgcggccggctggcgacgaggcgagcggcaaagcggcaactgggcaggcggggtgaggcggcgaccgggcgtggcggcggcgaggagtggctgtccccctcctagatccggcggcggcagttgacccccgcccggatctggcggtggtggcggccggcgcgactgtaggccaagtcggcggcggtgtccacgatgttgctcatgcccggagttgatgtcgcaccggacgtgagggaggaggaggaggaggtggtggtggcagcggttgcggctgcggctatcggctggagcgggactgcgcggctgcggagcgcatggggcaggaccagctgtaggacgtcgatgacgtcgtgcaccacggcggcggtgaccttgccgccgacctgccggtggcgaggaaagactcgccgcagcggctggttgcgtgcgggccggcgggcgggcggcgattttcgctttttttttatatttttggttttttttttgttccgtatgggcggtataatttgaccgcacgggataatcgattatcccgtgcggtccacttaacccgaccgcatgggaaaatgattatcccgtgtggttgtgacgtccacacgcgaaaatattgatttttccatacgcttgggtgcagacgggcaaatcctccacatgggaaaattattttgaccgcacggaaaaatgtttttttcctagtagtgtacgttgttcacaaaatcacctagagttcctctttttctctaccagtaaatctatttccttgtcaccatagctgacatggctggttgcattgttgtggaaatctcatctctactcatattcacgagactcaaacaccagcattagcacctaggttgtatgtggttttcaaattgattaatctttggttggaaggagaccagcttggttagcttcgctgaccttaaatatatattatcttctctcccccgtgagcagttgctcttttgatttacgagaaaatcgcttctgtacctctaaaatttattttagttaatcttttctatgcccctaaatttaatttgcttactttttgtataacccaaaatttaattttaatcccttccataaataccccttccgtcagttgaccgttagtgaccgtctaatttctataaagatgatcattttacactttggatgaacatagaaattcatgaattacattattcaaaatgtaaaagtttgtcgcataagactattatagttatgagtgagtattcagggttataaaagggattgagtgagttttcaggggtatatagggtgtttactcttgattcatatcgcaagatctcctggagtgtccaagggcgagactatgtgtgaaggtgaggtaacaggagaaataagatgaaacaaatgaaaagctaataacaactgcagaagcaagcaagcagggaaagtaaaccatggccaaatacaaaggggctcacgttggagaataaaggtaggagtatagcagttatgagtttcttcacatagtatttgtgatatataagctacactaaggtagcagtgtgtagttggtttaaaagttatatttgttgattttaaattcaaattttaggactcatcttgactaggtattttaaagaaacaatctctaggatttatatatctattgtctttatttactcatatgtaatagacatcattaaccaactagaaggagaagtagcttaatggtacaaataaaaaatatttattatcaataataatattttatcaacttaaaatggaaaaaaaaaccttattttgaatttagagttagacatgtcttttaaaaaaaactaagttaaccctctttgtacataatgaaaaagattacaaataatttcttataggaatgaattcaatattatatagtttgaagttaaaaaatggcttgaaaaaaatttaccaagcaacgttgacgaagaaaatttgtggagtagtagttttgaagcttagcaagtgttatccgtttcatattcattccttattagtttctcaaacacaacttacaatacatatccatgcaaatacacgggctacttcctagtctttataaaactcataatataataactctgaataatgcagtcacgctaaggctgtgttcgctaggggagaattggaacatgcacagtgtacacggaaaacggagtagtccattagcgtgtgattaattaagtattagctattttttcaaaaatggatcaatatgattttttaaacaactttcgtatagaaactttttgcaaaaaacgcaccgtttagccgtttgaaaagcgtgcgcgtgaaaaacaagaggggagtgctgggaacttgctcttgcaaacacagcctaagagcaaggctaataatacagccagctgcttactgtatagatctttatagactatctctcagctcactcatatagtggttagctcttcattatataaatatatggtccacatgtctgtctcacatattttcttgattcttgtgcctaagccggctgtaaacttacagcccgcttctcatctctctcctctcctctctgatccacctcagcattcagccttcttatagccctctattatacttgttctacaggtgtgttctctgcagggtgttccctaccggaacagtgcgcacgaaaaacggaacgatctattagtgcgtgattaattaagtattagttgattttttttcaaaaatggatcaatatgattttgttaagcaactttcatatagaaacttttttcaaaaaacacaccattagcagtttgaaaagcgtgcgcatggaaaacgagagagatgggttgggaaacttggggtaagaacacacgagaatcctaattctcgcgcgcgcactcccggcccacacgccccacgcggcgcgcgcgcgattttttttcgctaacctaccgccattttcttttttttcgttttcttttttccgtgatttttttcgctttcctttttttttgcgtttttttcctgattactttttaatcttccagcagcaagtgttttcaatttttttgttgaaagtttttaaatctcgagttgaaaatatttaaatctcgagttgaaagttttcaatcccgagatgaaagttttcaaatccaagttgaaagttttcaaaatctcgagttgctctcaagttgaaagttttcaaatccaagttgaaagttttaaaatcccagttgaaacttttcaaaatcttgagttgaatgtttccaaatctcgagttgaaagttttcaaatcttgagttgaaagctttcaaacactagttgaaagtttttcaaatttgagatgagaagttgaaagtttttaaattttgacttcaaaaattcaaatttcgagtttgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcacgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaagatgctacatgaagaagggcaaacatacacgttgctaagctgacacgtggtggacaaggatgactgatttgtgaccggtctgacactggtcgcgtcatcaacagacagccataatcccacgtcgcacctgtttccggcggaaaggggggtagatatgggccgtcccgtcagaagggcacccggagagcaaccgtaccgatctccgtccatttatgaagagaagaacagtccagtttggagagggagaggggcatgtggtatccccttgagatataaaaggaggaccttgcccacttagataaagagaggacttttagacacaaggccttctccagatccgatcccagggcgattgggggctggttgacactttgttacttgttcatacacaaatccactaaaacacaggagtagggtattacgcttcccagcggcccgaacctgtatacatcgcccgtgtctcgtgtttcttcctagctggcgatctttccacataccgagagagcttgagatttcaccctaagcccccggccgaaccagcaaaggggggcctgtgcggtctcctggtgaggagccacgagctccgtcatctggcgcgccaggtagggggctcagcgtgtgttttctgagctctcgtactcctccgtgtgcgccaagtttttcttgttcagcctaatggccgagcaagcaaaggtgcacgacctctctccgagtgtgagcggcgacgacggggagccaaacccacgccgtcgagctcgtactcccccacctcctccacaccaaaatcctaagcagggggaggcgctcgagagggtcgaaaaatccatagcatcgccagtcgcgggtgatgcaggagaacggcgagatggggagcgtcgcctcctcgtctacggcgacggcagcacgcctcagggcgcgcttcaggctgttggcgcgctcctacgtcacccgcccatcgtccctgacccggagtctccagcccagcgatggctggacgacgtggccaacttggtcatgacggcacagcagcgcctgggtgctggtggacggtccgccaccaccaagacctccggcgccgccactaccagctccgtgtcgtcaagacggagggcgcggcgagcggcggctgttgcacgccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagtgtcaaccccaccgagtttctccaggtctatacgaccgggattgaggccgctgggggtgacgacagagtcatggcgaatttctttcccatggccctgaagggacaggcgcggggttggctaatgaacctgccacctgcgtcggtccactcttgggaggatttatgccaacagttcactatgaactttcaaggcacttatccgcgcccaggcgaagaagcggacttgcacgcggtacagcgaggggatgatgagtcacttcgctcgtacattcagcggttttgccaagtccgcaataccataccatgcatccctgcacacgcggtgatctatgcgttcagggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggcctgcgagcgacaaaaagaaagaggctggtactcccaccagggagcgcccagccggcaagtggtgctccgtccacaacacctccctccacgatctcgcggactgtcgcgcggtcaaaaacttggctgagcgaacgaggaagtgggaggaggacaggaggaaggaacgccgtgagggcaagtcgccggcagctccctccggtaaacggcgaagtgaggccaaacagaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgttggagcggccctcaacatcatttcccccgcggcttttgatgccatcaaggccccggggatggtgctccagccgtcccaaccgattatcggtgtgacgccggggcacacatggccgttgggtcacatcgacccaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcgtggcacctccgcccccaccgccccgaggcagcggattgtcacatgcgccgaggtcccggtcaaggaggttgccctaggcgacggcccatccaagaccacacggatcggtggtcttctggatggcaaataggaagacgcgctcgtctctttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcgaacccggtggtcgttccaaaggcgaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49707 - DNA, 1562 bp, Oryza sativa
tgggccggcccatcaagtgcagatttacgtctactttgaaaccccaaacaagctatcagcatccacacgactctgcttttttttttttctgaacaatcactttcttttccattgatcgtttataacctgtttaagaactgacttgtgaaatgttgtaacacacttctgcaggcagtgcgggaaggagttcaagccgcaggagctgcactcgcacatgcagtcgtgcagggtcttcagggagaagatgaggagcagcaccagctcccgggtcagcgtcgacaggggccggacctccgccgccgcgaggcccgaacaccggaggacgagaagcaagggcgccgccgccgccgccgccgcccccggcgacacctcggaccgaccgtccgccgtgctcctcctcagggactcatgatctgatgatcatttcgatcgaccttggagttcgtttgtgaattttgcagcacacgcttatatggcgtgcataatatttaacagcttatctaggatactgtacattgatctcctttgggtcaaaacttatagatcatgccatgatactgctcctaattgaatcctagctacgccaaatggttttttttcaggaatacgcaaaagaaaagaattgtgcacctttattatattaaaaggaataaaatttacatagacggcaaacaaagaagtaaggggggtcgaggagaaaaaggaagaaaaaaatgaaaacaagtacttaagcctattctcgcgtttacagtgtgacaaccaaacgaccaagcacgctaaccaagaagctttggtggtgagggatgggcaagccgccaaagggcggcctcttgtgccatgcctgcgacaacctcaggctaggatcggaaatagttgttaaacacacagttgttcctttctttccaaatggaccaagcgccaagggtcacaatcatgtcgaacccacgacgacgctccctcagaactttgaaccacctagtatggagcgctatccccatgagctctaggttgtggatgcccaacccctcatattccagtgcgcgcgcagatataggaccaagttagccggcaatggccaccttgtgcgcttgcacaaccacaccaaaggaagccgtgccggatctcgttgatggctttcagcacccatttcaaggggtggggggattacaatgagcagataaaaccaggatcgcgctcagcataactttgacaagcgctaggcgcccggctggatggatccaatcagatctccacagcggctatcgttgtgcaatcttgtcggccaaaggctgaaggtcctcgtggtgcggttttctgatggagagagacaaacccaaatacttgcacgataactcctcaactaaatacttgcacgataacgcctcaaccgggcagaggagagagtcaccgaggactgcgacctctttctccgagcagttgatcggaattgcggaacacttgacatagttggtacgaaggttagaggcctctccaaatagagtcaggatccctattactagggtgggcgttcggtctgaccgaaaaattcggtctcggtcttc

SEQ ID NO: 49708 - DNA, 784 bp, Oryza sativa
tgggcctcgcgtcggcgctgctctacctccacgaggagtgcccgcagtgcgtggtgcaccgcgacatcaagccgagcaacgtcatgctcgacgccaccttcagcgccaagctcggcgacttcggcctcgccaagctcgtcgagcacggcagccagccgcacaccaccgtgctggccggcacgctgggctacctggcgccggagtgcgtcatcacgggcagggccagccgggagtcggacgtgtacagcttcggcgtcgtggcgctggagatcgcgtgcggccgccgccccgcggagctcgacgaggaggacccgagcaaggcgaggctggtgccgtgggtgtgggagctctacggcaagagagccatcctcgaagccgcggaccagaggctcaatggcaagttcgacctcgagcagatggagcggctcatggtggtaggattgtggtgcgcgcaccccgaccacgcgcaccggccgagcatcaggcaggcgctgaacgtgctcaagttcgaggcgccgctgccgtcgctgccgcccaagatgccggtgccgtcgtacttcccgccgccggacttggtcgctccggtgtccgtcgaaggcacgtcgagcaccgatggcccaggcgtcagtgagtgtggatcgtctgggtccaatgccggaggaggatcggggatcaatgataggcttctcgatccatgagcaagatttttttggggctcaattcatcaactgtagctatgccaaaaggttttctcttttttttttccctttttgtgtctgatttt

SEQ ID NO: 49709 - DNA, 1259 bp, Oryza sativa
tggtttcttctttttatttttctcatgtgtttttctatggatcaccgctgcagtgttatagccttataggtatgtgtaacttgaattgtgctatattatttgtcaataatagtgccattttgtggtaacacatgctgttataatgagttctgtggcctattggttatatatattgtaccgttccggattctcacttcgtgagattacctgatccttatacgaattatctgaatgattgcgctcatgcttacgttcttgccttttgtagctattgcatcgcaaagttttcatcttgtaccaagctggtgcctggttcatctattgggtttcataaaaaatttctggcagctagcaataataggaaataacacaaactgttttgagcaatagctccaatgggctctttggaacatatagtggttataatacacgaagtgctggttttcctacctactaatatacagttagattgcaatctgcaatattattttggtaatggatatatcctttgtttacagccattacatgtttcagtttttttactggtcttcactaagcaacttttgctgcttagttgtcacctgcatcagaaggcagagaataacttaactttacatgagataggtgagcccaattttattgaaacaatattttccacttgcaattttgtattcagattaactaaaggttgtccccaatattttctcttctcagtatagctttcagaggtgaaaagagaaaaaggagaaataaaaggaggtagcagatcactctgcatttcaagttgctgacctagcctaatcaacatgtcaaatgtcagacgtgtattgagtttgatgtactaaccactacaacttattgaataagtatgaattgggttttttaccattaacatttaactgctgcaatggataagtacaaatgaggatatttagtattaacatattactatcttttatagacacttgtatcagtctatctccattacaggtgtaacttctgttggtttgttgatatcacaaaaggtaaaagaaaaagtcgccttaactataagtctgtaactgtacaatatggcatatggttcaggtaatatatctgtaaagctttacaaaatatctccaaataccaatctaatttgttgtccagaatttaatcttactaaaggatatcttaatgactgataggagttaggactttatccaatttggtatgttttctggagctatataaatttagataattgcttatggaacaagttt

SEQ ID NO: 49710 - DNA, 1178 bp, Oryza sativa
gcgccacgcgtgtgggttaggtgagcacagcggggctcacctacccgcatttatagcgggattggacgagcgcgccacgccgcatttaatgcggcgcagcgcacgcttatccggtccgcgactggtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagatccattccaggcttcaacgcaagtatggcaaggaagtcgctggccattaaatgaaggttgaaatgggcgtccaccggaaaagcgggcgagcggggcaggagacgtgcgctctgcttgtcagaggtcacttccggctgtagactagccctcattgtaaaaagcatgtttcccttcttaggcagctagaggcccatgtggtgacccctgaccagataaaaaggaggcccaggcctaggaaaaaagaaagaggagagaagaaaggaggggagttgggactctggcaaagggtttctagagcctgaacttctttcgctctcggcctctctgtattccttcacacacagatccaccagaacacaggagtagggtgttacgcttctcagcggcccgaacctgtctacgtcgcccgtgtcttgcgcatttcctctctcgctgacgttcctcagatcgagggcgaagaatctcacttagcgcccccggccgaatcggcaaaggggggcctgcgcggtctcccggtgaggagcctcacgctccgtcagcatactataacactgatagatatattataataccaacgaatcgatttttttaaccgccactagcttgtatggtgtacagtacacgcatgtaatcttctactctcctcgataaggggagagaccgagagaggttttcgctggaattatcgtcccccgtttcactttgtgcagttctgcgagcataacagagtttttgttaactcggtgaagtttccaacgaatctgagctttcgttatgcaggacttgacttggacatctttatttacaattccatgaaaatatcgaatttttttcgtttttagattttttttttaatatttacagaaataatctatcgaccaaa

SEQ ID NO: 49711 - DNA, 4082 bp, Oryza sativa
ttcattgtagcaaaaaaaatcataatcatataaaattaaatttaaatgaatatccaatgatattatttttaacaactaaaatttaatttataataaaatacagctttgaaagaaggcaccacgttcgctgtggaggctagaaattcccacattaatcggagaaaaagaaaaaaacgaaaaggagagtccaagtagaaatacaatctaaaaatagctgaaattcagaattaaaaataagcaatactgaaagaagtttctatataagaacccaatacaaaattaatcaaaattcaaaataaaaataaaataaaatccaaaattagaaagaaaaaaagagacccaagtagaaattttttttaaaatagctgaaattcgaaattaaaaataagtaatattgaaagaagtttccatataagaacccaatacaagattaatcaaaattcaaaataaaactaaaataaaataaaaattagaaaataaaaggatagtccaagtaggaatacaattttaaaatagctgaaaatcggaattaaaataaggaatattaaaaaaagagtccatataagaacccaattacgagattaattaaatttgggaataaaaaaataaaatccgaaattagcaaaaaaaagaagagttcaagtaggaatacaatttaaaattagctgaaatttggaattaaaaataaacaatattaaaataaaaatccatataataacccaatacgagattaattaaaattcagaataaaaaataaaataatattcaaatttagaaaaattaaaagagagttcaagtaggaatacaattttgaaacaactgaaattgaaaataaaaaattaaaataaaaatactaaaagaacacaatacgataataattaaaatttgaaaaaaataaattctgaaattagaaaaagaaaaataagattttaattgaatacaatttataaataactaaaatttgtgataaaaataaagactattgaaagaaagaccatctaaaacacatgacgagataaattaagtaacaggcctataaaggagtagagtggtggcggttgatacgacatataaaaactattaataaaacaccaaatagaatcctaatgacgattaaaaggagggacgataggcaggccatgaagcaaatgagcaatgcgattgccgggactactagaaagtaaaaaaaaaccccattgataatcatattcaatttttaaaatctcaatgacaataaaaaggagaagcagtgggcggggtgtatagtagtatagtttcagagccgctgatgtttgacgtgacttctagaaaataaaaaatgaattccaacgatagttatgctcaatttttagaatcacaatgataataaagaaagagtaggcggcggacgggccataaaggagcatagtggcatcgtttgacgagacttctaaaaaaatataaaaaatgaaacccaacaagacaataaactctaaaaactataaggttcaatttttaaaggttccgaacttcgaaaaagtaaaaaaaaacaatgataatcatgttcgattttaaaatctcaatgaaaataaagaagggacgcagcgagcgagccgtagagaagtacaatggcaaagccgttgacggtttggcgggatttctagaaagtaaaaatgaaccaaaacgataattatgttcgatttttaaaatctcaatgacataaagaaaagagacagtggacgggccatagaggaatataatggcaacgtttgacgggacgtctagaaattataaaaacgaaacccaacgtgacaataaactctaaaaactataagatccaatttttaaaggtttcaaggagaatgaatagaaatagtggtagatcgagcaagcaaataaagaaggagatgtcataaggggtagcaactggtgtgacttttaaaatatatataattagaaacacggggatgataaggtttaatctttcaaactcttaagacatgagatagctatttaataaattttaagtaaaatcatactaaaaaaatatatgattttatttgggtgctagccgcgcaattgcgcgggccacccagctagtttaaatgatgggaagaaaattacgattagttaataagagaaagtggctgaagataataacttaaataatttgtgattgtttgagaggatgtggtaagtagagaaatagttctattttaggacaagacaccgataaaaaaatagctatatactacctctatttcaaaataattataattatatttctatgtttagattgtgtttgagacttgaacaaagagaagaaaagatcattgctttttgtgttcacgcttcacaaattattaaatggtgtattttttgaaaaaaaaattctatggaaaatttgctttaaaaatcatatttatccttttcaagttaaaaaataatcaatacttaatttattacttcgttcgtttcaggttataagactttctagcattgtccatattcatatagatattaatgaatctagacacacatatatgtctagaatcattaacatatatatgaatgtgggcaatgctagaaagtcttgtaacctaaaacggaggtactatgtactaatagcttatctagttttgcatatcttcttaatcttctttattcctcatttctcaaacatagctgtggagaaatgctatgggaaaaaaatgatgtatagccaaaaatgagagggtggttgaggataaaattgaaaaaaaaataaataagaaatgattgatggaacaattactactttattatgataactttttaaaagataataaccgtttattatgacggaggtagtaaaaaatttaggatgaatgtagcaccgcagtttgcaatcgccaaaaaacgagcgtgatcaaactgtggggctttgcttatgtcagggcgctttgtttatcaactaagcgtgattagggtggacctgtattttgggattctttgaagcgatgcgatgcgatcaggtggtgtagtgtcaactcaaggcccatcacgatatgcaaaatgtgattttattagtataaccagtagctaagctatcaatgtccgttcagagattctagcatgggcttttattaggttacgcttggatgtcagagttgaattgggttggtgtggacatggaggtccaatcagggttgtggaaaaccacgaaattttgaggtttcgatgtggaacggaagtagattttgagtgaaattttaaatagtttttgagaatttaaattgaaacagtaaaagttttgactaaaatttaatgaaagtttgttaaaaaaatgtcataccactagtgccgtgtttagttgttttggcaaaaaaaaatgacgtatacggacacacatttgaagtattaaacatagactaataacaaaacgaattgtagattccgcctgtaaactgcgagacgaatctattaagcctaattaatacatcattagcaaatgtttactgtagcaccacattgtcaaatcatagcataattaggctcaaaagattcgtctcgcaatttcaatgcaaaccgtgcaattggtttttttcgtccacatttaatgctccatgcatgtgtccaaatatttaatgtgatggaaaaattggaagtttgaaggaaactaaacacagcttaggttgggttccggcactcattaaaaagatgaaccctaggtctaattcaataacaattataattggtacaatatttggctcgaattcaaatttaataagatgaaaatattgtttttgatgaaaaaagttactactagatcgctagcaaattccaacaatattacttaccaaattttgctgtactctatctctaaggaaaagaataacttataagggcgaatctagacaattgttcatattcgcacatagaagttgtttctttaattgtacaagtatatgatttcacatatatgatttccgggagtttctccacatctattaacatcttccacaagctaatgttccaaactcatcgcgttgtgcctttttcccttttctccatatgtatatcatgaattgacaattattttctggaagcataataattaagaa

SEQ ID NO: 49712 - DNA, 1633 bp, Oryza sativa
aataacaaagtctcaaagcacttttaagtcatagccactaagacactatccagtgctccaatgttgctgcttaaataaaatgtatgtttagttaaataaaataacagaacacttacgccagagactttcctttgaaaggaaatgggggagccacagcagaccagatgcagaacagtatatggatctgaaagggggcaaacactgttagcactgcacggaatatctgcaattttgcaaccaatagtgtggcaaaccattaatcttatactagatcattttaaccttacagttaccagaaggtaagggtcttaccaagtaaaacaggaaaaaccatccaacttcaaagcactctcagtcctgcaacatacattgtaacaatacactatgtcaaatataagaagaaatagtgtgcagaaataacaaaaacacaagtatattcacaacctcatcgcattgtaaagggggcgataccataacacataggctccaggtacaccagatataaagtagataatggctagcaaccagatcataacacctattgaattgaaccgcaggattagtttgaagtgtcagtgcagatggcagctgatccataagataaatatatagtaaggtactcagtcagccatacctgcccctttaatccatgctgctgtagttgcaattatgttccagaaaagacatgccgccaatcctgcatgacatcaaagtttgcacaataagaagcagctttgtagagcaatgctacaccaacatgcaaataggtactagctctcacaaccaaaattcagtccactaaatagtgcttctttttacaagatgccaagtattgttagcgttgctttgaaaatctttttacagaaagacatttagcccagctacaaaacagggtagacaccacatgcttatgcttattaggcttacataattactgcaccaagaagataataactatttttctcaaaagacacaggttgcaacttctatttttttaaaaaagaatctcttaattggatatataagtcaagattagagaagttcattgatatcaaaatgtctcaaagtaggcacgtttttctcatgtcactactcacttctggcattgactcagcagaaattcattgattggacagtaaatgtagtgattcaggcagtattttattcacaatgtttaagcaaaaggatataaagaattgtggttccaccaggtattttagttcttgtgacagctttcccaacatgagggaacaaaaagagagttaaaacttaaaactaaaactaacacttacccaacaatgaagaaaatgcaaggtattgcatcctttgtaggtggattggtatctcatttgaaatgtcatgatgaataataggaagaagggtgcccagtttttctcttcaatgcccatcccagctgaaaaataaaagaaagagttgaaaggcagaagccgcaactaaaatggaaaatagattgcaccagaccaaacataagcgcaaaattagcaagaatagccttttcaagaaaggcgaacacaatgtactccctccgtcccaaaaaacgaatctacgactggacgcgatatattctagtataatgaatctagacagagatatgtccagattcgtagtgcta

SEQ ID NO: 49713 - DNA, 2034 bp, Oryza sativa
gaaaagaggagatatctagatgaaatcatttgataatgttagtttgcattagcacgctggtatccttctgtttatctaaaaaaacagccatccttcttttcaaagtgctataattgagtgtatagatatccatgttttgttcatcatttcaaaccaattgtgcaatgtcaatgattcaattaatggttagatcagcgaggtctattgggtgccggatctttgtgtcaaatccatgccagctaaatatctttcacattgcataatggttactagttcaatactcaatactaacacaatatataggtgcttcccaatacatcataggaaaaaggttaggaattaggactttggccaggggaagttgacaacttgattcattagaatagttttttacttcatcaaacattggttaaaaatcacattgctcatgaaaagatcaattgaaaattccaagtttcaagcataactacagaaggcacatacgctttcccgtttgtttagctcagcctcctttgcctgcagttctttctcctttttcttcatgtcctgaattacatacgaacatactcaatgcataagcaaccaaccacaaatacagcaacaaaagaatatatggtatcaaacatccaaaccaaggaatagtgaaaccatcattactagattaattgtgttcttcagccttttaaagagataagataacaaaaaatgaagcatgcaactgttgttacacactaacagagtaataatatcagagtgaaagagctaagtacagtatgattttctcacgctgaggtacagaacataacttgtaaatatagtagcacgtagtattaccgctcaatggaaatacaagtaccttggttgaatcaagaggtatgtccactgtggcaccacgatcattatagaacccaggttcgtgaggaagaggtggcatccgagagttggaagctggaggtacacttccaccctgcagaacagggtacatttaaaaatgaaacaaacagatagttgaaggaggctgctaaaattagaatattcagccaactctgttatccctttttacgcctattggccgaaagctcaaaatttgacagtttagaaatcctagatggagcatgtgcacgcatacgcacaattcacatgattatggactcgctgacacgtgcatatccagcaaactgagagtaaactgactgcaggcttacgacactaaatgtttatactggcagagacaatcttcaatctcctaatgttatagacgatctgaaccaaacaagtgtgaactgccccattttacggatattttccaataattctaagagtagaccgaccattttcacaagttatacatatcgattgcaccacatattccctcgtaaaaccagaaacataacgtcccaacacaacctaagagccaattttcaatccgagcatcatttctcctatgaaaatgtataacaatacaaggggaaaagttgccacgcctcgcgatcagctagcaaatagacaagcaaaaaaggccgtattcgcgccatccaagtccaaccccctaacagcggatcctaaatcactaaccctagcgccaacaactcaggctgatccaaagcaccccacatggcgtgccgcgtgcaggaccagacgaagcggccacggccagaaaaccagcacaacacatgccaatccgggacgcagctcgactaccccatccacacaggcgcgaggacaagcttctccatgcctagatgaagcaaggaggaggcgcgattgcgacgcggagggggggtttagccccccgacccagctacagcctaacccagcagctcaccgcgaaggggttgacgtcgtcctcgtcgaaggggttccggtcgtacctccccgccatagctcccctccaccccaactcctcctcctcctccggaagcggccgcgtcggtggtttctctctccggcgagggaaggggaacgcgcgtgacggtggcgaccaactgctccggcctccgggcttccgcttttacgtaacctagtgggtttgga

SEQ ID NO: 49714 - DNA, 1016 bp, Oryza sativa
acatcaccaagaaatgcatgctgtctatggaaagttagtatattctgaactgatattggtttcctttggaatgtgctacaccaagtctgtatttgaggcaatacattaaattaggatatatataagagaatacttgaggtcattgttgtggccaatgtattgacaactgttcattcttcaatgtaatggtgcttactgatacagcgaatcgatgaatagctattcattaatctactggttgaactgcaaagtatatatgttacaactcaaatcagaggaaagctaatcaaatctccaattttgtttggttgcatgtatatacttttaccatttagagtcttgtaaaattgccgcactgcgtgcgccagttcctgaatcttctcccatcctggagcaatgaacttggcagtttaacattggactggttcacttgctgatggcagttccaatctcccttgataactagggatcctagtagggttcttgtgttactactttgatttttatttagctgatgagcaatggctggcaagacagtaaaaatcctctctagttaaggaccccaacatctgtgctttgtatgatctctttggttcaggacttagtcatttgaatattatctacattatacatgttgatgtagttaggtttgcctattatcagagctgtagactaaggtgctatattggaccagtcgatgtttggcgttccattttcaatccttaccttttttttttcgttttgcagaaatccgtgagaaacacaaattggaactggagaatttgacactaacaaagcatccattcaggacattacgttttttcatgttagctatgttgcaatacttgaaaagattagcaacatatatcctgagtaagggtgctttgtttgttgtcctcattgtgttggtgctagctcctggaattttacttgcggttacagatggtctgcataaaaaggtgtgttacttcctgtaatttgattacgatcgcagtgcttgtgctgataagagtaga

SEQ ID NO: 49715 - DNA, 2458 bp, Oryza sativa
gacagaagctgatttgcagccattcaagtgcttcttccttgaaggttggctgttcttcggattcatctatcctgttgttccctaacagaagaaaccatgtagggtttgtcattcgggttgagctcggaccacctgatgagccccgtggggatcctttgctgagtccggtgacgcacacaccaaaatctacggctcagcatcaaacctcggtcttgtgccgtttccgtggaggcagccgatggggattaacggtttgtcaagcggactgcacatcttttgaggcccagggtagcagtcgtcgcggcttcgccgcagatccctgtcgacttgctcctttttctgatgttaggttatttcaggaaggttgctttcgtagttcagttaaccctcctttcttaaggatggctcttttgcttggatatgtaatggggtttattccctagatctgttcctgcttaataaagttgatgtgttttcaaaaaaaaaaaaaaaagccgtggagtggaggagagaggaggccatttctgggaaaagggaaaaggcctgtggcgcgcgggccccgcgggcgctgaggctgacgaggaggagggttggctggcggtgtggacgtttgtttacgaaaggcgcctgcacccggcgtgttgcagcgcagcgcagctgcggctgcagcatatgactcgtgtgacatcacgagccaggttgttttcgtcgcgttcctcgcatgcagtgcaggcttttgctagcagcttcccccgccgtctcgcgcacgggagtttcgccgggcgcgcggcccggccggccggctggctcgatcgtcttctgcgccgagcgcctctccatcccgcgggtttccgccgggcgaggaggacgcgcgcggggatcgtgcacgcgagtcgcgcgcggtggagtttgcgcggccaaatcccggtaatcgtgggtgactcggtgcgggtgtgcgtggtgatcgactgatccgcgctagggtaggttggacgtccgcgcgcactcgatgtggtgtgtcacgcattgggggtgtgctttggtgagatcgctgctaacttcctggcacaaaagaataaatcgtggtagtgagaagtgtaacacgacgtcctaacaagtgtcggaggtagcgcgagctgtaccccttcgtggtagtgatacacggcccaacattgttgtgaccgcattaaatattaacatataatcagcagttttgagctgcttaatgatgagtggagcgcagaggattggtgtggtagtatgagcatgagccacagaaagtgctgttgtgtgaccgcattaataagccagttttactcctatactactccctccgtccccaaaaaagacaaaccctagatttttgtatccaaaggttgaccgtccgtcttatttgataaaattatgaaaaaaaataaaaagacaagttacgcataaaatattaatcatgttttatcatctaacaacaatgaaaatactaattataaaaaaatttcatataagacggacggttaaacgttggacacggaaacacaaagtttatcttttttagacagagggagtatatcagaaagtaaatttagtacttcctccgtttcacaatgtaagtcattctaatatttcccacattcatataaatgttaatgaatctagataaatatatatgtctagatttattagtatcaatatttaatacgagaaatactagaatgacttacattctgaaatggagggagtacgtctgcaaaggctgaatcacgtgcttagatccctgacccctcacgataggagaagctaggcacatagtagtggactttttcatgcatgcatgcagaaggagctggcagggtgaatgaagcaatatcgcatgttcttcatgaatcatgaggcaagataatggaaccagaggactttcaacttgggcagcaaattgatggtattgttattgtgtttcacgctaactcgactatttttttaatgtaatcatttgacatacccttttttttcaaacataatggaatataaatacccaattacgacaaaccggagtgttttttataaaaaaactttaaaaaaaaactacgacaaactggagttcaatccatcaatgatgagctcaaaagcaaggatctgattaaacttactagcagtactactagcttttgactgctaattgtgccgattagagggcaaaacacgtgccaaaacctaacccaataattgggcaggagtttcgttgcggcccggaagcacacacataaagattgattggtcgatcgttcgatctaaacaacccgcaaaagccaggccggagaagagagcgacgccccgggccgcacaacccgacgcgtagccgctctctcgcccacccgcgcccactggggcgttgctatagctgccaactcgaaaacaccccgcgagtcgccaactcgccaccgcgccgcaagccacaacagac

SEQ ID NO: 49716 - DNA, 1585 bp, Oryza sativa
aaaatagcgcgatgccacctgacgaaggaggacacgacggcggtagtgcagcgccactagaggaagatgaagcattccaaggacaccagcgggttgtccagcgactccttcccctcgccgtcgccgccggcgctggcggcgtccgcaatgctgggctcgccgtcggcggtcatggcgtcctcttctggctgcggaggtggtggaggcgggggctcgagcggagaaggaggcgcttcctgcacccgccgcggcgacggcctcaccgggacgggcggcttccgctggagggacggggctgggctcgcggcgcggcgctgctccggtgtacgcttcgctgccggcgacggcgacctccgcactgagcggtcccgttgctcgcgccgcggcggaggggacgccgaggcccgggcgctgcgggagcggacgccgtaggcggcggcggcggcgcggtcgcgccgggaaatggcatgggccagctcgccggagacggacaccgggcgcttcctcctggccggcttccccggcgaccgctctggcccggtcaccgagctggtcgcgacggacgactcggacgccgcctcggacctatcgtcggtggcgagcgacatgcagctaccaagatcgctcaccgtgacatccgcatcggcgctaggcttcggcgcctgcttctccgcctccggctcctccaagacagccacattggcgacgggcttcgcctcggccctgaccttagcgctcggggtctcggagagcacctccttgaccttctcctcctccggcaacggcggcgggggcggcgggtcgcgggcctcggccggcggcttgcagcggcgggagaacacagctgcactggccagctgcttcctgcgcttcttgctgaagcagcagcccatgccttccagctgccaccggcacactagctaggcggccatctccggtggtcgagaccagcgcgaagggtagtgtggttggttgtttgtgtcgggaggaggggtcttgtggctctctagtgtgcttcgatttgggcgaggtggttatggcgatgcgaggggactgaaactgaaggactagtgtgcagcgagtgagtggcaggttatttatgagtttgatggtgttcgcttaaaatggtggtaataggtacagggtacagactacagtacctgtgtaccactctgcctgatcgtaatcacacattatgcattctgtgtttctgtttggtggagtggagacggtgaaagcctttctgaagcgggtatctttggaagttctagcaaggcagtaaaatcattcggttgtgattttgtgaaggcaccgttgatcgttatggatagcaccattatcggttcagataaagatacacgtgtaccgcccaatgaccagtacgagagtacgagtcaacaaaccaataccgtaccgactcgatctagagccacaccgagtcaccgacgcagtcgtgtagccatcaggccatcacccatgcttcgtaccgtagcagcaagcctactcatatcacgttgatgtggaaatacaacgccggcgagacgaaactgcccctgttcctcggatgctaccacatcctattcct

SEQ ID NO: 49717 - DNA, 1410 bp, Oryza sativa
cctatatcctttttcctgctcaactgagaaccgacagcttttgctgccaacggtgatgtccaagccttctggagatcttcttggcaatctctagcttctcgcgcagccaaggatcactggtttcagctccagaaaaggcatggcttttgaagattgtcaagaaatcagtatctttcaagctttccagaggaaaaattttcttgcagtcaagaacagctggaagtgcattccggcgggacgttactagaattttgcttcccctctgcagagaagctataggagctaacagttgctcccagtcccactctgtctcacttttggattcgtcaaaccaaacatcatccaacactagcaggaacttctctgattcttgcaatatgtcccttaatttgcactgaagggtatcgagattgccaatacgtgggcactcgccctttccagcggactcaatgatctcttgcgtgtgacgatgcacatcaagtttgcgcgagatgcagacccaaatcctggcatcaaaatactgagccaccctttcatcattgtagacatgctgagctagtgtagtttttcccataccaccaactccaacaattgccagagatgagtaccacctagccatgctacctccggcattcacaggcttacagagaatatcaattatacgatcacgatcctcgtcgcgaccaacaacatttgatgaggaaaaggaagtggtggtgttaggcctgatgggtgctgtgaccataagttctgtcgaattgccagcttgtatgccaagctgatcgtgaaaagccttagcttccaccaagatttccttcagttcttcgagcttgctgattagcttcctgttcttagggcgcaaattggacatcttgttggatgcagcatgcagaggctttggaacggaattagaggaggcaaccatcaacgatgcttgtgcgcctttctctgctacacgcttgaggatgtcatactcgagctcatccagcacatcttcagtgtcatagaaagctgctttcagtttgcgcagccacctttcgatcttgcccttatggggactcttctcggctgcttcgatcaccagctgaaactgtggcaggatggtggcctccagttcttggagctcacacaccatgtccttgccaaggtaggttgaggcgcggttgatgaacttggtgatgatcggtgataccacccatcctaaggcagccagcgctgctgcctccgccaaggaaccgtaacagatgttcccttggtttaatagtctcgtggctgctgcttctcagagtggaaagagcagcacatgaccaaaggactttctggacttcaggcctataatcaaagaagcaaaagtgagagatgagaacctgggagttatcagagccaaggatgaagattagtgctctcaaa

SEQ ID NO: 49718 - DNA, 2161 bp, Oryza sativa
agtagaatggaatttttggtacacaggccattttgcaatatatataggttttgcaatgaatactcgctatggctttgagaagaaagttagcagcctcaccagcactccaacagttgtaaggtggtgtttgaatacagaaacttaactttagcctatgtatttagacactaatttaaagtattaaatataaactacttacaaaactaattatataaataaaagctaaattgcgagataaattttttaagcctaattaatccataattagaaaatatttactgtagcatcacataggataatcatggattaattaggttcaatagattcgtctcgcgaattagtccaagattatggatgggttttattaatagtctacacttaatatttataattagtatccaaacatctgatgtgatagggacttaaaagttttagtcccatctaaacagctataagatgattggcaagagtcaggaggtatgtggtagatgtaaaccattagtatcacattgagtatatgggatatgacaaatagagaatatgttgaaaagaagcttacccaatacccatctttacaagagatttagggcgtttttttttgggggggggaggggtggagagttgggagtacgattcactaccaaataaatatgcatggcacgaagtggtgaagataaaaccatacttcaatagttggaggacacaaccgttaacctagagagtcggctagcaatcatcaaagtagtccttcctacatcggtttcttcctctctttttctctcgggggaaattgatatgtgttaggctactttgaaaagaaaaacttctcatacatatcataatctcgcatataccctcgaacaaccttacgtatagtttatacaaaagcccaccatactattatagcaggatctaatggttgcttctcatatttatatttatagtcccaaaaaagacaaaaacatgttagaagagaaaagaaaaatatatctttcatgcatgagtaaatacaagatgatgtgttttgtaaacaatctagacatatgctcagaccatcttaaaatacttgcatgagtacactcaaagcatacacctagtagaaataaaaataatgatgagtagtaattttacagtagggtaacttggacttcattcgttcctgggagatccgggagattgagagagaaaaacatctcgttttccgcgcgcgcgcttccgttttttgcaaaaaaaatttctataggaaagttggtttaaaaaaaccatattaatctatttttgaaatttaaaatagttaatacgcaattaatcatgagctaatgactcacctcgttttgcgtatattcccaatctcctcaatcactttctcctcaaactcaccttggtataaggtgtgtttgcaagagcaagttcccaatactctcctctcgttttccgcgtgcatgcttttcaaactgctaaatggtgtgttttttgaaaaaagtttctatacaaaagttgttttaaaaaatcatattgatctatttttgaaaaaaaaagctagtacttaattaatcacgtgttaattgaccgcttttttcgtggataggagatgggttcccaaacacccacctccaaacacagccataagcacggaccaaaataagcgaaagcacatatatgatggtgtgaatgggcacttgcatccctccttgataacggaaacatcaaaacggttggtattcggtactcccaacccaccacccttaatctccataaatacggtgttactcgagagttggcatgagctggcccatagatgccaccgcaaccggtatgaacagtggcagtgtgcaaacaccataaaacctcagcttggcctaccggccgccgcccgccccatggacagggcctacgacaagcacaaattgattactctatccgacttgtttggtaggtcgaggagtcaatgtgccgtccggtgggaggtcgctcgcgttcgcgggcatcatcaggcagcgaaaaaaacgactttcccgatcccaaatcctcctttccccttccgtcttcaggcgagcccacacgagcatcacgccgcggtgcgctgcaagcctgcaacggaataatgcaaagcgaagggaagcggacgcgcgccgcgtacgggccgcggggcgtggcacgg

SEQ ID NO: 49719 - DNA, 763 bp, Oryza sativa
tttttatcggccggctttccccggtactagttgttgtctatgggaagaagctagtcaaagaacatctcagttctcagaataggaggccccccccagtgaagccggggaatcattggacctggggggtttgactaaaaaacatctgggtctgcaagggtatatcgaccatgctggtgtttcatcctaccatgtcccatggtggtgtttcatgcattgtttcatcctcctactccttggagttatggtagaagtcgacgcaggtctggcacccgcagtcggtgaagcggcagatctcgcacccgaagcacacgcacttcacgcagccggtgcacgacgtggagcgggagcagcctctcagcaccttgcggctcgcgcgctcctcctcatcgccgcaggtgaccctggtgggatcaatcaaggttatatatatatgcaaatgtacacaagaacaaagcaaatatatgaaatatggaaaaccaagaaatgtcaaactgaggatggaaggaacacagaacaggtaacggtgcataaaagtacactactggtcactaggcaaagcaatgcttcttttttaaaggaaaatttaatgtaaacattgcagccaaatttagaatgcatgtactcatgttactgaaggaacagcacccttcagcgatcctagaaaattttccctacatgctactgaatgctacagggatacagtactgaatgtgtcctgtggctacaggccgcatgagtacatgaccctgcagagatctggaag

SEQ ID NO: 49720 - DNA, 770 bp, Oryza sativa
gattagtttagagaataattgcgctaaccttgtggaggtaaaatgacatttctcctacttccacgacgacatcactctccagctccgtcatgcatctcctggcgattgacaagattaagattaagcatgtatttggaattgacgtgtatagattagcaatgagggataatctgaatcgacctagtatgtgcatgggagtttaggacgtgaatgtgttatatcaaacagaatgtaagcgtttggaattgacgtgtatagattagcaatgagggataatctgaatcgacctatgtgcgtgcatgggagtttgggacgtgaatgtgttatatcaaacagatgaacatactgtgccatgaaagatttccagccgatttgccagtgaacaacatggatcagaggttgggaatgacatagttcatgcgtgaaactcaatctgttgttacgttacggtgcagaaattaatttgattgtgttttacattgtttgagaacctacgcatctccatacaatctgtcacagaagtacccatggttttaaagcactagttgacatactgattactgatatggttagtaaatgaacatcaactatcagatctcttaaactcaacatatgatagagatcctttaagagaattctgaactagaaaaaaaaataaattcaacatacagaaaattaacacaacagaaagaaacgaggaattcaggataaccatgtgaggccttccagaacaaagattccggcttggagcccaacttcatagtcgccat

SEQ ID NO: 49721 - DNA, 716 bp, Oryza sativa
aaaccacgggtttttttatgaagaaccccagataatcttgacttgctcgatgaattcccgtgggcctacagacagcatgaatggggtttggcttcaaccaaccgcatccatgtgctgtgccatccttcaggtctcgtaccaccgaacatccgaacagcagtcagatgttgataccggaaccaacaaccatcagtccaacacagacgttgctcccgtgagctcgcatgcggcgcgaaatctttacacgggagacaagcgcgcaacgcagatcagcataacgacgacggggacgagagcaagcgggtgcagccgcaggcccgcagcgcagctctgctccgagtcgacaggacggtgcgcgctacgggcgaaccaaaaccaaggcgcgatcccgagaactgtcgacccgcgcggcctcgtgcagcgccatgatgcgccgcatgtcaccttgatgagaattttaagcggagcattggcggtttgtttaacaccagcgcacacatcccgggcgctagatctgtttgcctaggttgacgggctcctttggcagatctgatcctgtgctgaatctggggatgagatcagaaaagctgcatgcatggatggatgtccctgacggaaacattgttcgatggcgcagcatgggcagggggcgaaagtgaaagtatccgatgactcacgcaccgaacaagtcagaaaatgtgaggtcgccatgtgat

SEQ ID NO: 49722 - DNA, 4598 bp, Oryza sativa
ttgttaggtattctcttgggagccagtaagatgtcatgacgttgttgacatgggatggagcaatttggctgaccttagtatttatgaaggaaaactcttgggatgctcctaccacgaatgccgagttggtgtttgggttgctgatatatcggtgagttttactttttgtctcataggatgtatttcttctatggtctaatcaatatctttcatccagctcattgggccctatgctcttggtgttttgcccaaagcaaatttctttgctgagctggtacattctttagacgacaatccttcgaaaacgattgataccactgccaagtccattcctgctctagcaacgacacatccaaaaaatctgtacaaggtcaaggaaacagggactggtactgcttcaaacacccatttgtctctcattatgtataatgtattgaagtacctttacttcgatacttcacactgatgctctctctctctctctctctctctctctttctggtagtagctgaaagtggaattcgtggctcaaatttgactccagcaagtatggataaaaccaagagagataagagtggtgcaactcctcgaagacctgattcttctttcaaatcatctattcagagctctactccaatgaggcgcatgaaagctgctgatagtccatacacaaatagaaaaacagtggagcgcaattttgcacagagggatgcctcgctagcatcccgtacgggaacagctaataattcttcaactgttaaaaaaggccatcttgctgagtcagtatctgtaaaagatatttacactacaccacagactgtttctgtgcctgtcgttatgcctagagacattttagaggacaaaacagcaggcagcattagtggaggaatcagagggagagctgcagttgcagatgatttccatgctcctgttcattcaaggaaactttcagttaatagttttgtgggtgatagtgttaactcaacaaaatccatgctaactgatcctgatgtttgctctgagggtttctctggcttaaaattctcttttggactaactccatattacaagaaagaagaatatgataatgtggataaagttgatagtatggataaaggtgataatacacaaatgacagaaaaattggacagaacagtgtcgttggagcatcaacttcagtcaaatgatagtaagtcttagagatcctttcctacattctaagtttgcactctgcagttctgttcattttggcaaattgacgatgaaactctttcctgctacagcctctgagccaccatgttctactacagaaacaaccaaggtcaaatatgtcagaggaggtgtgtgtacgttaagagattgtctcggtatctacttgtgctaaaattagttctttaatggtacttttaactccttttgcagttgctgtgccattaggaaaaacaaagtctcttgttgagagatgggaaaagagagaggctactaatgttgagtgctcaccaccaactggttcttgtggtgaccgtgcagtgagatctgatggtccttcctccttttcagtatgtacccataattttaagcccaattaatttcaaagcaatttgaccttattatctggttggttggtgcattcatgaatgcatgaatgtttaagaactgtacttactattttcctaaagtccttggtgataatctcaaacatttttcttaaaccaatttatctttctgggacatgtcatacatactcattcttgcatattatacaatgtaaatttctgtattcgtttttccccttactgcgaagtacattctatctggagatagaagtagaagggataaagtattgttagaaaccagattgtcataaatcataatgtaatgttttgtggacttaagtacttctgggagattggagtattttcagaaataaaatcagaatatgggctagaaaaatatgactttacctttgctccatttttatttgttcatgctctctagcatttacgaattttttcggtactcaaatcattatattttgcaatggttgtaatggacaggcagaaccaagtcaggcatatgagaaggacttgtcaacaattgatgaggcgatgattccaatcaatttgatgcagaaccatgatgaatttataaatgccgtaaaatctcggctgacaaagttagaggtgtgtcctgtctctgatctttttacttgcggacttctgtttgttaccagctcatgtgcaccatagaattccttccttgaccttttgtatccaataaacagggaaccaatcttgcatgccattgcatgatagattatacatatgatgaagctcttctgtgttctttaggctattcagtacagggaaaatggcttatcgttgttagtctattgagtacaattagacaacttagaattgaacattacctttttctttgatacttgcgttaaatgatttattggcattttcttaaagacaattggtgtggacacacctataaattgaaggtgaagtcagctctagtgaagattgttgatcaatcccgcaacaccctaaaattaatcagctagctttgaatccattatttctgatagcctgatataagatgagagtgatctacacttgtatgtaaattatgcattggcatgcacttttcccaccatctactaattatcctacaagtggagagtggggaatagtcagtgaggaaagcatttgaaaactagtaaaagttgcatatatcatagccatcactccatcagcatatgatattaatgttaactgtcttcagatgatgcgtcatgtctttgaccaaaatggtatcaaaggagcgattgctgcagtggcaaagttgcctgacaatgctgtaagtattctcaagatgccgtgcgatattcttggatgtacatgtacttcatattttttagctgctaatggtttgacccttttttttacaggttctagctgatgttgttagtactctgaaggggaaacttgatctcttcaacctagacattttcttaagctttctgcctgttcttgcggggttactgaccagcaaggctgaaaggtgatatattggatgtctctattccattgcatgttggttcttgtctgactggaccaagtgatacatagtaacttaagcgcacatgctctgtgcacacatgtagacacaagatgctgctgttaaattgaattgtctatcctcttgttagtctgttcattctattgcaagcaaggtcatggatctattttctttacaaaaccatggagatattggcatcttacattagaaaatgtttggtttagtagtaactttgtcttatggttactttgcctttaatttcaatttgtaggcatgccattgtttctttggaattgttgttggatcttataaagatctttggaccagttattcgttcaacattgtcagctcattcagcagttggagttgatattcaggctgagcagaggtacgtgcattaatgttattcaagggaatgctatttaaaggacgccgcaaaacctgcaaattgcaaagagacactggatgtgaggtgacaagtgggttctgtccctgcacttcagttaggaaccattgttttaaagaactgcagtgtttgtagcatcctataacctattgctctgcctatgccaagatgaactggactgttgctgacttcgttgatgtcacaggttgcaacgttgcagtcggtgttttaaccatttgcaaaagattcagcaagttctacacccgttgattatgtaattcctttccttcccctccctgtatgagatgctttatcctttactttatcagactattgttttcttaagcttgctgacagttgttcgtgtgcaccatgttgtttatttttgttgctacccacgtcatttgttggagctacctttcctgacattctgtgatggtttcatattttgctggtgcaggcggggtggtcaatcagcacaacttgcccaagaactgaacctgtctttgcaagacttggtggtgatctgaaacaagcggggaggttcattcatactagtacaacacagtgagagtagataactagacatcattctttttggcaaaaaacgcgccagcgccatacagtttttgtagcttgttgccatagctttgcaattgagctgtgtaattgtgttttgacttggcttttgattcggcgtagtcccctgttgtacatgtgagcttggctgtgcataatctgtaattaacatttgttacatggacagccccggatgagggagaagcaagttcaaaaatggttgatgtcagttcaacgtggtgattcattctcttctttcatgtaatgaaactgttgcccgtgtaatctggaatctggtgataattcaattcaccatcaacgaagtggttgaagttttgaagacagagtttggcacggtttgaacgcattacccattccccgtttgacttcaaattcaaaccagctgggtgctgatgactgtcttgtcatcatttgattatttcctaagccctgtttccttcgttcttaagaaaacactcgtctgtatgtttttttaccaattctgggggatccactagtctag

SEQ ID NO: 49723 - DNA, 1692 bp, Oryza sativa
gagtgatacccctgacatgtgaacgtggtggggtatggtaggtacgcctgattgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcctagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccatagaacatcacccagccaaaaagccagagcaagtacgcctccaaacatcggctgtaggagtactcgtcggcctccgcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggcttgagcgggaggtgcggtgtgcgctgtactagtgcgaaacgtgccgtcagatcgtcctgccagtccacagccgtggtcactggcccaacagcgtctcctgcaagcggtagccccaacaagtacgatacgtcctgtagggtaggggctacctcaccgcacggcaagtgaaaagtgtgcgtctctggcctccatcgatcgaccaaagctgctaggagggacctgtccacagtccatcgtctggccgggtccgcgtcgccggccgcagcctccaccagccgacacatcggtaggaggccggcctcacatagcctgcaataacaaattaatatgtcattataaaaaatattacagtgcaactaacttatagtaaaacactgttcgtacctctcgacaaaggagtcgtgaaccgtgagtagctcaccgcacgttcgtgctcggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattataaaatagtaataaaatcatgagattaattatgtacaacaagagtacaggctatttaaatatagcaaacgttactaatagtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcc

SEQ ID NO: 49724 - DNA, 2063 bp, Oryza sativa
ggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgtttcatactcccaaactgcaactcttctatcgctcgctgacggagcgaggggctcctcaccaggagaccgcgcaggcccccctttgccagttcggccggggaccctgggtgaggttctaagctcccaatctgtggaaggttcgccagactggaaacacacaagacacgggcgatgtatacaggttcgggccgctgagaagcgtaataccctactcctgtgttttggcggattcgcgtatgaagaagctacaaagtgcaagtcagcccccgattctcctgggatcgttttttcctcctcctcttttctaagtgggcaaggtcctccttttatatctcaaggggatcccacatgcaccatctctccctccctttctttcaacttgacttctcttcattaatggacggagatttgcatcgctgccatccgaatcaccttctgacgggacagcccatacctacctccacttccgccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggagctaacacgccggctccggctagggacgagtgcttggagactctcgtcctgactggacggggcgaggcgtgcgtcagaccgcctgtcgccacctgacccacgatctgaccggtctgtgactggtcacagaccggataaacgagcgcgctgcactgcgttacacgcggcgtgacgcgttcgtccaaaccgcaataaatgcagttaggtgagcgccactgtgctcaccaaacccatacacgcggcgcaaaatccacaaggggtcggggcgccccagccctcggggccaaggcgggagcggtccgaccccctcggggagacaaagaggagggcgaacacaccaccctcgggcccgacgccccccccccccgagggtgccaggccacgtgggcgattgtgtctacctcaagcctctagtcacgatactcccggtcccatgtcatcgacagtagcccccggcgttatgccgaggcgattaccctcctcgagggaagcggtcgggcgtgacgccacttcctaaggcctggtgacaggtgggaccggtttccacagttgggcagaaacccaacagtcgcaaatcacgcacatcggcaatggttactcggctgtcaataatgaacggtctcttcaagactgccacattacgcgcgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggataagtggaagagtgggcgcgagaatcgagggggcaagatagtgggcgcgagaaacgaggagccgggcacagcgttggcaagggtataaagtcgccgaggaagagatttgcttcctttctctcgccattattccccttgtcttcgccgcttgcgccctaactccttgtttcatgtgccctaccttcgccacacgcgctcgctctcaaacatctcttcttccggcgtcatggcacggggctccgctccgcttgacggtagcgtgctgccgccttcccgcatcgtgagcgagagacaggccgggctgctgcgccgcttcatgccggaatctgcgaccggccaggagatagtctcgctgggcgaaagatgcccggcgccacgctacccggggcgg

SEQ ID NO: 49725 - DNA, 1111 bp, Oryza sativa
tactcaaatggagcattatttaaattaaataagttatgggctattttttcaagaaaaacatttcaacttaaatatttaaggtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcaccatgacgttcgcctgttcttgcagcagtgcacgtacccctgctctgagcgcatcaggctcctctaccttcaaaggtgtgagcctttctcactaacatgtaggcccatatgggcccgatgaaccccaggtccacctgttagtgacaaaggtatggtgtctttgaaagcagatgatct

SEQ ID NO: 49726 - DNA, 1504 bp, Oryza sativa
aatatgcccaatatagtaattttactttctgttaatttgtccacccaatcttaaaaaggctggctttccagcacagagggagtaggcttctttgtattcctcagggaagactccaaatggtagttgtttggccgtcgtcggctcgtcgcctcgtagagatgcatccagggtttacattaccggttgaccactaaatttcgagctatatcgtatcacggttttcgataaatttcgaccaaatctactgtttaaccttcgaaattctaatcagaacttaattttgagtcatgccaaaacgtcgaaatttcacagaattcgaccagtttttgttggaattgtgaacgctggatgcatcatgattcatgtcgccgtctcccactctctcgctactgccaccgcggcgccccgcgcgtccagtgttcccatccctgcggagttgggagacaacgctctcgaaatcgattctctgctcgcatcctgccctcatccaacattccaacacaaggcacgcacacatacatgacagtaacttggcagctgcaaatgcgggcagtatgcacagcacgtagtcacgtatagaagaacggtacagtacgacacaaccaagcagataccagctggccagctcgagccttctcgttggtggtcaacccaaatgtagtaagcttttgtatctcttttccaaggctcgcctggcctggggcaggagaacccgagcttctccgccatggggatctccgccgccgccgccgccgcccccttccttctcctcgtcgccctgctgctgctgctgccgtcccccgccgcggccttctccttcacctacaacttcacctcggcggacacggcgcggtcgggcatcgcgttccagggcgacgccttcttcaacaagttcatccgccttacccgcgacgagcgcatcggccccatcaccagcagcgccgggagggccttcttctcgcgccccgtcccgctctgcgaccccgtctcccgccgccgcgcctccttctccaccgccttctccttctccatcgccgcccccgacccctccgccgcctccggcgatggcctcgccttcttcctctcccccttcccctccgtcctccccaacagctccgccggcggcctcctcggcctcttcaactccttctcacgcgggggcgcagcggcggcgcacccgcgcccgctcgtcgccgtcgaattcgacacctacaagaacgagtgggaccccagcgacgaccacgtcggcgttgacctcggcgggattgtctccgccgccaccgtcgactggcccaccagcatgaaggacggccggagggcgcacgcgcgcgtcgcgtacgacggccaggccaagaacctcaccgtcgcgctctcctacggcgacgcggcggcggcggcggccctgacggaccccgtgctctggtacgccgtcgatctgatggagtacctccccgacgccgtcgccgtcggcttctccgccgccacgggcgaggccgcgagctgc

SEQ ID NO: 49727 - DNA, 3010 bp, Oryza sativa
tctttacaaggttggcagccctgaaaagtattcgtgtccttgtgctttcgtcattaacgtcttcttcccctaggggagatggtttgttctggtcaggtcaacttccaaacctaaagggaaggggcatagcatatcactagtgtactcgtataactgtagtattatccagcaatctgttggtttcaagcttctagtaagaaacagtaacagaaaggggttcaaataggatcatcgcccggaaaagtcgttggtaacaaaaatcgtcctaaagatcatcaccacacagccaaatgccaatacactacacactccataaaactcttttgagtttcatagcactgctgcatctgacgcaggaaatttcgctacatatgcttcactgcatcatgtaacatgctgtcatgttaccgggacaccggcgcacctaccctccatactccatgacccatgtttcctcgtctttgacagtgcgagcctgcgtgatgtgcgaagtgtaaacactagacttttgcctctgcacggggtgctcctagtaaattcccggtcgccgtggcgtgaaatccgtgaggattctgagacaccaagcaacgctgcaaacggcctccaccgaatccgaaactcccccaacaacctaggaatcagaaccggcaacgtcaggtcgcacttcctatgcgcacttgcagccggcgcccagcaaaggggacgatgagaagacgagattttctttcacggttcaagctttcacaattttacttgttcacttcttcgtgattttactttggtcgtatgggaagtgaggcaaccattggccggatacttgggtggaatttacgaaacattactgttttctcttttgttttctgacggaaggcagtagtagagagttggagaattattatagaacagtggtcgatactgcttaactatggagtttcatgatctcacaatctcaacttttcttgtaactactttgtttgagaggccggagtgccggacacatatcctctcaagtctcaactaggcttaagcaagctttcataaaaccgttcaggctaagctatcaaggtttgccatttgccaacttgctactatacaatgtaaaaaacgaaaaacaaaatctatttgatctctttaaaatattgggacgtctagtcaaccatctcagactttaagggtgggaaatattttcttgggccgtgtttagttcacaccaaaactcccccaaactctcaactttccatcaaaactttcctatttacataaactcctaactttttttttccaaactaccaactttccccaaacttctccttaatttcagaaactaaacacagccctgatgtcacgtataacaagttttgattcaaatgaaagttttctaattaaggccttgtttagttcgcggaaagaaaatttttaggtatcacatcggatgtttgaccggatgtcggaaggggttttcggatacgaatgaaaaaactaatttcataactcgcctggaaaccacaagacgaatcttttgagcctaattaatctatcattagcacatgtgggctactgtagcacttatggctaatcatggactaattaggctcaaaagattcgtctcgcaatttacatgcaaactgtgcaattagtttttcattttatctatatttaatgatctgtacatgtatccaaatattcgatgtgacgtttttgggaaaaaaattaggaactaaacaatgcctaaattcgcatgagtccgggatagtagattgtaaaaaaaaaacccaaggctcatgagttactcgagctcaatttaagctcgcctcgagttctagttgagtagagctcgagcctatgccaaagctcacgagctttgtcaagctgagctcgagctcatgtcgagttttaccgttcatttaataaagtagtacatcatgtatgccatatatctgtatccatgcggtgaagtatcttgcgttggcacaatatatttatcttattatttttcatcaatcattagcatgattaaatataaataaattatttatttcaagagattatccttgaaatatactatgttgcgctacttataagccgactttgtaggaaagctcaagcttgaaccgagcatgtctaaaaactcgaaggttactcgggctcggtttgagcttgagcctagataggtaagcttgctcgagctcgacccgttgtcagcccaagttacaagcatacccttacacccaaatccataacatgactttcactgaagcaatgatatgcgcgtatcaatccgacaaacaccaaagacaacacacaaagggcccgtttcgtagagcttttaacttctattaactctaggagttggggtttggagcggagttgtggagcagcctaaacttagttccacatctctaaatcattttgtgagagtgctccacccagctatattcccattttaggtggagttgaaattgttcggctaagctccagctccagaataggtgaagctggagctgaagccgtgccaaactagcccaaaaccacaacgtcgcacaccaactttcgtgagagttttgcaggaaaatagtactaccttcgtttttttaatatgcaacactattgattttgaacacgcatttaacaatttatcttattgatgaaatatgagaaaaatacgtaattatcatttgttttatcgctagaagtactttagacatgatttatatagcttttgcttaattttttgaataaaatgaatgatcaaacgtgtttaaaaattaacggtgtaatcaacgcttctcctttttaccctaaaaaagtatctctttttcacgatttcaaccgtcagaaatgcgaaacccacagatttgcgggtgccttcggcaagaaggcgtttctcctcccgcacgggcccgtgtgcagcccgcacccgagattgggcggcccgctcccacccccgtccgtccgtccgtcggaagcccaagccaaccgcctcgcgactccaccgcgtctctgcacatgc

SEQ ID NO: 49728 - DNA, 703 bp, Oryza sativa
tcggcggcggagacgaggtcgcggacgtaggcgcgctccagcttctccgtcgccttgatgatggcgtacaggtcggcgaggctctccaggagctcccgctcccgcttgtcgttccacagcttcacctccatctccgccgccggcgagggggtcccctagcctcccttccctccctctccctctccggcgagcgaatcgcggtgggggctagggttccgccgcgtcgcgcgagattggggaaagaggaggaggagagggatcgcgatgggggagtttaggaggtcgaagaattgcgaggggcttcgtgtaaaagtgaagcgatctgtgtaagactgtgttaagcccaacgcgtttgttttgcctttcttccaaagttattactcgacctctcgacgagaaccaaacgcaactacgaattgcacggcagcttctgtcgttcgtttcttccactgcagtttttgcgtcctctcaatagaaacaggctttgcggttaagctcagctgttccaccgcacctaagacgagctaaatcattaatgtataatttaagagcttgttcactttgttaccatttttaactttaccttttttttaagttataaaaaaaagtagctgcatttagtttgttgccaaattttagtaagtacatatgaaatcttgcgaaaatttgacaaatttaccaaaattttggtaaccttatcgaa

SEQ ID NO: 49729 - DNA, 763 bp, Oryza sativa
cataggataataagctagttttaggccttgaacagtagtccttcaatatgtactgtcatttctgatgtatttcagggatttattcttaatatttatatattaacaaagaagaaaaatagttagtaaaccaaactgtttcctgccacaaagaatcaatacggccctaggaaccattgtgatcatgcaggatttcaaaaggaaaacattaactataggcacatctgaacctaggtaaaaagctcttgaggtatccataaaaggccccagtgaacatatattacattaaggcaggaaaatcctttagctatatgctgctgtaaaatggaataacttagatacgaacaacataggtgtagggatgtacaaggcgccaccacagaacgacacatcctattctctcccgtccatcgaagcagctctatcaaaaggccgatctcatagcaccacgagctgcctcacgtttcatctcagcagccttcccacttccacggaaatacatgtatacttgctgcatttcaaacggccaagttcagaatgacatctcccaggagaaaatgaagacagcattgcagcggaaattttattgcaacaagaacaaaatcttaggggacagcacattctagttgggagtggagacatcaatgcaaatagaaatgtatatattctgaaggcacagcatgacgcatgatgatgaacggcagaatgaaggagtgttgctgaacagacaccaaggtgttactatttggctttggctaagatcaag

SEQ ID NO: 49730 - DNA, 1279 bp, Oryza sativa
ttggatatgacagaggtagtatttagcaggcagctcctgtgttgtgcgggaactggggactctttgcgatgtctgtgttgcctggaaagtgtgttattgccttattggcccattcgcccaaggtctagcagtctgagctgatttttttttgtgtggaataagttcactttgactcccttaactggcgtccgaatctgatttgtatccttgaactgcaataccggatatcgcggcccataaaaccggtgtaatttgactccctcggtggttttggatggtggtttcgttgacgtggcgtccacatggcagtgttgacctggtctataacgttgatgtggcgcttaggcggcattagagttaaaaacatgtatgtaggactcatttgtcattcacacaaaaaaaattatggagcccgctgacatgtgggccccacatgtcagcctccatctatttcttcttccttcctctctttctctttctcggtagagagtgacacgccgtcgtcgccttgacggtagcggtgggggatgaatgagatgagtggcggaagaggaggtggagtcagagggggaggcatagtgaggtggaggagggcgcgggtggtggggatgggcgaattggcggtgaaggtgtgggcatcatcaacgccgaagccaagttgctaccacatgctctgaggcggtagaagctggtgcaccgaaactccgcgacggccggagcgatggcagcgacatccaagtggtaggggcgtggctccgcctgcacgacgacgcgccactgcttgttgacacagggcgccatcgcctgtcctctcacctgacgccgcccttcaatggccgagggggaagagtgcgctgatagaaagagagagagagggaggaggaggaataagggaagggaacagagagaggctaacatgtgggcccacatgttagtggggcccacctttttttttgtgttaatgcaattgggtcgcacacatatttttaaaactataatgccacgtaagcgccatgtcaacctcacgtgaaagtaagattgggtcaataccgccaccgtaggcgtcacgccagcgaaaccgctcttcaaaaccaatcagaaagttaaattgtaccagttttaatagttggggtcgagatatccggtattgtggtttaggaatatgagttagattcggcctctagttaagggagttaaagtgaacttattcctttctgtgttgctcggcgttcttcgggctggtccacaaactttaacacaaagtccggtccatcaactt

SEQ ID NO: 49731 - DNA, 2185 bp, Oryza sativa
ggctatctccgagaggcgctgggcgaggcccccttggttggcggcgtacttcgcagtccgcccgccccagaggcccacttgccggccggcgcggtctagacgggagacggcgtcccgaagcatgctgggccctacctcgcctgccaagcggagggcctcgacctccccggcggacgagtctagcgcgccctgcagatcggcgatggtgtgttcggcagctgcgaggcgagcggttaagtcgctttcgcccgcggccgccccgccaatctgtgccctcgcgtccagctccttctcccgcgcctcgagcacagcggcccgctggttcagcgcggccctctcggcgcgggcatcttccagaatacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggttcccctccacggcgcaggcacgctcttccagcgccatggcacgggcctcaagggcttcgtcgcgtcgccgggatgccacctcggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcggcccacttccaccatggcctccaccgagcgtcgcccctcttcgacacgcactcatgcggcgtcgagctctgcccgctctgcttgcagggcctccacctgggcacttaacccgtccaacaccgtcgtgtttgcgacggccaaggcctgcagaaggggttctgcgctcagtggagcaacagaaggcgtggggaagagccgtctcggtgaggatgccgcgcggctcggcccgccgatggacgtgccggactctgggatatcccccggacctagcttgtcctgagcgtcgcccgagggattgggcccaagcgatgcgcccgcggcctcgtcgcaagctgcctcagaagttgtcgccgcctcggcctggcgaagtctggcctcttcccgagcggcttcttcagcttggcgagcttggacggccacctgaacagcttcctcggcttctcgaaggcgatccgcggcctcttgccggtcagtttcacgggtcgcctcggaggatgtcgtcgcttcggcctggcggagtcccgcctcctcccgaacggcttcctcggtctggcgagccagggcggcctcccgagcggcctcctcggcttcccgaaggcggtctgcggcttctcgccggtcagattcccgccttcgggcctctgtggtcgccgggtcctcggcctcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtcccccccatcttgcggggccgtttcttcttccgctctccctcgggctgcgacgtcggcgtggccccctccgggcgcctgctgctggcacgcgccgccccgccccctcggggaggagataggggaggggttccttcctgcttcctcttcccccgggcgtcggcagggtggccgctccccgggcccccgtcgcgaggcccagaagcacgaccccctcccggggtagatcgttcccccctgcggctcccacccgcgccatcgtggcctcgaggagcccgctcctccgacgccccgaccgcctgcatgatggtcaagatggaggcacggtctggatcactgcagagggggaggactccttgaggaatgagggatgcctccacggagctgagattcagcacccgttggaccactatcttga

SEQ ID NO: 49732 - DNA, 1141 bp, Oryza sativa
cttcaaaaggtaagtttcttgggtggttatcaccagcaccgagctgtccaaatgaaccatctccacacatgaaaagctgtccagaatctgaaaataagaactagaaacatcacagctaagctcatcagtaatggttttatttttgaaacaaaataaacacctgaaatgcacagactatatgtgatatagagtataaagtagattttttgaacataaagcataaaggatcaaaagaaagtacaaggaaataaggtggtttcagaattggacacctgtagcaaatccagaatggttccatccagcagacacacaggttatcatgtagttctcaaagaactttacaagctttggatgagggatgttctccacgtccccatgaccaagctgaccatgtgtacctcttccccaagtaaatacttcaccatcacctgaaatgttgagtagctgttcaaagaactgatgcatattgctcacgtgaaggcatctgatgcagagactaaattcttgaggactgacggaaatgggacaaggttgccaatttagggcacatacaaaatttctgcgtgccattgcactaatataggcacaaaaagattcagatttacaagcccatctcaaaacacccaagaggaaagaaggcaaaaatgcttaggttgccaatgagagaattttcttcctggtaaatgatcaagcttcagcgagcaatatatcttgataatggaacaagaatgctttgaaaaaatggccaaggatagaacaaatctgtgaaacatatccaatcactaattactggaaagcggaatttgaactgaaaaggaaaacactcagccccttgttagaatacaagtatacaacagagagatgtctctccacttaatggcactaagttcaaatattcagaacaaaggaactagcgaaaaccgaaaagttttaaatttgtgaaatagaaaactgttctgattaatcatcaagcccaacacagcaacacttcagtggtgtttggatggaagtgattattctagacactagaactggtgcaaactgaagtctctgaacatctgttgctatggtgagcaaaactacatcgccgtgcacaaatccattgtcaatctaggtatctaactgagttcagttccggcaa

SEQ ID NO: 49733 - DNA, 2056 bp, Oryza sativa
tatgtattccaattgtttcactaattgcaaattttaactacttttttctatgatatgtcctgaagtgtcacaagcaaccgcgatgaacggtcctttgcgggtattatgcgtgctaattccttagggttaatggacgatacaggactaacgcggaggatgtaagtctctatgctatgtactagacagctcttgatatttatgatactaatatattgattaattttaatgcatgcagttgccaagattagaatgtcgaacaagttttgacgatacaggtatcacaaatgtgcagcgtgatctgtgccacttcatccaccacgagtgttgtcatgtcaaaagagatttcttcgacccagagggtgtcctagcggcaagtgacgaattcaaggatcttcgggagtggaacactgctatgccataatgtaactagatgacgttatttgaagtgacaatgtaaaaaaatattgtaatatatattattttggcaacacttttgatttatgcaatatatgtagatttctcagtaccaaatgcttgataatcttccaatatatgtacataaaaatctacctgcaagaatttctattaaataatttaaaagtaatttacggccaaattataattaaatttcaatattttctacctatctttgcaggcggaagttttttttttttttttgcaagcggacgattcctattttcacaggcggaccggactagccaacgtacgcctgtgaaaattatcttcgcaggcggacggccgccccgcctgcgaagatcggcgatattcacagtcgttggcttacaggcggacggccgccccgctgcgaagacccttttcggccgcttgcgataatgcttttcctagtagtgccacccgttgtttcgctctagctccgcccctgaccgcccctaccgccacgacccggcacggcgctaccgacttctgcctccgtgaggtcgggctcctcctccccttcgaggtgcccccacccttccgggccagcgaaattagctgtagcgagctcctcgccggagtcgtctcgatctcctctacgtttccatttttttctctttttcttgttgttgtcttttgttttatccatctatcggtttatgtatatgagataacgagagttaggctggccacgcgcatcatatgataacaccgttgtatcatggccgagatgggcctagttgggccgaaaggatgtccatgttggccatccgacttgatgtcatcctagctcgtttaggctcgacggctcgcgatccagctcgagttggctcgttatttctaacgagctaaaataccagctcgactcgttaggaaaatgaaacaagccgagctgagttgaaccgagcttgttatgagccgagttaacgagttacgagcttttcgtcaactcctagctacaagattgagtggagtggaagcggattttttttcctcgaggagacatcccctcattttgtgcatgtcatttataaaattatcaaatatttttaaaatttatcaagatagatcaatatatgatatatcttttcgcaaacatgtgagtcaaaattcgagttatacaattcaaaacaaaaataataaatttgaccgtgaattacgcgttcacttcatagtcaaatttgttattttttgtttctacttgtataagttgaatttgaatttgcatgtttgtaaagtaacatatcacatattgatctattctactattttttataatttttttgatgactttttaagtaacatgaaaaataaagggatatctcttatagggatgatttaagttttcccgagtggagtaccgtttagagcaagagaagattttgcctttttatctttggtccaagcaaaagctccgcaccgcaacagctctgatcttgtgagtgactaccgagcgaatcgcgcgccgcagcgaccggacgtcgcttcggcagcgggcggatcgacgcgaatcgacacgcgtgtgcttacggcgacggaaagttccagcaaacaccggcgtctcacgtgctggttggatgaacccggcgaatctcctcgc

SEQ ID NO: 49734 - DNA, 1149 bp, Oryza sativa
caaacctaataatgctaatatttaaatcacttgatattaagtgctgcttatgcttttcattaatgaacttttaggaggctaactatgcttccttgtgcaaataaacaatctaattgcaggagtatgcagctgctggtactgtcaagcaaaactacgtcaatatcctgctgatgcttttacggctcagacaggcatgtgatcaccctcacttagttcgaggtcatgagtctacttctagttggatgtcttcattggagatggcaaagaagctgcctgtagaaaggcagcaatcgttgctggtttgcttgcaatcgtgttctgcgatatgtgctctctgcaatgtaagtgataaaagtgaatgtgctgcctttttaaaccacacctaatatgatatcgtttctaccttcattctttgctctaacccatgttttgtgttattgttgcactgtactttgatattatctatccagctgtggtgtggattgtggattgattattttcaaagttggaatgcattttttgagttttctcagtagcacatagactgccttaggttactatcagaacatgagattcttataataggatttataagtgcattgctggggattgatcgtgagcttcctttcctggatgcttatacaatttctaaatccatagctaagtaccaaattatatcttgtggttagcatacaacatgatattatgtttgcatggctatcagcggcttgattttagtgaagaaataattctttgttgttcatgcataccattttcctagcatccacttctgattcattgatccgtacaccataaattgtgcaggatgcgccagaagatgccgttgttactatatgtggtcatgttttctgcaaccagtgcatactggagcaacttaccggtgatgacagtgtatgtccagtgtccaattgccgagtccgactaaattcaacttccttattctcccgaggcacccttgaatgtgctctgagtagatcaacctgtgagtttctgtctgatgattcctgtgaagacatggtgcaagggaagcaacctagatttgattcgtcttatgcatcttccaaagtgagagctgccctggatattcttctctcgttgcctaaactggatttaacccatatgggtgat

SEQ ID NO: 49735 - DNA, 2325 bp, Oryza sativa
cgctctccgatcgtcgtcctccgccgccgccaaccgtcgtcgtccaccaccgagaccgacgtcctcggccgccgccgaccgtcgtcgagctctctgccaccgccgccgccgacccctccaccgcgcgcccgctccaccgccgccggctcctccaccgccgccggctcatccaccgccacaggctcctccaccgccaccggtctctgccaccgccaccggctcctccaccgcgagcgcggccgtcggtggcccctccaccgccgccagcccctccaccgccgtcggccacccctccaccggcgccggccgtcggcccctccaccgctgtcggccacccctccgctcgcggccgaacggcttcatcggccgatcgtcgtccacgagcgaagacttcctcggccgaacgacgtcttcggccggtcgtcgtccacggccgaacctcgtcgtcggccgttcgtcgtccacggacgacgccggtcgtcgtccacggccgaacctcgtcgccagcccttccttcgtcgtccacgaccgaagctcgtcaccggccgttcgtccaacacggacgtgcgtgcatgtgggtgtttccttttatatgtgtgtgcatgtgggtgtgagggggtatatatgtgtgtgcatgtgggtgtgaatgggcatgaggggtgggtgatatgtgaataaggggttatatgttgattgtgaatgtgaatttgggaatgtgggtgatatgtgaatgaaattgggagggtatgttcaattttgcaggatatgtgaatttgtcaaattttttagataacatgttggagggtatgttaacaattttttttaaaaaaatgtagaggatatgtttgccttttccattttttttagtcaacatgtcgatgaaataagtaagtcaattagtgcactacttgataataacatatcaaattttgtacaaatttgttttttagtaattaatttagcataatagtaagtagtcattagtttcgctatttaaatttgtttgtactaattaatttagcataatagtaagtactagttaaatttggaaatctcagagaatttaaatttgttcatacgatatattgttaatacacagtttatttttgtactaattagtttgtactaatttgagtaatttaaaatgtggacaacattgactacccgactgcagatggtgtatccgtacttggggatgcggtcgatcttgtaattctctggcacaagaatgacatatcctttggattgggcactgacgctggggaaaaacctgtgttgcctaaaccggggttgggaaaacctccgaggcctcctaagaggaaggtgactgataaggcggatgatctagagatgcaaaaggaaaatccagtgctggaagtgccaccggatattgcattgccggaggcagccatggagattgcaccgccggagacagccatggagatttcagtgccggatgtgcccatggagattacagtggcagaaccagaggtggaatttgtggcatcggtcgggtcagacaaagaagaagtaccaggattggaatgggacggtacagagccagagatatttgaagacccttctcctgcgaaagaccccgaggtgccacgagtgcttaggagccacgactccaagtccaaagatgcgagcaaggagaagttcatgctaaccgtcttcagagggggtaaggaacgtgccaagctcagagatgacgacccccagaaggcttctgaactagccgggccaacatacttcgcaaccgatgattgcccggaaaagtacgaacatgggaaagcactcttgccggaatgggcactgaaagaagcaccatgggagatgagaaggttacataacttctacatggaggccagcaagaaaggcttgggcaatataacagctcgatcaccggcagattgtttcggcgaagaaggttacgtatggctagatttctcatatctctacgccatatatcgtcgggataagatggatgtcaactacgtcggtgtttggtgcatgtgagtatgagttttaattaattagatgaaaaatatgtacaatacaaatccatgtgattgttactaacaaacttcttctataggatgcaatacatggatgctaagaagaaaaaagaacccatcgacttcttggatccaactcggatctgccaaacacagcataccgtgacgctagcaccagggtcagaccagctgaagggtaagaatccaaaagagatagcagaatacaagaagggcttgcacaaggagaaattgattactgtcgcacagtacattggacgagccttcttgcactttcaaaataagagag

SEQ ID NO: 49736 - DNA, 779 bp, Oryza sativa
ataataagacctgtatgcaaaacagcagtgtccgtgtggagacaattgatgaagccggggaaaaacaatcatacttcgggtttattgaagaaatatgggaaatcgactatgggcacacaatgcaattccccatatttaagtgccagtgggtaaaatacccgaacggggtcaatgttgataagttcggtcttacttttgttgaccttgcgagtatgggtcacaaggatgacccttgggtactcgccaatcgcgtggcacaagtgttttatgtgaaagacccttcaaatttgaagaaagatatagtgctaccagggaaacaaaagatattgggagtggatggagttgaagatgtcgaagattacaaccaatacgatagtatgccactttatagtcagtttgtatagaagattaagaatgtcgagacatctactcagaagaccgtgaagccgtacatgcgcacggacagtgtgggcaaaaatgttaaagggtaatgattgtggagtggcatgtaagcatctaagaagtaattagttatgtaatggtcgtatgtaaggtgatgtgtgatcatatcgcaaattgatgaacaattgtactcaacattttgcatattaattagttcatactaatttttatgtgcaattaccatttgaagtgtaaaaatttagttaaaaaatttaaaattagtaatatttgaaaagtgtaattatttttatgtgcaattaccagtttgttaaaaagatcttcgcaggcggacgatccgcttgcgaagatagtaaaaa

SEQ ID NO: 49737 - DNA, 1153 bp, Oryza sativa
aggagagccaacgcctagaccaacgtatagcaatggtagtcttttttcatgagatttcccgtagtattttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaagccggacgctcaaagcaatccgttagcgttcaggcacagcattctcctggacgagggtaatacaagaccagaagtggccgccgcaaagaagtctccggacgaaggatatccttgtcctgacccgccgcgcactccaattctaaccggctgcctggagtgcaccgaaaggaagctataaaaccaaatcaaaccccatccacccgcggaagcatgcgcgccaacgcactccccacgcgatcccacagccctccgcttcctctcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgccggagcatgtgccatcctgggctgccgcctctgccgccggggtgcgaggtcaagcggcggagggcgccgccggtggcgcgagtgggttccccgccgcccgtgccgcggcgggagcagcctcatcaggctcagccgcaccactactgcgtgtgctcgcccacggcgcaccgcgggtcgttccgctgtcgctggcaccgccgcggctactacgagtggggcgcctcccgccgcaggtagggcaaagcccgttcggtgggtgacgcgtgcgcgcatggtggaaactgctcgacgcatcgccggccagctgcgtacaactcatggcgtcttcttgcgcatcatgttcggttgctcatgtgtttgtacacagacacacagtgtacagttgttcgaactcggaaggaaacacaaaacacttaaataagcgtacattactctatagtt

SEQ ID NO: 49738 - DNA, 717 bp, Oryza sativa
ggctttacctacttctatttgctaaaattattattacatatcgtactggcatgcaaagtaatatgaaatactcattcaaccacaacaaaatttgaagtacaattacatgatcaaaataatttcttaatgtgaaattcctgaacaatgtagccaagaatgaaaaggaattcgtcagtaactatagcttattgaaatggttgcttgtgactgaaccagcacaagggacataacgcatagtttccttcagtgacatgttcgattatgttctattgacttttttggagaactggggacatacttgagccaccaactgatgttctagctactcaacaacatttgacgtgaaaaaagagtgacaatgcgagaattttgatcaagtttaagatgtataaagtttatagctcatttttggggcctaattttcaatatctttttgagcggaaaattttaacttgaaatgagggctattattttactagtgtgatgtctcacgaatttgaagtttgaaaagtagaaaacatgatgatatgtagaaagaagcatgtgaggatgccaatcatagtttgatatttatattcaggttcatctggatgatgctctttcaaatatcaaacttcaactgttcgctttaattgcgaggcagcctgccgccaaccagctacgaactattgagcagcttggctatatagcagatctttatgtaaggtacgtagcaga

SEQ ID NO: 49739 - DNA, 1413 bp, Oryza sativa
gcaatgcgtgcgtgcagggtactacaatgggccgccggtgatggcgccgccgcagtacgcggctccgccgccgaggcggccggagccgagcttcctcgaaggatggtaagaacgacaaagccatatgcgagcatacgatcgtcagaatactgtctctgtcctttgcattctctctgctaatcatggtgctaatttgtctgaataatacagccttgctgctctctgctgctgctgcctcatcgacgagtgctgctgcgacccatcggtcatatttgtgacctaattacggtcacagtggcgtctcgactggttgacgaggacgaacagtctgagttgagatatacactgtacacgtgcttgccttttgttaaatgttgataattgtatcggtctatagctagattacagtacaagtcctccgttaagttcaggttcttcaagtatcagatgcatgcgtgatccacctgcagtggaaatatttatattgcatgcactggttgctcgattaaccaaaggacgtatacgtttctatgtgtatgtctgcatgatcgactataaagaataaacgaaggtaaagtgaagttatactgtgcatggtcctcaaatctgcaatatatattttgcgcccccctgaatttcttctgcaatggcattgcacattcctaatcgaacggttggcagagattccgatggggttcggagttttcaactccgaatcccatcaatgggccttcacgagcccgttcagcgccataggccgagagcccgaggcggagcctcccatcaggcccaaggatcacggagcgtcgcgaataattccactcatctaggccgcacgggcttgatcgaacggtcgtcgggtattccagggagctcggagttggaaacaacgaacccccgtggccctgtattcgggtggcaagaatgaggcgccaggcctcgccggagcgccgccgcgtaatacccgtccccagaggcaaagaggacgcacccgagtgcccaagttccagacttccagtacgccgatggcgtctgggtcaatgtgccatttgtccccgtggcagctagcctcagagaaaagaacgagctaaaaccatagaaggtctcactcttcttcatctgcattgatgaacttactggagcagaatttcatgcatggccataatgttgcaaagggcaagttcgatgcagcataaaaggttccagctgttgttgttgcaacactgccgcgcagagtacatagtcctaatcaccgcaacacgacacgttaaccgctagctgaaatcccagagggggtcggagtactccgaccccatgcaccagtgcatcctcctcctgggctcactgcggctgtgcggcacctgctgctcatctgagccgcacatatctaatcagacggcgggaaaagattcc

SEQ ID NO: 49740 - DNA, 3530 bp, Oryza sativa
aaaagttggaagtttatgtgtgtagaaaagtttgatgtgacgaaaaagttaaaagtttaaagaaaaaagttggaatctaaacatgcctatagagaatataccaataagctgaatagcaaacactccgattctaaagtccaattcaaagaagagttcaatcaatgccatgtgacgtgatgtcagagagacaggaaagaactacgaatgtgaccccattcacctccgacatgaaaaacagagcaatgaattagtacgtgattaattaattattagcttaaaaaacttcaaaaatagattaatataacttatctatagaattttttcaaaccacgcaccatttagtagtttgggaagcgtacgtgcggtaaataagagagtgaggttggaagcttaactgaagaatgcagcctaaaaaccatagcattgtatacaacaatcaaatatggtagtagtaatttgtattgcgaagcaatcaaagtaccatggagaggtaggtagtctcgtgcctcggtggcaccggttagcctagctagagttccggcagcatggcggcaagcagggcagaggattgaagaaggggtcggacaggggcaagcgcccgtcgtcgacgccgaagcgactgggagggagtctccatccatcgttgcgagcagctgctcatctagaccgcatatgcataatcgaacggacaacagagattccaatggggcttggagttttaaactctggacccttccaatgggcctctgtgggccaattcagcgcaataggctgacacagagaggcctctcgtcaagtcgaaagactacgcagccacaaattattccactcatcttagtcgtgcaagcttgatcgaatagtcataagatattccacggggttcggagttcaaaacgatgactcccactcccactattttgtactcctactcagcaaagaacaccaccttggccctcgtgccaagcctcgccggaccgccgccgcgtcctgtccacccttcgctagccagatccacatgagaagaggatgcacccaagctctaagcaggtttcccttaccgtcggtgtcgagtttatcgcaccttagcgataaacacgattaccgcgtggtaactgcagtaaactgtataaaatttattaaaaaattaaattatttttaaaatttgtttaaatttaatgagattaccgtggttttatttttatggtaccctaacggtaagtaagtacagcaatttgacggttactgtcggttttgtcaaccttggctgttggctccattcatccctgacggtatgcagctagctagcctgtcagatattccaatgttgtggacgatctggtcgtcgaggtgctctcgccgtcgcccgcgcatgcacgcacctttcatgggcctcgaactctggaatggagtactccctccgttcagaaaaaaaacccaatcctagatttaaatctggacatacactgtcttcagatttaaacccaggattggagtatatgataagctgaatgacatgcagattttaactctctaattcacagaagagttgttggagataatagaaatgtgatgtcagagacaggaacaaactactccaaaccatactccgcatcgatgatcttgttggagcagaattttatggtctcattattgcaaagatgcagcattgaaggttccaatatattgcactaaacaaattggatatagatgcaaattaaaccgcaacacaggcgcgcgcagccgcgcagagtgcatcagagcgatgagatctaatggcctaatcaccgcaatgcatcacgttaacagcgagctgagatcctagagtgggtcggagatttaaactccgaccccgtgcacactgccgcttcacgccagcccgataaacgtactctcttggtctctcgacgcgtagtctcggttgacttggggcggtttatgaagaagagcagaaactgaaaggcagtcaatgcagtgaacaccgtggcagcatttcatcgtgttcatgctatagcagatattttctttgcagtcaaattgagaagacctccagctcaaaagagagagagagagagaaagaaaagaatgagaagaacttgaaagcgatgctaattaacttccggcatcaacattcacgaaccaacacggtacgtcaggcgaacattaattcagaaaaataaaacatccaaagtaaaaaaaaaaccaataaatttcttatgtgctgggaatgcgtaccgtaccaaagcttgcgatggattaagaaaggagactgtccggcgagaagggaccaaagcagttttcttttttctccgaaaagcatccctggacggttggaccccatcccgagttccctgctggtgaagtagtacactcaaatggcaggcttacgtccaggttacagtctttcttctcaaactgtgacacagcagcaatccgtagcagagtcatgtcttcctttctcagttcaatactgctcttgtaatttgggctctatacaacccttttagcatttttttttagagaaggatattttttaaccggcctctacatttaaccggatatatacggccattgaaatagggaacttagccccgcaaacaatccaatctgaaattcgctccataggaaatttgaactcagaaccttggggtactactcagatcactacaacccttttagcatacatgacctgtaaagttacttaatgatccccgcaaaaaaagttacttaatgataacgaataatcaattaatcattcgtgatcaagttatattgaagtacacgaaaaagtgttaataatgctgccaaatgcagaatgctaatgccattgttctttatggactctgctagtaataagaaacaacagggtcagtgttcttgatggaacctacgaggtttggcatacttttgagttctcagtcaaggaacagcgagtgtacataacggccggcccctaaggaccagctgcaaacaacgaactcactccatttcatctttttctatttattattgaccgcggccacacatacagataagttattccccctctttttttataagaaggaaaataaacagctcgttttcttttcttttttgaacggaaaacggcacgagatagtaccttttcattgaatggagtaggagaaacagcttgctttatagtattaacaggtaataaaaccgaaacggtggatcaaagaacatatattacaggaaggatttacatcatcacataaatggaagagggtaaaataaacggagcaaaacaaggaactttcgatctcgatcggcgattattcctcccttttctacgaggtgggccatcacatcgatcacccaaaaaacctccaccaatataaatactggtttcccccatccgaacacaccgagcaatgatcatattgtaatccttcccgtcgccgagagattcccacacaggctaaaactatctatcaggcctgcaaatgcaatagggctgagaagtgaggaagctaggcaacctcaaccttattataaacacggggggatccact

SEQ ID NO: 49741 - DNA, 719 bp, Oryza sativa
gtggatcccccgctttttattgaatcaagctttcgtgttttcaaatttacatgacacttcctttcttttctcttcctgaagtgctcacatcatgttctttcaattcttcttcattttggggtaaacttccacatgcataattgtatacaaaatttggaggggttgtaatcgataaaagaacagggatatatgatgcattatagttgaatttatctaaatttgttctttgcacatcaatgtaaaatcacttaatatgacattctttttgcagaggtatgtaaaatcacttattgattcgaaactggagaagtccaaaaatttgtgggaggaatccgacttctattgggcagagattgaggcaggaactctccagtttgatagaggaaggtctgaggtaagtgctctgttttcagcaaatagttaattgtttgatggtatcgaatataatgaaaacaggttattaagcacaggataacttctcaaagaaaagaaaagagttgtgcgatatacctcttttgcaggtatctctcctaagagagctcaagaaagaagaattcatcgaattttttgatcagtacataagaattggtgcacctcaacggaagacattaagcgtacaagtcttcggcggcaaacatttggcagaattcaagaaggctattgccgaagctgatgcacccaaaacttaccgaatcactgacatattcggcttcaagcga

SEQ ID NO: 49742 - DNA, 749 bp, Oryza sativa
tccccagcatgcagggagtacacaatgtcaaaattcaacttacgtgcattaggtaccacagaagaagaggaacctaatggtcctaaaccaaaggtaagatgcaggcgatattacgctcagatacatcatggacatgtctaaaaaaaaagatacatcatgaacatgcagattgcagaaaaggggatgatttaattgccgaaatcgacagtcccgcgagccagactagcaatgcatgggcaggagcatggtacaaagtacaagaaacaggcgacgctgggcgcaggcagcggcgaggcgcatgagccggcattgcatgcaggtccagtcatgggagcaagacgccacaaccaaagagatcaaacaccacccgtgcaccgacgcgcgcgctgacatgaaatcaagaacaacgagacaaacaagcaagcaagcaaaaaggacgtggtgtactgatgatgcacagtggcgagcacggaccttcgcgacacccgggcgtgcactcgcagctgacctcgaggtcgccggaagcgtagacgcggaggcggcccacggcgtcgccgtagcggtggctggtgcacccgcacgtcacctccacgaaatcctcgcaccggcgcaccccgctgacgtcccgcagctcctcctcgctgaacagcgccgcgccacctccgttcgccgccgcagccatgcctccaaccaagaacagcaaacacaccgcaacaactcaaaataaaacagcgccagacgggggatcc

SEQ ID NO: 49743 - DNA, 736 bp, Oryza sativa
aacatacaagtttaaatttaacttttacatctcgcaacggaaaaaaaataaatttgacatatgaatatatgttaacaagctgtagtttaatatgtttttctcgttgtgaaatgtagaagttaaatataatataacataacatattaatatattttttaaatttttttcataattatttgagtgacgtacaaacaacgagaagtcgtcccctcgggatatcaaaatccactccctagacaacgataatggaagcattattttcgacctctatatcaacaaacaatgcaaacaagcattatttatagaaccttgtcgctgccgttactgaaggaggaggatgcgaggagctccggtgtagaagccggacgcgccggtgcggagccatggcttgtaaccgagctggcttctcttcccatcagggagaaatgcaccagctggtccggggaaacaacaaccagagatctccggcgaattcgttcctctccatttctacacgcaatggatttgattcttcttatcggattcgaattggatgtagtttccccctttcttaggtggataaaaaacaaaaaggaaaataaatattggtgaagaactgtaatggactgggcctagagatgccacattatttttatgatggaataagtccattttgtctccctcatctcttgcgcttgattgaattgcctccctcaaccacaaaaccgggtataatgaatccctcatcttcaaaaac

SEQ ID NO: 49744 - DNA, 6017 bp, Oryza sativa
cattgccatgctttggctcctacggtcaggatcattacctttcaatgtgagaatgtcagagaaaatttagaggtttgtttgttggtagtatttcaatgatcggtattcctttgaggtgaaattgctcttactattgtctcttttcagatactgttctacagataatgtcatgggcaccccacggcataagtctccgatgcgagagagtgcgtcagcaaaacgggaagcgttctcactcttcatttggttatcatcatcaggccaatctacagtacatctttaatcttcagtcttgcagcttcctggaacatgcatctattttcacagtgaacattttgagtatgtatgcaaatctcacctccattgacactcttaaattcatcgtcggagtcgtcctcgagaatactgacggagtcaaaccaggcatcttctttgcagcaacctacataggtacgtatgatcgatcaaattaggtcgattcatctactcctacagatcagcttcagttagtagagtagtaccattggaatccctctggctgtggtgccactgcatctgtgtgaggtggaatgttttggaatgctctgattttccatggtttgatgatgtctcaaaatggacaacctcactcattgagaagtcagtcatgtgtcctcttgaatcgttcaaccgtgacttgggcgcctctggcatgatggatcgggaattagtacgagctcttcttcctttcctggtatagtgccttgctggtggtctctgctcaatgacagacttggaagcacaggaacccatggtagtgacaactcgtgtttgtatctacatttgggaagtatgatatacttcaagataattatccttcactaagacttgatacagtattgaagtaaccacaaagattaatctgcaaggaaaaaaacacatacacatgcatatgttttcggagggagtacctaaaaatattgggtgcagtaacattatttatgtgacaccaaagaagcaaactgagggaaatgtaccaagagactggaatgcagaataacggaaactcggtgaaatacatccaagaaagcaaacagcgccaagaatggcatgaaactgcaagagggggaggggagggtgatggagaagaaggcagctatatatgctgatatgtaatgatgtgggttcatgatcaagggacaagtttggagagcatgtgcttgttggtagtaaggcattctgcattataagcattatcatgaactgtagcatataaaaatatatattctttcacgtagagttatattttgcagccttagagacccctttgaacttcagagaaggttcttgcttggtttgcctaatgaagatcttccagttgaagaaaaatattgttaatcaggtatgtcttggactgtgggtaggggaatgatgttttgtactgcatatagctgcatcatatgctggaggctgcacatatggatgccgtgctcctgctccccagggggaggttatggcatatagctgcatcatatgctggaggttgcagtgtcaatgagaagcaaatctcagagaagcatccgtggcacaaccagggatgagctgggaaggatcgttaggtgaacaaacaatgtgcaaacgattaaggggtcaatcatggggttttgagtttttgaataagcctagccggcctatattttttcaacaggttcccacttctgtacttaacagatagtgataattttactactatgttacacacattcctgaattgcatatgtagtttatatgctgctggaaattaaacgaaagctggaattagaaaaactatagaaatggtttggattttccatctttaatgccttgttattagagtaagcagactgtaagtaaaaaaattgatgtaggaagagaaatctgatttttgatatatcaaaagaacgcttttaatttagagcatgctacgtggttcatatatacatgaacgtatgcagtagtctgaaatggacgtgatcgagtaaatgtttttctcttcgtcttttggcgtttgttattcgtagcaatgatcgtgccatatattagtatgtatattcttttaaattatctcaatggtgatggtgagtggtgaattagctaccacccacaatcagtgtcaagtgagtcctccaaacaatgaggtaaatggacttttgttccttcccaacatcaaaccatcaaacagggatttttttaaaagtatggtgaaaataacgacaaataatatgaccctaagattttacaatgagaatatatttattttaatttttgaggctttagagtgtgcggtgtggttctcttatttaatttccgttgtaacacacgagcatttagctagtgcattataatgtggtgtcttacatcgtcaagctagactgagaagtggagacaatagaagaattgaaatgaattgttgcaacagaccatgttcggcttgtgaaagatcggttttgtcaacttgggcaaaactacgtgcatgttatgacatgtaaggatcaatgtgaaacagattatttcctgtctcaaatatagcaacttctagtttttaatatttatcataaaacataggaatttctccacctatatttttttatcaaccaatcataacattcaccattcaccaatttcattttgtcaaccaattataattttccgtgtttgattttatccactccatatgtctaacccccaagacgaagctaccgggggtcccagaatgaacaacccccccccttttccccctacccacgccggcggtatcccctcacacggatagatcgtaattattaacacaggtgaatcgacaagatgcacaaaacattctgcgttgagatggctttttgatattgcatgcatcctataggtctgaagatccatacctagcaatcaccttcttattctttttctttaactgcaatggatttcaatttttttttctttagcccaattgggttttcttaactttgttggactccattgtatttggaggtgtttggatataagattttttggaagctaattagatttctagtatttctaattctataaatccgtggatctagatctataattatattgataatattttgataaatcattttatttttattttagataaaatatcaaatatcaaaccacaaatagtttaacatatgaactctaagatctggatacatgtcaaacaaggtctaagtatcccatgtaataatttctcttttgaccattgcactccattgtatcgtcaatttaatgacatattaactgtcacatgtaatattttttctgataaaattgctctcgtaaactgaaaaccttctctattagatcttcaaatggatactgaagtaacatgtaatattttttatgatgaaataagtttcacaaaatgaaggtctctagctgcggcgtctccaaactctgaacacgccgtgtgactaataatctatacagaaatctcggcaaccccaatatttaaatcatggcttcgtccgtgttaaccctaaacttttttagggatggtggttgtgtcgttaagctcttattggagttattaaacataatcagcggccttggttttgccgcaagtaacgaacgcagatcatcatatgttactatttaatttgttgtttgcacatgtattgcatataagttctccctctttcaaaaaatgtaagtcctatttctttttcaccaagaccaaacaagcaattaattcattcaccatgtgacaaaatcaatgcacatgcaaccaataagcattaaaatagcttcttgggttcctatcaataatttaatttagcatataataactacaaataggacttagatttttgaaaaaactaaagaatgaaataggtctcacacttttggaaggagggagtatgacttactacgagttatgacatcacgagttatgacttcagatacgtcagtataggtgggctcacaccgacaaatttcgatcccattagcttttcatttcaacccattttgacttaagagtatgttgtttatcacctcttttcaactcctactcatttgttttccgtgcgcacacttcctaaactattaaacggtgtatttttttgaaaaaaaaatataagagagttgatttaaaaaatcatattaactcattcttcaaatttatgttagataatgattaattaaccatcactaatgaatcgctatgttttacgtgtagggaggtgaagttcccaaacaccacctccgaactcgaaataaagatgataactggtttatcattttcttccttgtctttttggatgcttttggtttggggagtttatcagctgaagtgatttggagtttaggaattaggctatttgctttgtttagttagaagacaatggagatttttaattaggatggagaatggatgaaagaacttactgctttttctaggctctaggctaataaatcaacggctaagatcgtttctactggtagtatcatactgttagtagaaaggaccggagaatcactctagcctctaggtagggcttcagagttgaaaagatttcctacattatggcttggacaaatcttagctatctatttttatttaaaatctagtctctgtctatatttactactaattcgaaccatctttacccaacaagatattaggactaaaaatccaattcacatactaattttacaataaattccctcgtgtaaactcctaatgctcttcccaaacaccccagaatttatcgaaagttatagatgcttaaaatctattgaagcaaaagatagtaattcagattacagcaaatcatttttctaacttcaagacgaaataccccacggtgtttcccacaatgaaagaaaaaaaacactatatgtaatatattcaagtttcatataggcataacataacagttatatactatctcccttgacgtgtgatacagaccttattgaacacagcaatggagcatgcatgaaatccagaatatagtgtctcaaagatgttaatgaattggaagaagttaatcagagaagctaggggaaagaacctctgcaactacgagcaatgaaagtcgatatgcgtgcttgcatgcatatgtatccccctcccacggatgaacgacgacggcggcggagggcggcggtgtgggggtttaccgtcgcctctgccgtacgccgttcgacgtcaaaccgccggcgacgttgttaggagaggttgagtggtaaagagagaccgtagacaccaacgagaaatgttccgttatttagcactggtattgcccatatatagtagttttctttgtttgcatcaatgcttgcatgttggaggagagaaacaaggcggggaagatggcggcaagaataaaccaacagctagatatacacctcatttacgtggttgccatttattaacaacaaaatttggtaagatatgcttggagtcgaagataaacacctaggcagatttggagcagatacaatctttccagaaacagggtgcgtgtcagctggatattatatcggctgagtctgattcggacacagttggccagtacaagaataattggtttcagattataatttcgatattttgctatacatggatagagtccattacagacagttgtatctattaattaggaatattagtatcgatttattagagaattggcaagagtccgccttaaggacttgttcatatgtgtttgtaacttaggaaagtttgactcgtatctgatatggacaagtttgtactatgggtataaatatatgcccagaaccgtgtaagaaaaataacaaccgtttaatacactcttggtgcatcgccgcctttttctcttagttcttttcgacgagttcttgctaaaagttaaggcatcggtttcgacctcctgacaagaggtaatgcttgtcacggtggtttgcattatcgagattactatatcgctttagatatgttaatcttgctaatataatcactgttcatcagatatgttattctatttatatca

SEQ ID NO: 49745 - DNA, 25421 bp, Oryza sativa
  unsure (1)..(25421): unsure at all n locations
tctctagggttttgccggtatcgactaaattatttatgttggttagattaataatggtatctaccaccctgaaaatcagtcaagagcttgattgtcaatatatattgtttcttttcatacttaatgttgcatcagttatgtctgatctattaagtcgtgatttgaatctctagctctagcttgttttttgattgccaataatggtagaatcggggtttcaggcgatcttacctgatatagatgttttattatgtttagttaatctaatcaagcttttcatgctatatctgccctttatgtatataagataaatatatttgatttatattgagtatatttatctagattacatatataaagttttattagagtattagctaatacattatcttttgacctaggcattgtccatttagctatgatataaacacatctaatccctgagtttgtcaatctgatttatatacaatccatactgtcgcagttaggtccaatctataccatttgtctataatttagagaagattgacttagagattatatgattgtttgcctctacaactattagagattatatgactgttggtatttcttaacggcattactagaaatattcattcctagcaatggcgcaaaaatagtcatggtatatttatggttacaaaagtaatccgcaagcgcatggatataccattgtagcatttcacccggaagtattccaaggtatcgtatttaatcctaagggaagatgtgaaagagagaaccatgctaataattatatacatatataatactttctttcatcaaagtctaagcaggggttaattcagtataagggtagaatgacaaagcaaagcttttagatttatcctaataaataattctaaactaagtggaagaagagatagaaagtaatcaattcctatacttctaatatacactcaacctttagtttacatttgctagtatacaatcatgtatccaataccccctaacagtgccctcctagtgtttcgagagaccacccctggttgccaagttcttacgacaacctgtcgtgcctatccaaccggggctaaatacggaggagtaccctaccaaggaatttgtcttaggaatatatactagcgtagaggaatacctgtactaagctgtcaccatcagcggcccacctctattgtcctgcagcatatatgcccagatagtgatatttagtaaactaagcaccatgcttacattaataaatactactctacacctctgcagatgatatagagcaaccgataactcggatactaaacccacaccattgcacctctctggtaggctaccctgtcacacccagaaattcgctacccgaatttcaagcagaatgtgtattaaaatatttgtccaggaccatctagaatacacaaacaacaattgataaacagatccacatcttacaaaaataataaataattcttacaaactcagcggaaaagcaaataaactagacttttatcttcatgaccaaaagcatagcttcctccataaaccacgtgcatcctcaacgtccggaacaagctcaatcctcatagaactcaccatctgaaccaatctctacctctggggtggggaaaaataaagcaagactgagtaccaaccaccgtactcaacaagtcataccaacgggaaggcatgatgcatgatattcacaaaggaatggttcattagatatttgtaataaaagcagcatttataaatcatattttgaataagtaaaccagtatatatagttaagcagtattaaatcatcattgtccaacgctaaaaccacgttgcaacaggcccaatcaaaccacctgaactacactagttcaataagtcgtattgttaaaagtgagactaatcacggtgagctggttgaccgcccaataaccgcaggcacggctattcgaatagttttaactctgatcagaagtgtacaactttacccacaagacacgattccatacatgttaccatgccccgaagttccaccacgatactacaaaaggggaaatcgcgacaaaacccttcatataactctccctaaccaaacatacccacctcaggtttcaccccctccttgtgccaagtcgggcagtcccctcttgtgcctaggtaaatccagaaacaacagagatcaatatctagattctaactgcaccatcgcctctacccttgccacggtatgtcagctaggttaaattatactctagatttagcctggagcccacgttggcctgtggtaagtacgattatatcttccaggcattcccgagaaccggtccttaattgtcatgggcacaacttccaaaaccatgcacccacaacccaccatcaaaagccacagttcgaatctttgatcatattgaaacctatagagaaccacttagttattttctgcattgagtatttataaaattattttgcgtatgaattattttttaataaacttgttagtttagttattacccattattacattgttattattggccaaatccatggattgctatatcacgccctttgataacctaggtgtagatttaaatacttcacaataatattattctagtggataagaccaccaaatatctatagtcatatatttggtttacccgtcatcacatggtgatgtgtcgggtgatataaaatgtgttatttgatatgagtcactcgcctggagtgatatggaagattaattcccgggtgaagatggatattgtggtttgtgaggccgtgcatgttgttataatttttttgtggaaagtgtatatttacacttgaagtatgcacgggcctgtgctagttttggtggcttcccccgatataaggactaccctcttatgccatgtaaaatgatgtaatttgcgcccatccataggactgagtaatcaggcttagcctagtacattgtcccactatatgaaagactgtagggtggctctatgagcaggtttggggtggacatgtggaaggggcttcgcccaggttgacatgatccacaacggtggaacccgtgaaagcagcaaccatctagccttgcttaggcccagcaagtgcccgactgctaggacggatcaatatcccgctgggcagtaactagtagtaagtgggactctcggacggctatgttgtcctcagccttgcaaactgttgacatcatctgggtaaagctgggcagtctctacagagatgagtagaccgaaaggcattctaagatggcagaaggtaccgaagggcgtgatgaaggctgtcttggggatatctgccgggttcatgtgaatttggtgatatccagagtatgcatccaagaagctcatgagttcgcatccggcagtcgaatcgactagctgatcgatccgaggcaacgggaaatcgtccttcgggcaaatcttgttgaggtccgtgaagtcgacacacattcgccacttgtcgttcgacttcttcaccagcaatgggtttgctatccactctgggtagtcgatctcttgtatcacccctgcttttagcagcttgttcacctctgctttcaccgcctcttggcgatctgccgacattttcctcaacttttgcttcttcggctttgcgtcagtcttaactgcgagatggtgcatgatgagatctggcgaaacaccccccccacttcatttggtccccaagcgaagatatcaatgttcttcttgagcacgaccaggatggtattcacttcttgctcgcttagatcttcaccgagcgatatgattttcgtggggtctaaatcatctatctgcagttggacaaccttgccgtgggggcgggtttcggtattggctttgctttttcttgcccttcgacttctaaggtatggacttccctgtcgaaaggggaccactgtggcagccgaaggctgggaacccttgacgactatcacaccagctgggccaggcatcttgagcttgaggtagttgtgatgagatactgcttcgaacttggtcaaagtgcccctagcgaatttggcgttgtagttgtacgggatgttgacgatgtcgaagagtatctcctcttctcttctattctctttcgtgccgaaggcgactttgatgagggcctgttctagaacttgcactgcttcgcctctgaaccctctaagcgaagttggtacttgggataatgccgatggggttgtacttgaaatgtagtggggttggttgagttgctgaaggaaagcttggagttgcgcctgcagagccgaagccccttccgccattgtttgtggcgcttggccaggtggttgatgttgtacttgggcagcgactggttgggcttgcagttgcacgtgaggggccggatgcgctgctgcagtcgatggctgcccggcgaagtacattggtgcttgtgcggcttgtggcggaaagggctgggtcgtcacttgcggatggacttggggtgggacataacctgccgaatactgaaggatcggggccgacgtgaccttggtccgtctcgctgcctcgtatgcttgttgttgttcttgcatttggcgaagcatgtcttggagtcatgtcatgttctgtcgcatggcttccatgtcggcttcggcttgtgtttcggggtcagggctgacttgggcctgcacagcggcgagcacggttggggccgctgccggctgcgatggaacggcttggggcaccaccagttggcttgtcgaaaggatctctgccctggtctggagtgcccttgccgccgcagccgccttcgccacgttggccgcattcggcacttgctcagaggtggcaggggccgaaggcagtagtgatggcgcagatgcggaagcagatggtcctcctccatcttcggccacgggcgctgaaggctctgctccctcctcggcggccatgtccgctccggtgtcgctttcctttcgccttgtaaccttctccttcacgaccttcttcggtggcattcgctctcggtggtatcgctcggaggtccccacggacggcgccagctgttgtcgaaacgacaaccgcatacgtcgaaagacgtggttactcaacagtggttggaaagaaacgaagtgtattaattttagaattttttacttcgggatccccttattacatggccctaggggactatttatagccccattacaggttcttactactagggtttaggttatacaggggaatttacatggttaccctaacgaaagggacatttacaggggtacataatgttatggaggctcatgggcccctgatgggccgtcgggcgaccgccggccctatagcccctaggcttgatgggccggaaaggcttcttcggccctcgcgggggcgaacttgccatggcgaagtcgtcttccttcggcaaatactcttcgccttgcacccttcgcctgggacgcctctggctcgacaaggtactcgcacgacccctcgcctcgcgctgttcttgctccatagtcttcgccacgggtttcggcagatttggtcgaagggcctcatgccatccgccaacacttaacaacccgagagaaaagtactgacgatatcagttaaatgagagttacgagatgcatataattgagttgccctttcgttacgagatgcctgttctggcagtgagggtctaagcaagacatcttctacacctcgtcgtcgtagtgtgagatccaatgttgagaacatggatggcatcgctgcgggggatgatgactcactgctcaaggcaatgaagaggaaagcattgcacaatttggatgacagcttttctggacgagaggtttcggcaacgaattctaagcagcactcggcctctcataaaacatcctctagtgaaagtactgttataaactcatccccttctttaccttctttacattatgattttgttacttccaatcttagttctttaggtgtttctttgggtaactctcatgatgaaatttatttctcgcttaacgctttgaaacatattgaggttgatagaactaaagcaacaaacaagactagtgagtgtaaccattctaagcacgttttttcggaagtggatccttttacaactagtgatgatgagggcgacgatgatgttgccctactcgctcacttagtaaaggatctcacgaagattgatatggacgatgtggaccaaagtgacaaaatttgtgacttgttggtatccactagaaaatccaaatcttcttcaaaaagaaaagagcgaaaggcttgttcccaaaatccaaaagcctctaaatctgtttcctcatgaaaggcattttttggaatagcagaggtcttgcagacttggctaaataccgttatgttgcataaacagttagagagaaaaaactagactttgttgcgttaatggagacaagaaagggtgaaatgtcaaagatgaatttagatcgcctctctgggggtgctgatttcatctggcattgtctcccacttaaaggaagatcagggggtatacttctcggaattaatgtagctgttttggatatatctttaattgttgaaggggaatttttcgttaaatttcatctcaacaatagggaggataattttaaatggatcttgatggctgtgtacggtccggcccaagatgattttaaatctagtttcttggcggagttcgttcgtacatgccaacaaaatcatctacctactcttatagggggggacttcaacatcctgagaagtagtgtggaaaaaaacaatgcccgttacaactctctttggccttttctcttcaatgctgtgatcgatagctttgacttacgagaaatcgctctttcgggtaggcaatttacatgggcaaattcgcttcccattcctacttatgagaaactagacagggtcctcacatcaacggaatgggaatccaagtaccccctggttttggttcatgctcttgacagaggggtgtcagaccacacgcctttgctccttgacacaggggaagcggccttcacgagaaacattaaacaatttaaattggaactgggttggtttctacgtgatgacttctatggtcgtgttctcaagatatggaacaaaccagtcaagggtcataatgcggtccaaagatggaataacaagatgagcgctttacgtcgccatcttagaggttgggctgctcataccagtggcgtctttaagcagaaaaaggcaaatttgcaaaacacaattgattctctagacatcgcagcagaggtacgactcctttcggatcaagaaagaattcttcttgatcaatcgagggattctttggcaagtctactccgtgaggaggagattaaatggtaccaacgctcgaaagtctcggacgtactcttaggagataacaacacaaaatatttgaacttgatagccaacggtaaacataggaagaagaggatctttttcctagactaggatgaagggaaaattgagggggttgaggccttgaaaacttatattacgagtttttataggaaacttttggaccaccagaggagaactcgttttcgcttgatgagtccataattggtgatatggctcaagtttcacaagctgaaaatgattttcttactgctcctttttcggaagaagaagtgaaagaagccatctttgcaatggagcataataaagctcctggaccagatggtttcccagctgaattttaccaaaatttttgggatgttattaagcatgacctgatgaacctttttaatgaattccatactggtagcctcccaatttcggactaaattttggggtacttactctagttccaaaagttaaagaagcaaatcaaatccaacaatacagacccatatgcttgttaaatgtcagctataaaatattcactaaggtggctacaaaccgaattagctcgattgttgaccatttagtgaacccgacccaaacagctttcatgtgtggacgaaacattttagatggagtcgtcatcatacatgaaacaattcatgaactacataggaagaagttgagtggggtgatattcaaaattgacttcgaaaaggcgtatgacaaggttaaatggccttttctgctacaaactctgcgtatgaaaggtttttcgcccaagtagaaatcttggattgaacctttcatttccgggggaagcgtggcagtcaaagtcaatgatgatgtcgggcctttttttcagactaaaaagggccttcggcaaggagaccctctctccccaatcctattcaactttatcgctgatatgctagccacattgataaacagagccaaaacacaagggcaaattgatggagtcacaccacatttgattgatgggggactctccattctacaatatgccgatgacacggtgctgtttatgaatcatgaccttgaaaaagctcagaacatgaagtcagtgcttctagctttcgagcagttgtcgggtcttaagatcaattttcataaaagtgaactgtattgttttggtgaagcacttgattatagtgatcaatacaaccagctctttggctgccaggtcggcaacttcccattccgttatctgggcattccaatccattataggaagttgagaaatgcagaatggaaagaagtggtcgagagatttgagaagaaattgagtagctggaaaggaaaacttctttcgttgggaggacggcttactttgattaactcagtacttagcagtctcccaatgtatatgatgtcatttcttgcaattcctagtggggtacttaaaaaacttgatcaccttcgatctaggttttattggcaaggggatggacataagaagaaataccgacttgctaagttggacattatttgtcgtcccaaagaacaaggggggctaggaattcatgacctcgagataaagaataaagcgttgattagtaagtggttatacaaactacttaccaccaatggaatatggcaataactgctacgcaataaatatttgagatcacaacctttatctcaagcctactggaaagcgggggattcacatttttgggctaatcttatgaaggtcaaacaggattttttccgttttggatccttcaagattagggacggctcccaagttaggttctgggaagacaaatggttgggtaatgcctcgttaagagaacagtattcttgtctctataacatagttaggcataaactgtcaactatcgtacagattttccaaaccaatcccccgtgcttttcatggcgacgggatttaattggtgcaaaactagctgcttggcataacctattgcctcgcatagctgatttggttctggtacaggagtgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcgaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagctaattattaccagttatagcatccataattatcgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacggtaaatgtctcacaacagtagctcgcgaaccggtccttaattgtcatgagcacgactctcaaaaccatgtgctcacaacccaccattatcaagttttagttggcaagtaattaattaaccaatcacgattaaccatcgtgaactatcattaagccatccttaaataatagtgagtcataagttatcccaatagtgtgctaatgtttctaagcatggctaagcaatcataactaatatctagctgaaccaatatataaagcccaactagtcaagttataataacccaaggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttctgaacactcctgacgcactcacgaaccttcgcaacgacggaaacgacaagctaacacgcaaaacgaagaaaaagactaataaaaaccaaataaacagtacatataaagtaaacaaacatgtagatcctgattttagatgaatttagcaacttgaaccactcaaaaccgagttacaatgatttagttatgaatttccgaagatttaatctattagaaaaactggaaaaggagaagatgatgacgtcatgatgacctcatcaatggccggaccaagatggcgacctcgccggagattggatggtcggctgtgactttggaggacatgaacacgtagaggacgacgagacgaacccaacgatactcaccctcgaaccaaacgacgaacgacgacggccggcgacgaggaggcgacggcggcggctcgggttgcacggggcggcggagctccgatgaccggcgacggaaaaggaagggtggccgagcttcccctcaccacggcgcacccaacggtggtgacggcgaccggcgacgacgatggagacggcggcgcggcggcaccggagatggccggcggtggcggtttgcttggcggcggtggcgacggagctacggagcacggaagaggacgggagagggggcaaacgaaagaggaggactagggggtcctatttatagccttgattgaagagatcggactcctcccgcaagaaatcgatccgggaaatcaaaaactcggttttggagataaactcgaaaacgagtttgattcggataagatactcaacgatttgctccgatttttgggggtaaagatagaggaggataagagtaatatttcccctcaacaaaattggagaaaaagagcaacggggaggcgagatttggaaggaagaggcggcggcactgtgcacggcacggctggctcgggctctgcctgagttggaagatgaacaatagcgcagggagggaaagtagacttttccggcagagctgagaggagaggacgcggctcaggttgggccggcggaagagagaggaaggaaaggaaggaatgggccgaaaatggcccaagctgaggaggaggattttattactttcccaattaaaataatcacttaaatgatctttgaattgttaaaaatacttccaatgctcaaataatttcaagaaaaatcatgaaaatacttggacactcaaagtacttaacaaaattataattagaccatttaatgattaatttaatatgtgggtaattactgaaatgctctttgtatgattaaaaattaggaattgagctccgaaaaatccgagaaaactccagagagtataattaaccatggagaatttaataaaaattaaatccatccatgctttatatttaggaaattttatttcccacatttaacttcacttgtaaattaatgaacatttaatataaattctattattaatttattaaataatttataaatcctgaaacaaaaatcagggtgtgacaaggagcaagatgagtttcactggaacctcaccccgaatggggacttctcggtcaaatctcattatctagctctaacacataccggggttctgaatatcaatagacggatttggaaggtgaaagtacccctaaaagttaaaatcttcctttggtatttacgtcggggcgtaattctcaccaaggacaaccttgctaagagaaattggaaaggcagcaagacatgttgtttctgtcacaaggatgaaactatccaacatttattctttcagtgccgcttatctcgcttggtgtggtctgtaattcatttggcttctaatctgaaacctccttgcactgttggtcatatgtttgggagttggctatcatgtgtcctcaaagaaatgaggaatctgcttttgatgggtgcaacagctctgtgttggtccatttggctaagtaggaatagagtaatttttgataacaagatggtgtcttctcctttgcatgttatcactttagttacccggtggctacgtacctgggctatcctccaccaaccgggactgcgggatactattatggtggtatctcgacgtttggaccaggtggctcaggagttttttacccaggagcataggtggcggtctagtctatggattaatagccactaagatactaagatatacggtggtatctcgacagttggaccaggtggcataggagtttcttacccaggagcatgggtggcgatctagcctacggattgatagccactaagatatatgtttccgttaaacttttgtgcttgggagatgttctagttatttctttcttattttttggctgtgtgcattttatgcagaggccgggggtgactcagtttgattgtatcatcttgatgtaattaactgagtctaaataagactccattatctaaaaacgagatgcatatcatgaaccagaaattctgaaggtgtacaaaacaaaagagccatcagttaattacatacgctaggcaactgatgccatatgtacaagcaccgaatatatatgaaataatgtaaaaatatatacaataatgatccctaacaacctgtccccaggctccacatgaacacagcaattgcaagaataatacaacagattcaattcaagttacaaaaatgagtttgcacaaatcattgttttgaataaatcaaaaatgacgacaactctactctacagtatcattcagtgtacataggagtatgtacctcttgatgaataaatcacttgttacaatagttatgcttgtgcaacaaatatatcttttactgtacacgacaaatttgttctgcatcacccagcaatctaagactacgagaaattctctgcagaagcaagagtagcacatagttataacatgatctcttaggtagaaagagaacgttacgcttagaacatacctctcgagtatcactaaggcgcaatagatccaacctgtctgacggcctcaaatttattaagttgacaagctgcaataaaaagtacagtgatgaggcgacaatatgatgcactcttaaatctaagcagttgaatgagccttacccaaaaactaaatttttcaggatcctgtggtccaggcatgctctcaagatctgtctgtcttgctcgcctcgctacattcagcaaaacatattaaagtacaatgtgcatgggtatctagtgagcaccaaataacattgcatcccccctcaaatcatttgaatcaagggcagctactatgcgagtgaaatatttaaacaatgcactgtgaaattggagtctcattttcctaaaaaaagagagagagagggagcagggcaatatgtacgacattggaattatgcatcctgacagtggccgatacaacttctggagtttttggattgacattattttttctggggtcattcgcaaatatgtatttttaaagaaaatgaccctatatatatgtcttcatatattagaccccatgactgcatactggatcttaggagtcagctcttaagctgtctattcttcacatgggcgccacagaatcactaaaacttcattgagcaggatgacaatgtgtcgaaaatatccataccaggccttgagatttctctagctcgccttatatatgtcctggccaattctgaagctgcattagccctttccatcagctgaaaagagccaaaagagttacatcaatgtcacttagaacaaattaatagagacagcattaccattccattgtgatgtttttctcttccgtctataaatatcagaaggccaaacatataaaacctcaaataaacagtgaagacaaaggtaagcgtaaagcagattttaatttcatcagaacggaaaaataaccacgtgcaaaacaaatgtacaactaagaattcgagtgcaaacataggctatgtgtccattttactgggaaaagtactagcccattttcaaaatagttgtgaaaatgtttttctattttgtttaaataaaacatgcattattaggacaaaaaacttggtcctattgaaacaagtactccttttgaagtaaaagtcttctattggtaactagttaaattgttccttcatgttgcagctcatcaagaaccaatgaatcacgcagcatgtatccctatcagcctcacaacgtacatcattttcaaacttctatatcttagtgatggtatgtccaaatattttcttaattcgtactctgcaagttttacttcaataacatcatgtggtgcttaagctggtttttgtccatcacatttttgcaatacttcacagcacaactaaaagaattgcagtccgaaaagttaacaagattttacatcttttctctcctgcgatccgtctggtaatgaaatatcttggagccactcaatttcagcaaccctatacctgaaaagggaaatgactaaagtaaaatgaacatacacaagggttgatccaacatgttatattcccagattaattgacacactcacccatcttggtcccatgatcgcaagatacgaaaccgccgtgaaccttccacctataactgaaagtattattttcacatctgataataattcaaattcatatttgttgaatgacattatctatggaaataaaaaaaaaacgtttttggcaggggaaagggtttttcattaatcaacagggataaagcagtctctttgagcaccaagtgttcaacacattggttcattgtatccggtgaatggttcgccccacaaatanagattaaaaataagcatccataaggggtccttttagaaaacaaaagtgggctatgagtctgcatccagagaggtgattgctgcaaaatnnaccaggataaatcttgatattgtaaggtacgctagtatgtgtaaccacatccactcaatatgagccaaaccaacctagaacagaagttataagctcaagcataacatcttgcaaaaatattatggttttacctctagataaaaacgaccatccggaagtggctcacacctacatatatatatatatatatggagacgagactgaaagtatgaccatatgtttgggaaataaacaagtaacaactaaacttactccagaatttccacctcacaaccacagtcagctacagtacccgtagcagaatcaataccaacctgcaatattgcagcaatattcaatccaaaaagtaaagaaattaatgaatcgacacttcaaaaccaaaatcattattttagattagttactgaccattcccatgcgatgattcccttccattatcctccttacctgtttcaaattggaaaaaaaatgttgaaacttatcatgcaaacatatcgtaccaatgcttagatggaatagaaaataggctaaaagtttcatgcataacatgaaagatatacagatgggaaaaacaccgactggaaatatgcttgttggcacattgagaaactagagacaacaaaagatgatagttacagttatcttatcatgtcttcccttttattgcgctacagctaggatttagggaaaatatcaggttgtaataatttttttgacctgaaaacttccaggctttgcctggcagttttgaattatgataaaaagaaaatatttacataaaatttaaaaagaaaagtaaagaactctcaccaataagctctaagttatatcgtttgtaaccaatcaagaattaagctttttagggactctttcatcctacaggtatgtaggagaacatcttatttgaaggttccaatattttaacactagaattttatccaagattccccggaattatacgagtccttcttagttgtacgcttataccacaagttagatatcaacatgtaacaagtattagacttctcttttggggggaaaaacaaagcatcatcgttctcaacaaacggatctgacaaaaagatcaactgaatttatggcaattgtaccatgagcctgtagcgaggttcaaatatgttcagtgccatcttttgacaaggcagtacaacatccataacaaagagaggcatcaaatcaacgcctgcatatgtcatagtctcatgttctgacttcctctcagcatattcttccggaaaatttttctgaattatgttgctcagcgttacactgaagcatttaatcatattgtcatcatagatgtcaacagaaaacattgaagaaaaaaagaaacaaaatttcaaagaacttagattaccttataggatatgtttttggaccaataaaaagaactgtccgacacatgggacatttattgcctacaggaaatgcacataatgtgaagttccgatattaaaaaaaaaaggttaatcaagtctgaatattccctaagcttaccatgatccattgattgatgtaaacaagagcgacagaatgagtgcccacatggagtggtgactggttcaaacaatagcttgaaacataatgtgcactcaaaatcatctggtctatctaatgttggacgtcttgctcgagctgcaatacttgtatttctgtgcagatcactgagccagctttgcaggacatggctatacatgcggcaaacagatgttatgcaatagaggttaattttacattaaacagatacctgcaagatacatgttgtactagtaggcaatgcatcagcagttgtacctgaggggatcaacttgaagcccagaaagaatagcctcccgtgcctcatggtactgctccaactgtgtgtcaaggagttagttgctatttcgactacatgaacatgtatgcaatggaaaaaggtttccatgagtacacaatatgcatgccagctgcgatagaatctgaacagattctataaaatcttataaatctgtctgaagagatgccgtgacatttgtaaaatattaaacctaatcagctaatggtgcctcgtgcataataaagggaaaaagaaaatagaacagtacttaaacatttaatgtttgaaaattttgtaaatcctctctcccctgcatcgtccattgtctagcatttctccaagtcttctttctgtatccatctgtgatctatcatcaatctctgacgaataaatcattatcctattgaggtgcataacaacttagtatcgcagccaacctccaagggctctactgcttgtaggatcgaatcacaacaactaagccaaccagagggggggtgaatggttggtatacccaaaaaccgaaaacttttagcggaaatagcactgctgaccaatctgacatcaacgctatgataaacaagatgatgcaagcaaacatcaatgctcttattgatctggtgagttcattgctgcagtgcacccagactcacaatgcaggtggaagctctatagacccactcttgtgcaaggttaggtagagaccaaagtcgttgggcacgtgccagtactaggtggtcctcaggtacagagagatgggtggtgtgcctcacagctttggagaagctaatgctgccaccaagctggcagcataagtgccaagtaatatggcattggaaaagagaccagtcccttacgtccgtaggatttcatctacggcccactgcacaaaccgaagcattgggattgctgggtttgtcccactagcatgttagttttatccatcccgacaataatggcttttgagcaactacaagtgaggacagttgatgacaccaacgggaatgcagtatccacaaggttccgttgtcttggcttaatgctttagaggccaggagtccaggacacctcaaaggacaaggtttggttggcttcataccacctgaaggacattggcataagtacaactactagccagagagacatgagaagtcaagtcaccaatactaagcagcccattgagggagctggcaaggtacaataggcacaaacagtagataagtaataggagaaatttattggcactgttttttctcatggatgacctctccaaacaaatgaaaatgcggatttgctataaatgtgtcaccagtttcttttgttaaaaattagtcgattcgtcgactgtaggatataggggatatacgtcgagattcatgcgtccaggaataacgtacaggcgcagtggcggggagtcgaaccctggtcttctaagtcatagagagagctcctaacctaagtcacaaaagttcccggatcgacggatcgaggaactggaccgtggaacacgggacaccattttccaaaaacatggaacgagaggggtatacctcttccaaaattatggaactataagtggaacgcgttcctaggttttttaaaacgataatccggaactctacagaactatacatgttatcacagtggtcttggcgctcatgtacaaagacaatgtcacgtgctcgactccctggttctgctctattttcggttcttcatttttttttttttttgctattcatgtgacagctcatcaccagccaaaagaatttgggccatgagtgcaacccagccgatcaccagtacgtgaaagtgaaacctagcaggctagcacccatcacttcgtcctcatcattcgtccccatccccagccgccgcatccagtccatagatagctcgatgcaacgacggcggcgctgcgtgatggcttctgttagaacttcaatggttactcttattgagaagaggatggcactcgagatggggcaattttctggttttcttcattcacaaaacacaaagccataccttcccaagggaggttggatacatatataaaaccatagctggctgcaagcctattgctgcaccctcctagtctaaaaattcgaaatttgaatgggatgctgtcctagagggcatccaaactgaataaagcataaaggaggcataaaggagatgctaattgctgctgtcctactaaccgcagctgtcctagcaactgaaaatatgctaaaggagtagatgctgtcctgaaaaggtgaaactacccaaaagcaaaaagaagaaatcaggaccaaggaccacaaagacttatccatcagcttcctcgccagtgcaggagggagaaaagcggctgcaacgagcggcacccctctatttctccaaccttccctgctcggcggcggcggcatgcgctggtttatgtaccttggcatgacagtggtgagcagcgaaggagaaacagtgccactcgtcgattgaagtgatacccctcgccactcgtcgcttgaagcggtgccccgtcctccacccgtgtagatccgggtgagttccccttctcatcttttgctcaatgtacctcgttcctccattgccggaccacgtattgggtcgatgatccctccgtttttggaacgaagttcgcttcgttcccgttcctcgttccgggacgaaattcccgggcgttccctgtgacttagttcctaaccaactgagcatggtagtggtattgatttcattgccaaaacaggaattttcatttacgaagtacttacactaattacataccacttgcactatagttacaatgtaattacatagcacttacactacggttataatgtaattagataacacttacactatagttacattatatttactttgtattttttactaatgtgttgaatgttatatagtgttataatcatatggtttaagaaataaagtatgtactagttcctaattaatcatcaaagtgtgtacatagttggatgtccactgagtcgttaggtatggattagcgactgagaaaaaaaccgactgcatttggctctgttttgtggcgaatgatttttaggtagtcccatgaaaatattgaacccgcagaaatacaggtcaccatgtgctgcacattgctacctgaagtgctgcttaaggatgagttttcttatgaggggagaaaatatcatgtacaggtcatgcatagcacctagaggaggcaataacaagcagccaacagtaagcattaactagagacgagtcattggaattctcatttagcattttagttgcaacactatctttagttgacccacctgttgaaatcaacaacacaaagagtaaaccagaaatagcctcactccctcacattttcatcagtccattcctgccaacacccccccccccccttgctttcattttcttggtatgcgtgttactgccaacttttttttcagtccctacactcattcaagcgcttaacagtagtaattattaaagtgtgtgctcagttgaggctaactggcgaaagtgttgcacagagtgaagcttttgcaaatcacaatgcctaatactagtcagttaaacattgtacggtcaattgaattatcctattcgagaataaacactaaaatctttggcctacaaaatgatattggagctatctatactggctctaacaaatgatactgaagcaaggatctatctaaattctagattatacaacaatactgaatttaagaaggttttaccaggataagcgcatatgccttgagaagatatggtcttggagaattactgccgatagctaataccttctctgcatctttgagcgctacctgcagtgaatgcataagaacattgtaccgaaaacataagaaccattgcactgtactcacatatttcacaccaaatgataatatttgcataacaacttatacctccgcatgcgttgtgggatcaagaccattcaatggttggtactctgagtcagctgctgatctctccctcaacacttgacttatcctgtaatagaggtaaccagttagccccgacataggcatgaacgtagatcaaacctatccatgtagaattgagcaactgcattaacaagcatgcaattggtacatcatattgcatatgaatagtatcgaatagggtgctaaaaagacagtgacagagaactcacatacagaaagcagaacttcggttgctaaggataatgggatctcctggtctcaaagtttgtgctttagagtaaaaggaaactgcctgaaacaggaccataccaagtatcacgaacaatgaaactagcaaattgaaggaatcaagcttgtacaactgaagactaagagaaacataagtaataatgcataattataataacagctgttgttgctacatatgcaggatagatgttatcactgcataaaaaggttgcagggacatgaactaatataaaggatactgataaagccagtaacgaattcaacatttggaatattttgttagactaataaggttatgagacatacttggacaaaattattctgtatttactcaaaaaataaggatttcatctttcaaaaagttcaataggaaaaaaacatcagctctctgtcgaactattaaacacacaacattttacacaccaacggttgtcagtgtgaaaacatatatatcaataaaatgaaaataacacaaagtagctgttgggctgagtagttcaacgtaatatagagtgggtgtgtcaaggcccatgaggtccatatgcctatatacttgtatatgtaccaggaaaggaaaagagagatttgagaagcttccagaaaattcccaaccttttctctacagtagccatactagatattttcaatctgaacattccataaattaaaaagtttctgaaagaacattaattaccgagtgaataaacatcataaaagaaataataaaagagcgaaaatgattattaaaaaagtggacaataaagttcaaatttaaagaaagaagttatttggatcaaaaagaaggattcaggaaaactgaaaatcaaaccgaagaaagtagccctgaaatgtttataattggcattagaaactcaaaaggaaatccacaaaaactagtactacctcggtcccaaatataacaacttttggctatgaatctccaaattcatgaatagaatcttggaacccaaatgttcaggcatgttgagaggaatagcaaaattttctttaatggaccaagtaaaatggtaggattaactctacaaaattgcaaaatagcatacaacatgagactgataagtgtgtcctagagccagttgtttgggacacatctaactagcatgatttatgtatctcaagcagcatttaccattaggaaaagaaagagatggcttaatattggaccacatttttttaaccaatttacactacggctgataataaacaaattgagaaaagagggtcctggaaatcttgtaagatggacataaaagttgtgctacttggtaacgttattgcaggagaatttgatgttcaaaccaaaacaaaaaatttctgaagagatgactcgttacttgttattagggatcccttgttaggttgttactagactatttcactatgacatacgagtatcaaacttgatcagagaacaccaaatatggaggtaaaattctaatagctggaaggtacattttgtagaaacacagtatttccttcagtatgctagttcaggaaaattcttagcatgcccagcaacagtaagtgccggttatgtcagtcatactgtgaggggctggatggaactagtgggctacacgaacgaaattcgggaatgaagaggagcacggtcgctcagctaactgcttacctcgtcgaagtggccgtcgcggaaggcgcgagcaccgcgctgcgcgaggtcgaacacctcgcggtacttgtccgggtccatccccatctcctcctccctcttcaccttgcgcagccaaacacgagcaggttgaaaacccatcagcacaccgcgtacagtacatataggtgaaaggagcgaagttgacatacccacgggaagtcctcgacgacgagcgcggcggcgaaagaggaggcgcccggcgaggtcattggagggcagcagggcggaggacgggggagtagggtgggaatgggggtgcaggggattgtggagtttggaggaagggggaggagagggagaggtggtggtgggggaacctgcggcgttcgtgcggcgatgcccagaaatttttgcgcggctgaggccgcgaagacgtgtcgcagtacggactcgatcacgccacccgatccctcaacaacgacggtctatggctgagcacagggtgtccttttcccgttcgaccccggtttttcattttaggattctaataatttagggccgtttgttgggattcttaggagcaattctagcattaatcggttggagttgagccaaacgggtaattttccctcagcttccaaagcgaatcaactgggatcgattcccttttttacgaaggaagggagaatcggcggaaagcgagcttctgctaagaatcaaatcaaccaaatatgaaagttcccatatttttcccaaaaaattacccgcctgccactgggtatacccctctttccagccttccccatccacccgagcagatcgatcgacatcacgcgctagggttgcgggagctagacgatggcgctccgcatccagcaccgccatcgctgctggcgctccgcatcgccgccgacctctcccgtcgacgacatcgccgaccatagtcgccgtgcccgagccttttcccaccatccagccaccttcgacgccacttccggtctccatcctgccactcccctattctccctcagccctgcagatccaggccaacaacgccaccagttgccatgttgccattctccgtcgagctccctaagcaggacgaccagcactgactgggcaaggtaccatgtcctaaacttctccatttgattaactttgtatgttgtactattgtgcaaaatagtagaactgaatagctcgctgcgatgtggatttgtgtgtaaataatattgatgtggatttgcactctgatctgtgtatgtctaaatagttttgatgtgcatctgtgctttgatttgcatatgtgttatttcataactactgcagatggcagcaacagtagtagaggaaaatcaaggtgcaaataatgttgaatggacagatgaaaacactaggatagtttgtgagttgctcgctgaacaagttaggataggaaatcgctcaaatacccatttgaacaaggtggggtatgataatgtgattgcaaaatttgaagaaaagactggcttacgctatcaaaagctgcagttcaagaacaaatggagcaagctgaggaatgagtataatctatggaagaaactgatagctagagagactagattaggttgggaccaagctagggctactattgttgcatctgatgattggtgggcaagagccaagaaggtatactacatattaatgttgatgtttaagttgttaaccatgattttgcaaatatttgtgtcactcttctgattattcccttggtgttcctcaaggatttgccaggttgtgcaaagttcaagttacgggggattcaaaatgaacatttgctccaacaaatatttgaagaccttcgaaacacaggagatgaccactgtaatcctactagtggaaatttaccgcaaagttcaacccaaccttccagtactattaatgtagatacaaaagctgtgaatgaaggtgatgatgatgatagtaatgatgaggatttctcacctcctcccaagagaggtaaggcagcagctggtaaggaagccaagaaacccaagaccagtggtggacattggttctatgaacaaatgattgttttgttgataaccaagagaaatcagctgcgtctgttgagtctcttgtcaagagggaggacacttcagggtgtgccatcaaagatgtcatggctctagtg

SEQ ID NO: 49746 - DNA, 21453 bp, Oryza sativa
cttacttggacaatattatatgacgtattatgataaaaataaaccaaagacgtcactactaagtggatatgcatgggtacaagagactctgaggactccaggagagagtcaccacatgtttcgaatgaatacagacctcttctacaaattgcatgacttgctggtgagtacctataacctgaaagcaaccaaccacatgaactccatggaatcagctgctatctttcttttcatacttggaggtggtgagtccaatagaagggttcaaaataggttcaagcattccggtgaacacaattagtagaaaattagaagaggtcttattgagtgtggttagtatgtgcaaggattacatatgtcccaaagatcctaacttcccaagggctcatagtaggattaagaatgacaaaagattatggccacatttcaaaaagtgcattggagccattgatgggattcatatcacatcaaactcacctcgtgaagattatgttagatacattggtagaagcaagagtcctactcagaatgtgatggcagtagtcgactttgacatgcgatttacatattcttctattggacaaccagggtctatgcatgatactagcgtcctttatcatgtgttagatgttgataaagatatatttccacaccctccacaaggtatatactagctgaaatcatctacactttgctttatcttttatttgtaccatataacattgactcgatgcatatatcgtaggtaaatattatcttgttgatgctggctacccaaataggccagggtatatggcaccatacaaggggcaaaggtaccatattcctaaatggagaagaggtcctccaccaagtggtgagcaagagtatttcaaccaatgtcactcaagtgcacgcaatgtcattgagcgcacctttggtgtgtggaagatgaaatggcgaatccttttaaagatgcctacctatgcaatggacaagcaagaaatgatcattgcagctaccatgtgtcttcacaactttataagacagaattcgacaactgacaagtattttcgtaggtgtgatcgagatccaaattatgtcccaactataccaacaagatatgcaagatatgttgtttcccaaaatgcatcagatacttctactccaaagtctagtgataggtctatggacagatttcgtgatgacctagcaactgcattgtggcaatctagatgaatgttctcatataagtgctgttaggaatatattttggaagaactctccatagaaatatgtaactgtggtggttccactctccttagaaatatgtaaccatggtattttgcaataactgagtcaatttgagtggactattattataatggatattgtctttgatgccatgcaatgtacgtgacgtgttttttaacttctcatatggaagcttggtatttttttacaagtattgtgctaaaatatttgtgcatattcatgagtacttctaacaaatattaggattgccatttcagctatatctcgttggtacagaagttatatagaccaaggacgtctttggcttcccccattaggatcttaatgtttctagccaaacacctaaattaactgattctgattctcttcagtatctgattcaggaagaatcagaattagaatcacagaatctgaaaccctaccaaatgggcccttgctccctccgtttcaggttataacatgttaatcaaactgcattaagtttgattaaaattataaaaaaaaaataattttttcgatctaagataaatttattataaaaatatatttaattattaacttaataaaaataatttggtaatataaatattactattttttttaaggaaatatttgtttataaacttattcaaaattaaagtagtttgactttaaccaaagtcaaaacatcttgtaacttgaaacggagtgatacgtagttatttcatgggactgtctgtacattaaccggctgaaaatttcagctgaaattttcatcaatcgattggacacgtgccaactatccaacgtggagcgcacggagctcacgtggagagcagagcacttctctacgcacgttgccgagtaggatctggtttggccatctggcctattaagatgtttgtgcagcccattgtattacaagctcactctatcactggccaaggctagggtacagatggccataaggcacgaggcccgaaggcccggcccacggcacggctttgcccggcccaagcacggcacagcccaatttgggtcgggtccgtgccggcccggcacgatgggccggcaggccaggcccggcacacaaagtatagggactaaaaatagacatataaatatcactgtccaaagaatagggaccttaaatagacttatttagctatttatataccacagaccaaagaagaggaacgaaaaaggactttttttagctatatatatgtcacagcccaacaggagggaggaaaattagacttattctgagaaaaagcacaatagcccatcgtgccttcggcccggcccggcacggcccgaggcgtgttgggccgtgcctgggccgtgagtgcggcacgtgggctggcacggcacggcccggtgcgtcagtcgggccgtgccggcccgacaagcctcggtccaggcacggccgggcctaggccgtgccatgctgggcggcccacatggccatctataggctagggcttatttccttcgtccaaaaaaaacaatctaggaggggtgacccctcctaatacaatattatctagattcattgtattacgatgagtcacatcccctgacccctcctaggttggcttttttgggacggaggaagtagctcgtaagcatatctctggaccagtgtcgaaaacatacttagcatgaaacagccagaccatctgccactatattacatttgtgactacaaaccgagacttcacatagataaattctgaatgcatgaagtctctaatctacggctctgatcgtttgcctaacccatccattcagcacggaaaacagagcagtccattagtgcgtgattaattaatttttgctaattttttttcaaaaatagatccatataatttttttaagcaactttcatatataaactttttttaagaaaaaacatatcgtttagcagtttaaaaagcgtgcacatggaaaacaaggaggaggagttgggaaccttacatacaaacagagccttatagtaagcaatcaacgagactttgatcaatctcagttgaagacaaagcatcggtcaacatcctgcataacaaccaaacaaacaaagctcaatgatttaaatagtttatatagggtgtaaaaaggatcataagaaataattccatggttctcactcaactcaaaccttgcagccgtgcaagaaaaccgttagaaatacaaaagagttccaagatatgtgaattgtttcacgtctgagcttacgcaaatagggatggcaattttcgacctgccagtacctgcccctccggctccaggggaagggtgaattctcacccacggatgagcgaaggcagggccccgtaaattaccggggataggaacggggattggaagtaacccgcggagtgacccaacagggcaccggagtactctctccgggctgataatattagtcattttggataagggtaaagtcaaactttaaaatcttttactacaaataatttctaaagtattcatcttaaaaatatgaaaatcatatatgtagattagtcttaaaaagtatttcaataaaatcatatatttgttgatatttctatatatattataatagaaaatagttgtcaaagttactttttgaagaccgggccattatccaaaacgataagtattatcaacccggagggagtatgatttttggaaaaagtacatcgaaggtccctcaacttgtcattgagttacaaaatcgtcccccaaccgtaaaactagataaaacacatttctcaacttacaaaaccagtccctcggcggttttgaccccgattttgtccgacgtggcagctgagtcagcgtgggacccacgtgggccccaaatgtcaggtgcctcatcagcagattctcttcccctcctctcccttcctcctctctctcactcttctcttctcttctggcaagccggccggcggctggggcggaggccgccggggcgaggcgggagaggaggaggcggcagcggcgacggctacgatgcgggagaaggcgagggcagcagcggcgacagcggctatgatgctggagaaggcgagggcggcggcggcttagcttagcttccatcgatcatgcggcagcgggcatatgtccgggctcagcgcgcttggcggtgcgccattcttcaagtccggcatcgctggcagcgacgagaggcaaggcggccagccagtagttgggagcgcttgattcggcggttgttgtgttcgtctctgcttgtcaggtgtggcttagcattctcacagtactgtggcactgtgctcttgtcttcttttagctactgttcttgagataacactattaattagttagtctgcgtgtgtgcagcaagcgatgcatggattataatgacgttgttaagttgctaaatatggcgcattacgtggtgctaatttcgagcttaatttgtcgccagccaatcagtcatcctataattctctgaaactttgattgcaatcggcctttgtacttgacttaattcctctacacacttgtgttcattaagaatccgagcctgtaggctctccgcctatccacacacctaaatgaatgtgccaatatcggcattaactgaaaaaagttcgccgcgcgagtcacgaaatgagattttgctacgaccgcacccaatacactccaatatatccaaaactcaagttttggtgctttttgaacattttggtttatgtatataacatggcacacacgtatgccaatatcggcattaattgacaaaagttcgccgcgtgtgccacgatgtgagtttttgccacgaacactctcaatacactccaatatgtccaaaattatgttttggtgctttttgaatattttggatctggtatataacatggcacctatgtgtgcaatatcggcactaactgacaaaacttcgtcgcgcgagtcacgaggtgagtttttgcaacgaacgcgtccaagacactccaaaatgtccaaaaatcatgttttggtgctttttgaacattttggttcctgtatataacatggaaaccacgtgtgacaatatcggtattaactgacaaaagttcgtcgcgtaagtcacgaagtgagtttttgccacgaacgcgcccaaaacactccaatatgtccaaaaatcatgttttggtgcttttcgaacattttggttccggtaagaaacatggcacccacgtgtgccaatatcggcattaactgacaaaagttcgtcccgcgagtcacgaagtgagttttcaccacgaacaccccaatatactccaatatgtccaaaaatcatgttttgatgcttttcgaacattttgggtccggtaagaaacatggcacccacgtgtgccaatatcggcattaactgacaaaagttcgtcccgcgagtcacgaagtgagtttttaccacgaacaccccacgaacgcacccaatacagtccaatatgtccaaaaatcatgttttggtgctttttgaacattttggatccgatatataacaaggcacccacgtgtgccaatatcggcattaactgacaaaagttcgtcccgcgagtcacgaagtgagttttcaccacgaacaccccaatacactccaatatgtccaaaaatcatgttttggtgcttttctaacatattgggtcccgtttataacatggcaccctcgtgtgccaacatcggcattaactgacaaaagtttgccacgcgagtcacaaagtgtgtttttgccacgacagcatccaatacactccaatatgtgcaaaaatcatgttttggtgcttttttaactttttggttccagtaaaaaacatggtacccacgtgtgccaatattgacattacttgacaaaagttcgccgcgcgagtcacgaagtgattttttgcaacgaaagcgcccaatactctccaatatgtccaaaaatcatgttttggtgctttttgaacattttggttcctttatataacatggaaacgaatgcgcccaatacactccaatgtgtccaaaagtcctgttttggtgctttttgaacattttaggtccggtatataatatggcgcccacgtgtgccaatatcagcattaactgagaaaagttcgccgcgcgagtcacgaagtgagtttttgcaacgaacgcgcctaatacactccaatatgtccaaaaatcaagttttggtgttttttgaacattttggatccggtatataacatggcacccacgtgtgccaatatcggcattaactgacaaaagttcgtcgcgcgagtcacaaagtgagttttttccacgaatgcacacccaatacactccattatgtccaaaaatcatgttttggtgctttttgaacattttagttccggtaaaaaacatggcacccacgtgaaccaatatcggcattaactgacaaaagttcaccgcgcgagtcacgaagtgagtttttgccacgaatgcacccaatacagtccaatatgtccaaaaatcatgttttggtgctttttgaacattttggatccgaaatataacatggcacccacgtgtgccaatatcagcattaactgacaaaagttcgccgcgcgagtcacgaagtgagtttttaccatgacagcacccaatacagcccaatatgtctaaaaatcatgttttggtgtttttttgaacattttggttccggtaaaaaacatggcatccacgtgtgccaatatcggcattaattgacataagttcgccgcgcgagtgacgaagtgagtttttacaacgaacgcgcccaatacactccaatatgtccaaaagtcacccacccacgcccttcgccatagtaccaataaggtacggcgtcaagggctgcgggcgaagaggtttcgccacatgccacgcccttcgccatagtaccaataacgtacggcgtcaagggctatgggcgaagaggtttcgccacacccactccattcgccatagtgccaataagctacggtgtcaagggctgcgggcgaagaggtttcgcccacccacgcccttcgccatagtacaaataaggtacgacgtcaagggctgcgggcgaacaggtttcgccaacccacgcccttcgccatagtgccaataaggcacggcgtcaagggctgcgggcgaggaggtttcgcccacccacgcccttcgccatagtaccaataaggtacggcgtcaagggttccgggcgaagaggtttcgccacacgccacgcccttcgccatagtaccaataaggcacgacgtcaagggctgcgggcgaagaggtttcgccacacgccacgcccttcgccatagtaccaataatgtacggcgtcaaggactgtgggcgaacaggtttcacccacccatgcccttctaccaataaggtacggcgtcaagggctgcgggcgaagaggtttcgccacacccacgcccttcgccattgtaccaatagggtacagcgtcaaggactacggacgaagaggtttcgcccacccacacctttctccatagtaccaataaggtacggcgtcaagggttgcgggcgaacaggtttcgcccacccacgcccttcgccatagtaccgataaggtacgacgtgaagggctgcgggcgaagaggtttcgccacacccacaatcttcgccatagtaccaataaggtacggcgtcatgggctgtgggcaaagaggtttcgccacacccacgcccttcgccattgtaccaataaggtatggcgtcaagggctgggggcgaaaataagagtcttccaagttgggaggctacaaggccaccctagcctctggagccttttgccacacccacacccttcgccaaagtacccgcaaggtacggcgacaaggactgtgggcgaaaatgagttgcttccaagctggagggctacgaggccaccctagcctctggagcctttcgccatacccatgaccttcaccacagtatccgcaaggtacgacgacaagggctgggggcgaaaatgagttgcttccaggctgggggcgaaaatgagttgctttcaagctgggggtctacgaggccaccctagcctctggagcctttcgtcatacccatgcccttcaccacaatactaataaggtatggcatcaagggctgcgggcaaacaggtttcgccacacgccacgcccttcgccatagtaccaataaggtacggcgtcaagggctgccggcgaacaggtttcgccacacccacgcccttcgccacagtaccagcgaggtacggcgacaagggttgggggcgaaaatgagttaaggagttgctcacaagagcagccgaaagagatttatcatttttcaagatgctccgaggggccgacaaactcaattggatacctgagtgtcaagccgccttcgatgggctaaggcagtaccttcggcactagtgtaaaaatccgttcagaaaaacattttctgctgattcggtgtgccaaaagagttcattaccgacaataacaagcggtttgactccgagaagtcaaaggaaatgtgcgaggggctaaaacttgaaatcaagtttgcattggttgcacacccgcagacgaacggggcagccgaaagggatgaatggcaaaaccctagtagcactaaagaaaagaccgaaagccggtaacagttaaaaaggtcgaagtactaaaaagaccaaagccggcaacggtcaaaacgatcaaagtacctaaaaatacctttccaaaggcaaaaaggggaaagtacgagccgaacagccgtaacacgcaccacacctcatttatttgccaaaaagcacaagttacagataaattccattgcccgccaaaaggcattcggactttacatccgattcatcagcaaaagcagtcctcaatggcgaaggactacccccttgagcatctttttcatcgctagttgttagatcaacacaaaaaattttaaagcggtgaagaaggaaaaacggggattatgctgtgtcgacgctgggtaatggcaaaatgacgctcagtcatataaaattcatgggtgtcttcgccttttttgtgtatgatatttcgtggaaaaaccccaaggcaaacgtttgatcgacgaaaacgccaggggggtgatatgaatcggccaaagcacaactcaccgaacgttgaaaccgcgacaactcgttttcggaaaacataccgatcgtcgctacactcgacttatgcaaatacttaagcgtttttggacgcatatgccaaaagtcgagagcgaatgatgagggctgaaaagtcaatgtgaattcctttcgctaacacgcaagggggccgacacgcttcgcccttccgaacgtacaagttacaaaatgcgatgatagcgaaaagaaacctaaaaacatgcacaagctccatcgggcaaaagcatatacatgttatataaaggagcaaaaaattttataagtatattacatcatccgtttcaggacattttcgcctcgcccctactaagtctggcgaacacggttcatcatctatattgtacacgaatttaaggggaaaaggaggcgaaatacacaccgacgtcaagcgatagcagctcgacgattagtcattttgaagtctgaaaaaagtgtggcaatgtcatcgcggcactggatgtggcacctatcgtaatcctctaaggttcgaccaggatgtcttcgcctccaattcgccattttgacaaccacatagctacataaaaggcgaacgcttgatcgacaaaaacgccaagggggcgaaacgaatcggccgaagcatcgctcgccgaacgttgaaactgcgacagcttgtttcagaataaagatactgaatgccgttacattcaacttacgcaaaacacaagcgtttttcccagcgcaaaatgctacgaatcgaaaacggaagtcgaaagttgagaagtcaacaaatcttttcaccaatccccgaaagggggccgaacgcatgactttcggcgaaatccccgctaaaacaatagggaaaaggggaaagaaaaaaaatataagtcaagaatcgcgcaaagcagacaaacttggcaaaatataatcacccagtgttataatacagtttcgccattctcgaaaggcgaatgctagtgttcatattttttctgcaggagtctaaaaagaggtttcggcaggaacattggccgaaagggggcgcctcatgccataccgtatagtttgcacggtctcggccgaagctccttactcacccttgcccgtgaggggcttattggaggcatgccatgaagcccttcgaccggacctgccgaaaccatagtaccagcaaggattcaagctaaagacgtcaagaccattcaggcgaagccctatggcgaaagccataagcgaagatggcaaaggctggaaagccgcgtcggtactccgaaagtaaaggcatcttgagcgaaggcatctcgggcgaactacaaagacttcgccatgacgagttcggcatcaaggaggcccaacaggccgcccccggtcttttaggcccgttcaccgtagactaggcccagcctatcagcccattaaaggcccatatgtgcaaatgacactgcgtacccatgtaaatgtccctttcataagggcaaccatgtaaaatcccctgtaaccccaaaccctagaaggtgcaagcttgtgctaaagctataaatagacctctagggccatgtaatggggggatccccaagaaaaattctcaattcaataaactttactttctttccaaccactgttgagtaaccacgtctttcgacgtatgcagttgtcgttttgacaacaagggtagttctccctttgttccaatcttgatgaaataggtccaaccctttgatgttcatgttccaatcctgtgctatattgttctagcaaattttagactcaaatgtgtagttgtgaaaatttttagatgcttgaacttgtgggaggtggtctgcccggagccacaggcggtctgaccgtgggtcagccgccggtctgaccggcgtgtgcgcccggtctgaccggccagcagacgtcggtctgaccggccaccagtgggcggtctgaccggtctgatgccgtcggtctgaccgccctactggctacggtctaaccacccctccacaggatataggtacattttcacctctccaaattgtttctaaaattattgctaatatcctatcatcctttgctctttgacagtgatgcctccccgcactcgccatggtcttcatgcgcccactccggatcccgtgagtgagcctgaggagtcgagcggagaggattacgctcaagtgatgaagaggttgaggaaaatgttgagggggctagtgaggaggaaagtggagatgatgtcagtggtagtggggaggatgaggatgaagaaggtgatgagatgcaaattgatccctccatccagtttgtggtgaacatgagaaatccagtataccatctcgaggcatcatgatcagttcttgaggcctcgggacaccccggatccccggtttcacaccgctttgcagaagactgtgtatgagcaggtttatgcagggaaagcttttgcagagcataagtggatttcttggagagacatcaatgagactccagagtttgagagcttgcatgatctcttcaagatagttggcattgactggattgtgaccctcaagcaagactacaatgaagatttgatccgacagttctatgttacagtgtgggtggctagagactatagtgagatgaagtggatgtctgacaccctccagtgttctatctctcggaggcagttccggcggctcctcaacattcacttggattttagagatgatttgcatgaggagcacactcacaatccgctctccatagactatctctctcagttctatgaagatggagtgcggtacacacatgagaaggttgacggcttgaggactatccctagtgtggtcaacaggattgtgagagccactatcctccctcgccttggcaacaatgatgacattaggggggtggcttggcacgtcatcgatgctatcattcagggtcgtcagttcgacattgtgtctctcatgatgcaagagattgctatctccaagaggacattcactcagggaatctattatgccccttacatcatgaggttgattcaagacaagcttggggctgctgggcaaaatttgaagaaaaacaagcagtataagccccgccttcagcttggagctccccgtgctcctaggacgctaccctcttctcaccctggagctagctcaagctcagcacctcctcctcctcatgggtatgatccaaatgctttcttccatccacagtatgcttactttggaatgcaacccaatgaatacttcaacccggtacttggggctattaataccctaagtgaaagcattcaacgcttgtctaccgggcatgaagcattgcatgaggatgttcgtggcttgcgcaccaatgttggagacttgaatgcttccgtgggaagattgcacactagggtgggtgtattggattcttgagtccaaatgttggagagcacccaagcttttgtatatcatcgccgccatgatgctcctcatccttcatcttcggctcgtcctccttctcctccacaagaatgaagaccttttttggtacttgatgccaaaagtgggagaaaaatgtccttaggtgtgctttatgtcttgtgggttgggactagtggtagtgaggttagtcacctcatatctaataggtaaggtgttttgggctatattatgtatgggtatgagctattaccttatcttgtgtattatttttcgtcttgttaaactctaggtcatttggacccttcgtggtcttgtaatagcctatgtttatttgtgagcccttttaggatgatttgtgacttatgtgatttggatggttaagtgatgtgaacttgtgcgatgatgaaaggtgtatgtgatattgatatatgtgactatcttatgctcatggatgaatatgtcttgaagttcacattaaaatattgcttatgtgtttgtgcttgttgaaatgtgaaattgaaatgtgcattggctctatatttgttgattgtgattgttatgcacatgtttagggggagcttttgatttccattgcaatatatgtccatctgtttcatgtttgattatatatgtttgatttccattgcaatatatgtacatatgtttcatgtttgattatatatgtttgagtgtttgtcatcaattgccaaaacgggggagattgaagcatctaggcccccattgttaattttgttaattaatgacaagcgctaattgtggactaaccgttgctattgagatatattttaagttagatccacgtcatgtgtgcgcatggatgattatcgatggattaaaatttgatggcacgaagcaaagaaaagaaaacggtaaaactagtgctttagtttaaaattgatcgaggtggagagcgatcaaatttgctagtttatttttagtttcgccgtactatcaaggggggtaatgacctcgcaatgagatgattttaattgccacattaggtcattatgcatttagacttgtgctcacatttcaccacacacacacttctcacatcccacacagtttcactgtgttcggcctgaccaggggcggtcagactggccacatagtggcggtctgaccggagtgcccaggccagtctgaccggccacaagacggcggtctgaccggcgcataatgccggtctgaccggcgacaaatgagcggtcagaccggctctctggtggccgggatggtgccgctcggggtggccgatacagagccgacggagccgtattcggtcagaccgagctgatggtggtctgaccaagctgaggccgatctgaccggccactcaacgtcggtctgacctgccaggccgatgaggccctctgacagggctacaacggctagttttctagccgttgcagagtagcacggtctgaccggccacatacctccggtcagaccgacatagcacagagttgggggatttcgcccccaacgactagttttggttggtgggagtataaatactccccctccagcaataagggggctctcttggcacccaattcaattgcatacaccccttgcacctctctcacacacctttgagctagtgtggtagaggtagaggttgttctagccaagagtcaagtgcattgcttccatttgtagagctagtgtggcacttgattgatcatctccacgccgggtcattacttgttattcttggaggttgctgcctcctaaacggcttgtggaggagttgcccggtgacctttagaagattgtggaggaggtccggcgctggtttgtgagtgatttggagttcaccaccttcggagtgaaggaagaactaccccgagtgatcgaggcttgggtagtcctctccgtgggccgactcccgccttgcccaccccttgacgaagggggcgtgcggtggcgtggttgagcggtggagttgggctcgcctcaatggggagtaggaaaccggcgaatttccgaacctcggtgaaaaatctcttgtctccttgtctcatttgattgcgcatttacatttgtgcaatttacattcctagagacattctagagatcatatcaccctaggattgcaaaacattgatataagagtgtgatttactttcctagagaattaattgagccactatcaccctaggtttgcaaaacataacttagttgcttagttagacttaaccctcaccgagcctagcaacctaggttagttttgtttaggtgtcatttatttttaaatcgcctattcacccccccctctagtcgacatctcgatcctacagatggggggtgggttttgcccccttgggggaggggaggtgggttagagggagggggcatagaataagggttataagtttcatagtaacatagtgtgttactgcgattatttgataacgttatggcaagaatatgtatagtaagaaaaaaaaggtgcagtaacatatagagagatgaattggctcggtttactcatagggcaagggtagagagaactttcaaagattggtcttttgaaatttaactctccacaagtagtaatactactccctcctaggatgggtctcattccattctaggttgctatattctgaaacggagggagtatatcataagtgttgttactatctgttgtacgttactacaatcctatcatgacgttactatgaaagtgtggtaaatattataagttttacagtaacaaagcgtcttctgcaattcttgaataatgttactgcataaagttgtggtaatgtgtatctgccatgtagtaacacttacacttttgtgcagtaacaaatatatggttagcatgtagacttttaactcatatatttttgttttgattcctagtttactaccgtttcaccacgatgttactatcaaaagtacagtattttatagcaacgtgacgtgttactttacttatacgatgatgttactactgaaacatagtaacttgttatgagttttttaataacatatctatttttcttctactttgggagtgaaagagattagaatcagtcaccatatttctttctcacaaagtgagatacaaaagaaacaagcaataatccttaaaacaaataatatcattggatggattggttagaatagcattggatggattggttagaagagcttgctatgaactatgagattatgggttcactagtaatcgtgcacgtgcaatgcacgtcatgttaaacttatttattcaattttattaatagttaaaaacaaaaaattcattctaactaacatgaaaaataagtgacaaatgagggacttcttcggtgaagaacaaggaaaaaaccctccttggtcccttttgtttccgctaccgtctaaaagaagtttcagtactcacttcattgaaagaaacttttgcaagtgccaccaccatttaaatcatagcaactaatttcatcataaataagcaactatatcccctcaccataacaatttgcgaccaccggataaaaacaataattcagttaagggttaaggtaatcaacatgtttcactgtcagttctgtccagggatgaatttgctatatatggtttaatactatacaattacccccattgtgcatttgatgtatatggtttgacaaaaccctacaagtgtaaataccatgtgaaaaatgggcgcacataacacaatcatgtcatagggaatatagaattttttaagtgcacaattatatcagagcacaacatcagttcaaatgaattcatgtaaaaaacaactattgcaatcgagcccaatttgaagaggaattggacggatgtattcacagtaagggaaaaaaactattgcctaagaggtcagcttcgttcgcaagaaaatattgagacgtcagtttgacaactgtgacacaaagaagtacgtaaaactgtgacatcatgagctcaaaaacctcctttgcagctttggttcctcctaattaatgaagccaaaacatggatgtcactacaaattactgcatcctcaatcaccaagccatcaacctatggaagcaaaacctcacatatcacctgaaaaaaaaggaaagttcaagagtcaaatcatcaagctactgctgatcatgggagaacaactggtggagcatgtatatccatccaaacaatgttgcagaatttttcttctaaaggaatatatctgcatagagaaatttagcaagaaaatttgcttgcttaaaccaaaacgtgtcctcaagtaaaattgatagaaacctagcttaaaggaaacagccagtgcatttaaccataatacagaagtaacctcacctgactattcattgcttgtcattgcttttggtatttcaataccaagaaatcaaatttgatgattgaagaccagtctctctcaatgtagcagttaccttgaaaaccaaaggagaaaatagattatacaacattcatggcatgtctttcctttagtgaacagcattcgaggcttcaagcttgaataatagtgggaataaattttagggagtatacaaatatttcaaccaaacaaaataatttatattaaaggagaaatcaaaatctttgctgcttctcaccttatccaccgagcagtggttgtcaggtataaactttgttgtcatgaatttttccttagtagttccagagggaacatgaacttgattgatgccaatgcttgtgatgagttcattcacccatgcgaccagtaataactccacaaggtattctcgatgcattatgaaattacgtttcactggagctacttcagctgtaaattacataaatatagtttggatgcaaacactcaaattgtaattttgtgagagtaaacagttcagaccaacttcagtgaagtctgtctaatttacaagcaaactgagcaagacattaactactgagttccactaagatatgccactgaaacacccaaatcgctcaacattgcagaaattcctagttaactaaagtgccaagacctaaaagaaatttgaatccaaaggaaaggaaagatgcatgtgattcaatagattgggagaacctgagactgagatgtatcatgaatggatccccaaataaagcacagtaaggagggggaggaggacacaactgctcctaccattggtgagggtcgccgctggaggtagagattgaagagtggcgtgctccctccgtcgcgctcacaagtctggctggcgactatagtgtatcaatgcatgacgacaatgaccaacggcggggcacggctcgatgaacagaattaaacaaataaaatttctattgaaaatatgtcgagtgaatttaacattggccaaacaaatttgtcctcattgcacctgttgacggctgctgacctgatgttccaagtggaatttggataaaattcaaagcaatttggtaagcatataattaagttaaacaatcatatataactaaacattaatatacagctaaacaatcgtaatggccgtatatgtagaaaaaatgaggtcttgaggttcagaaattatctccaatcctagacagctactattatgttcctctgtaaactattcagcttgaactgtacatgttgtcatatagtgaagcatttgagatctccaaacctatgacaaatcaggagtatggaatacagggagaaaaagcattgagctggaagaagcaaccatcagcaatacaggttgagatctattagaagtatatgacaaatcgctataaaacagaatacaaaaaatacattgagcagtaaaaaacaatttgagaagcaaaccatcaaaattttgcgagatcgagatgatatcaagatatatgagcagtacatacatgtgacatctgttctcatccaattagttagctgcaaaaccgatttgcaaatgaagcaaaatatggagtgtattgacctggccttgcagtaggtccggatgtagagcttactgcattgaccatggaagtgggctgaggggaggagccgattgacctgaataacccacacaatagatgaattgattaattgagcagtcaattgatcgatatcctcgctaacaagaaaatagacgtaggtgggcattgggcacgccgatgggtaaacacattctacttctgtccaacgaccaccgtaaacctaaatggtttgcattatgtgcgcaaataagataaatctaacaaagacactataggaggctggtgcatgaaccgaacagaaaccccctccaaatcatgagcgcaaaccccacattcccctccatagacccgcaaatcaactatcacaactctaatttcgatcggttatcctgagcccaccgaacggcaattgagaataaccggaaacaatttaccatggtaagacctagctgattgtgtagctccagccttctggacctattgaagataacgtgcatcaaatcaaacacatgtactgcaaattattatgtgaaactgcacatacttgattcagtaaaatgtataactgctgtgaattattagttagattaaccagagacattcaagtacatttcctggagataattcaaccactggagatagttcacatggtcacatgttgttgacatcaataggggaattaaagtggaatcaaagacagaatgtatttgagccacattcaaagtcattgaaaaattcacaaaatataacctgtggcagtttggcacactttttcagacattttcagtaagacacaaaatgtaagtcattgaaaaattcacaaaatataacctgtggcagtttggcagacattttcagtatgtcacaaaatgtaagtcattgaaaaatttgcagacattttcagtttttcagtatgcaagtaacctgtggcagcgatggagtttgacggcggcgccggatggggacgacgtcggctccatccgcggccgatggggaagaccacggctgctagctgtggagtgcgcggcggcggtggcgatggcggtggaaggggccggtggtggcggcggccgcggctggcgaagaagccggctctggtgaggctgcggtggcgcggcgttagtacatgcgggtaggagcgaggaggcgaggaggatgagaggaggagcgatgggacgatggcgacgaagaagtcggctctggcgtgtccagcggcggaaggggacggcggtggcagcgggggcagaaggggtcgacggcggcggaaggggtcgacggaggcggcggcggcggctggcaaagaagacggctccggtgaggctgcagcgacgcggtgccatgcgaggagcgaggaggaggaggaggaggagaggataacctagacgcgagtggagaggcgtagtcctcgcaccgtcccacgtgaattgagatccagtgcagtccatcgcacacgtggagaggctgtgtattcgcgtggtgacgtggtgaaatagtacggtggagatttacatgatttgaggatgcacggtacggattgatacagatgatttggcctgtagcattggaagggtgcaacttctcctttttatattagtatagaagtatagatatagatgtcttgaatttaccaatttattttttagttttctaaaaaagagagaaaagataataacacatgtacttagcgatgttcatgtcttgaatttaccaatttattttttagttttctagaaaaagagaaaagataataacacatgtacttagcttcctacaactatgtaactttgtgtgtcctgtggagtaataacagtttaggtgttttcacagtaaccaaatgtgttactaacatttcttctcgaagattggtcttttaaaatttctctctccataagtagtaatactaaaccattattgttaccacttttcattgtgagttactaccattccatcatgacgttaccgtatgtgtgtaataacaactataatttataatttttacagtaacattgcttgttactgcaattttttaatagtgttactacaataacatgtggtaacaatcgaacacagatacaagacctaccacccaccttgaactagtaaaggtaggtgcaagtgatatctttttgaattctcatctttaaacaatgatatctctcacaccatattatatttttgaaccgtttacaccgtaatgctttaaaaaatgagctctacaaaactagatccgtcataaatatattttaactatatttcatcagtgttactgcaagtaacttacaacgttactgcatggtggtcatcctattactgctctgtttatacgagacgaggacatcaaataggtgcacgtggaaggaagttagcatccgggtttaactgacgtggcagtgatttgaggtcctttgaccatgctttgatttgggtggaaggtggattataagtcatgaaagaagggggaggtgggttgggcccttcagggggaggggggttatgagcccaatgaaagaagggggaaggtgggttagacccttcaggagaagaggggaggtgggttatgagcccaatgaaagaaggggaggtgggttgggccttgttgaaggggaggggtatagaatagcctcacccttattaattaatggattataaataaaaaagggacaatttcgtttttgcccccactttcatctccaatattgattttgcctctactttttagggcttttgtttttgcccccactttttttgaaccgaaagaggcttttgccc

SEQ ID NO: 49747 - DNA, 24587 bp, Oryza sativa
  unsure (1)..(24587): unsure at all n locations
taagttgcataaactagaaatgttttggcatgtgacacataaccctaggtattatggttttagtttcacaaaacctcacttttaactaatttgagttgctactataacaaaataaagaatgcttaactaggtggctaattgatcaaaagaatacataaattccatatttgattttagaactcataagtatggtggtcaaagatcaattggtcaaaggtgtggttttatgaaacactagaaccataatacccagggttatatgccatgtgctccttgtgattttgtgtaactatgacataatacaaggggtatgtgaattttgctctagaaactctgaagcatctgtgcttgaacataaacagttgataggtcaaatggacatattcacaaggattatgtgaaacccttatgtttgttactacctccgtcccaaaatatagagtttgggttatacctctacgttttgtaaccaagacacgggtaaattctccaattggtggtcaaggacagtgaatggcttgcagaaaagcaaggggctcaactcgttgattattttggtcacttgggagatttggaatcatagaaacatttgtgttttcaatggagcaaaccctagtgtggtgaatgtgctccatgctgtgtccagtgaggccacgctttggtgtttggcgggagctttgaacttcgaagctccaagacctgttgtctaaggcttgtagttcttgcaccctaggcaggttggcatgtgttatctttgttcttagagtgggcgtgtgttgtgttcctataagactttcaattgatgggtgttggggtttgtttaaatcctacatcccagccttcctttctatcttttaatgaaacgatgcgcagatctcctctgcgtgttcgaaaaaaataagagttcgacacgggtattaagaaagtatgtggaattaattggggagatattgtgattggttgagaagaggaattatgaagataatttaaatggtggaaggttgtgattggttgattggttgagaagaggatgtatgagagagattgttatattttgggacaagttttgaatgctataagttgttatattttgtgatggagggagtagcttttagtgcatttcttactttgatatactaaataagaggttctcttccaatattattctttgacaaaactcagatgcagatgcaaaggtgaatttccaatcctatccccgcttatgggattagttttcatacctccctctgtagagaggtacttcccaagtagtgggagactgggatgtataataccttccttccaaggaaaggagaacacatacatgaatagcagttttcttaatccagttctttacaaaaatggatcacaacagccaacttcacatataaaatgaatataaaatttcgaccatcagatgtgataaacttgaactttactcacaaccttctggacagaagaattatatatattcataataagttaatatatataaaatcacgatgcgatggacctctgtaatatcaaaagaaaattagtttacttttcttagaataaaacgagcagtcgttgtttactcattttgtctaatatgaaggaaaggaaggttgttttgttatgcaccgagggctgcaatctgtggattttctcaaataaccacaaagattgagaagctatgagttggcatgatatcttttctttcagttagcttgtaaatgcttttgtagtaacattgaatttattattgtgtgcacagcaaaggcataattgcggagtgctagaatggacatacatgtttctagttcattattcagtagtcttgtttaaatttaggcatgtccagtggatacttagggatatttggatggatataaacaagtcatgtagcagtgaactgaggaataatggctctagaatccttcctatataggatacggattttagttttagaggatttggggtcccctactacccaagaattgtatttgtcgatgtgttttcttatcttaatagtaaacaacattttactgtaatgtatttactgcactggatttgtatttctgtgtaatattaatagtaatattctcatattactagtaattcaggagtatttgtgctttatggccctaaacttgtgccggaatttcacatgggtctctgaagttgagaattgcatatttagggcactaaatttgtaggtataaatcttatgttctggtagccagaactcatgggctatagtaagtgaaatctcttctattgtttacctatattcgacattattgccatccgctgaaattctttcgagacggtaggtagctctagttacaacatgccaaaacaataaatcattggcattgaccaaatattttcatcaatgtgaataacattgcttatttatgtagctgggtgctatattgtgatatggggaatgtgttttgtgtttaaaactattgaagtttcaagagttcttttggtcaattttaccattgagtcttggacttgtagcaattaaaaggaaccattgatgcattgattttcagtatcatataagcgggctaaaatttgaagtgaattgcactgtattgcagggataaatacgtttgattatacacaaccggatgaatggtttcaaatgaatgctgttcttcgtgtcagccttgggaacttcttgttttttgcaatatttgctctgatgatgattggtgtcaaagaccaaaatgaccggcgtgatgcatggcaccatggtggctggattgcaaaaattgttgtctgggttgttctcatcgttcttatgttctgtgtgccgaacgttgttattactatttatggtaagctttttatttgctaatcatctatacgtgtgatttactgtacacccattattctttcccctttctctgttggcgtgctactattaatgtaaagaaagttctggttgggtgagcgatggcaatggttttggccttttggtgcgggtaagtaagttgttaggtgggcagtgtgggtgactgggaaaatattgcagaaggaaatgcacctgttttccctataaccagattttggaaaaggaaatcttgttaaattgagttacttagttttaactaagccagtaacgagctggtggtgagctctggtcccaatgctaaaattgcatggagagagtgcctatttacccaaaatagaaaggtatatgcagacttgtttttgaataatgttagatacatatgtaatttttttagttggctattactttcatgcatatgcaacagtagttcttgtaccctggattaaaaccatccaacagacagcagtccatgtcatgatggaagattatctaaactctagaatttagaatttttaattaaatcgtaagcaccgtatataatcttttttgcctcactatacacctggttttggcaatgctttcgttttgcaaccctcgactgttattgcagtttaaaccacccgaaacaaattaggggtaaggtctggtccaactcagtccagccagacacatgttatgcgatatggccaatcttctctagaatgcatctgcaagcaaaattaggtatggctgattactcctagtgtgcttgagcaagcgtacagtgcaatgctcagtgaaatgtggaacaaagtgaaatacaaggcacaatgcttggagcatcagcaaattgcaatttactccaagaattttaattgttcggtaggtaacaaggtccaataattgttgaaagctaatgcattgaaaccctgaaacaagcctaaatttgcatggttgttattcttctagtaacaaaaggatgccaagataattacacagtgcagtgttgattagctttagttctaatctatttctatttaagaatttgaattatattagtttgttaggcctctgtttggtacaactccaacttcaactatttgggggttggatatctctatctcaaagaaaatcttcgagtttagctgggactataatagggttgttagggtaagacatgttaaccttgttgcagttaattgttggttcacacaacatgaacctcctttttatattcccagatattagtaccacgttttcattggttcttatgaaccagttatcaacttatcatcatgcctcttgtgtttctctaatttgaagattgtccattgcagaggtactgtcaaaatttggatccggcttgtttcttctggtgcaggtcgtgatgcttttagacttcacaaacaattggaatgactcatggattgagaaggatgagcaaaagtggtgtgcacgctagtcaccatccaatgattcttgaaccaaaaaatttctttcctatcactaattctggtatgttaatcttcatgtagggaaattgctttgttggtagtaactgtggtttgctatctctctacatttgccttctctggtttgctcttcacgtggttcaatccctctggtcatgattgtggtctcaatgtgttcttcattaccatgaccattattcttgcttttgcattcgccataattgcgttgcacccccaggtgacacttctacccacttcaagtattctcatgatgcgctctaattgtattttttggtttaactagctataaatgcccgtgcttgcaacataaattaagtaattacttagatcatgatatgttttagagcctcaaaagcaaaagaaaatcattcttgctgatcataagctcgcatttataaaataatttgtacatgtatgtggagctaaacattaaactacaccgttgcttctaataatagaaaatgaatctaaattattcatattctactaatgtcatattttattgtagttttattttcccaccatttggttcaaataaatactctacccattttttctaacttgctacggcacccctccccactattcccaggccccaaacgacggcaatggtggtggtggtggtggtggtggcagaacgataaccaccactactctcttttgaacgtagtatagacattgagcatgcaccattccttatgggtatactaggacaaagtatgaagaatattcacatatgtgttttggtaaccatcacctattagtaatagctgccaagcagataaatttatttaaacaacacaatataaaaatgtttagtaatgttgctcagatgtacttcctatccatatttgtaactcgatgacagtctgctgtattcagtcttgtcagtttgcatagtgaacctgaactgcatttagttcattcctgttgatattttgtgattctaataatcctatcaccaactatggatctgctgggtccactcatatttttctactgggtcataatattgattacgcttatgtttacatttataacagacgtgggattgaattgaatgcctctgatgaaacaaatatcaaatacattagttatctcctgctttcgttggttcctgaagaaataatgtgaacttgtaatgtttccttgcccaggtcaatggaagtgttatgcctgcttctgttatttcagtttactgtgcatacctgtgttacactagtctctcgagtgaaccagatgactatgcatgcaacggacttcacagacactctaagcaggtttcaatgagcgctcttatactcgggatgctcacaactgttctctctgtcgtgtactctgctgttcgtgctggatcttccactacatttctttcgccaccatcatctcctagatctggtacgtaactgccaattaccaaatacccagtctccatctgtgtgcatgctggctatcttgctaatcaacaatgcaataggaatcaagaatcctttacttggtgatgataacgtggaggcggggaaaagcaacagtaaagaaattgatgcgcgccccgtgagctattcatatacattttttcacgttatctttgctcttgcaagtatgtattcagccatgcttctgactggctggacgagcgctgcttcagacagctcggagctgatggatgttggatggacaactgtttgggttcgcatctgcactgagtgggctacggctgcattgtacatctggacccttgttgctcccctgctatttccagaccgggacttctcataggcatgtcaagcattgttaaaaacgtggttaaaccatgaaattatatatatatatatgtttgtgtgtgtgtatgtacgtacgtacgtacgtacgtacgtacgtacgttattcgttgtgggaagccagtagttatgtataaagtccttattgacatgtacgccctcccgtttttttaaatatttaatgcaatttgatttttggacaaacgttaactatttgcttcattcgaaaattttgtgtcaatatccattcattttattcaacacttttgtgtaaacacaaaaaatatagggttaacagtgcttgaagtaactttaatgacaaaaaagatcataacaaaataaatgactataataatagttatgtaaattttttcaataatatgaatggtgtcaaacactaaatatgtatagggaaattttgctacagtacgctgctattgtgtggttttagccctaggacactgcaaaaaattaacttttagggaaaaacactccataattgtggcattttgccggtggatgttggatagtataggggaagaggaatactgcaaatattggacacattgtatggagcctcgggagctagtatatataggagtatataaggaggagataaggaaggattatagatttggaaggaatccaaacaaatcaatcatatcctaatacatctctaactaccacatactctaatatccccccgcagttcaagtgttcacgtcgaacacttggactggagaaaaaaaaccgacaagagtactcaacacgatgatagccctttgtgccgtagtcgatgtagctaaaacgaaggagccgagagagccgtggtcgatgaagccgtgcgtagagtagccgtggtcgatgtagccgagatagggaagcctatgatgtcgaggtagctgagccgcaaggcgcacatggggcgccgtagagtggtcatggacggacgggagggcgtcgtggaccaatggtgtgcgaggacgcgctggagacaaagacggtgacacaatcgcggtagtcgttgaggaagatgacgccgaagagccgatgtaatcgaaccgtgatggacaagacatcacgccgggtttgccagacccgaggacaactcgggacgaacacgcgccatggtgttgccaataccgcgcgggcgaggcaggagaccactatgaatcatacgccatgtcggaggagactagcaaagaaggcatccgggacggtcgcgacgcgagaactgtgtagagggagaattgccggagcagcacgcagttgacggagaagagcgaactgtagtcgaggaagatatggcgacgttggcgatgagacatgttggacaacgaagaaggcaaaatagcgggaccaacggcctagacggcgacgtcagtagccatgtagaggttgctggaccaccggcctagagcggtgatggtggcaacttggagattcgacggcaatgctcgaagttgaggaagaagacactgagcggctgacaatgaccagtgtgcacaacgaggttgtcaatgcgcgaacggcaatgaagacgacgaaagtggcgaagctgcggtccgagagggcaacacagctacagctccatgtcgatgcagcggtgagaagttgatcggtgatgtagccatgctgaggagggcacctctcagcattgcaacaaccagtggaggtgttgaccacaggcaacggcactatggcccaaggggggcgacgtagcggcaacccgaagcttgatggcgtagacgcatagccgaagatgatcggcggcaaggtgtcgccgtagccgggcacttgaacgggtgatcaagccgatgttgcacacagcggaacgacgaagttgaagccggagttgatgccgatgtcggagacgcgtagatgtcgacgaggcattttgcgacgcaaacccgatctctaatcgggaaaaaaaatacgagcaagcaacagcgctcggtggcatatggtcccggtccctagaccaagtccagcaactcccctgcctcaacagtaccagcagcagcaacacatgcacaacatctgtctcctcctggcctccacagccagccatgaccaagttgtttacaccaaaatttagcacctatggacgaaataggggaaaattgccaacgtttggaaagtgccgggtttccttcacagtgctggtcagaccggaggtatgtgggcggtctgaccgcggcctaaattccggtgtgaccgcaggtatgtggccggtcagaccgtgagggtccgagcctgagtctgttttcgtcgggtcttgggtttccttgcttgggaaagcatgtttcgggtttcctttggtttatatcccgagttggacgtggaggagggtttgtagagggcaagaccaacccctatttaagggacaaggtcagttcaattgtaatcccctgaacacacaatctacttgaatgaatcgctttttctttttttttttttacttttcagccatgttttctattttaccttaattttagttcatctttgtcgattgtccgccgccgctgcgagagtgcgacacctctttgtgggtttatgctgaaaaacttccgttttgctcacgagacgggtagttatcctcgtattgatctaaattggcatagaggctgattttgatctctaaatcggctctgctagccggtttagccgttttctacaaaacccatcttgatttggccttttggctaaatcgaggtggttggcgtttaggtgctgcgatcgtgtttatcgacttgtcacaaaaagttgccaacacgatttttggcgactacgttggaaatcgaaacttctggccatccataaggccgaaattaatctacatattaatcatcagagaaagcgccgaattaatctattcggcggcaagattttgtggttattcaggaaatcaatctacacaaatccatagctgttgctattcgatttacatctgcaccatagccggcgtcgtcgttgtctgcgttgaagccgatcgatttgatcggtttgatagcagtagacgccgagcaacagcagcaggtcgtgtaggtattgctgtagagcacggcaagaaaatcttattcaattcggtttgctgagtatacgtgttctagagaaaaaaaaaatcaggctatcaaagcccgaaaagggtagttagcgaatgttcgccatcactagatcacacgaatcagttagaagagggaacgctactttcatggacgcgactactccgcgcgcggtaccgcaatagtcctaacgcgcgacgccaaactttccaaaaataggagcgcacttttttccccacgcatacacaccttgccgaaataaagaaacggcacgttcctttccccacacgcgtgatgcttctataaaaaaggtggtatgtgttccccattctgaactgaggtgcaggcgatgaatagtgcctctattaaacaaatgattgaaaatagaaatcaaaacacaaagaggaagagattaggaacaagtagagaaggtctagggtttcatacccaaattcaaatttgaggtccatcaaaaaaagcatacccaaatcacaaacttcacatgtaagcttatattccccacaaattcatagatctgtgatgaattcttgaaaaaaaaaaaaccacaaacaacccctcaaattggacttcatacactaagctgcatcttcctttttctctttctttgagtccctaaaatgaattttagttcggatgtttacaattgagtaagctatctccttttctaacactgcatcaaaaaaagtcaaaagggtaacatgacataagttacaggtcagaaaattacttctagaaacatataaaattacttcatcaaaacatgaaaattacttcccataaaatatttaagttacttaccaatcacttttgaaatactacaatggttaacaagaaacttagttacattagctatggatccataccctaagacttcacctcaataacctctcagaattttcattctgatatttatacattcgtttggtctttaagttactaaaattacttcaagtgcattatagaacatatatatatatatatatacatatatatatatatatacatatatacatatatacacatatatacatatatacacatatatacatatatacacatatatacatatatacacatatatacatatatacatatatatatatatacatatatatatatatacatatatatatatatgtacatatatatatatatacatatatatatatatgtacatatatatatatgtacatatatatatatgtatatatatatatatgtatatatatgtacatatatatatatgtatatatatatatgtgtatatatgtatatatgtatatatatatatatgtatatatatatatatatatatatatatatatgtatgttctataaatcttgtctaaaaatgcactttattccttaagttgattgaatataacattttgcaactttatctctaatgttgtttatactccactaagcttcatctccatcttttatgataccgcattaaaaagttaaaacgggaaaatgcataagtaccggctgagttacatatcagaatgaatttccacaaaaagttacttctaagtccatgcaaagttactttcttaaaacataaaagttactccccagtaaattttgaaaataacaattgttaaacttagttgcaatgctatgaaaacatgcaactatatacccagaccctcaaagatctaagagccgagagagggctaccgtatttatcatactcttctgctcaagactcatgtgggcatacaactttgtaatttccgtaggggaagctctagcattttcttgcagccaatgtatgaaaataaaacgacacacattggcatcctttatgaaaccggaatagaactaactaaagtattattagttgtactatactatataagttaattctacaacgtgcaaagttacttccacatcatgtaaagttacttctacaacatataaagttacttctgcaacatgtaaattatttcccataaaatatttaagttactttgagtttaaggcataagtatcggctgagttacatatcagaatgaatttccacaaaaagttacttctaagtccatgcaaagttacttccttaaaacataaaagttacttcccagtaaattttgaaaataacaattattaaacttagttgcaatgctatgaaaacatgcagctataaactcagaccctcaaagatctaagagccgagagaaggctaccgtatttatcatactcttctgctcaagactcatgtgggcatacaactttgtaatttccataggggaagctctagcattttcttgcaccaatgtatgaaaataaaaagaaacacattggcatcctttatgaaaccggaataaaactaactaaagtattattagttgcactatactatataagttacttttacaacgtgcaaagttacttccacatcatgtaaagttacttctacaacatataaagttacttctgcaacatgtaaagttgctttcataacatgttaagttacttctagaacatattaagttacttatgtaacatggatagttacttctacagtaaaacaaaaaaacagaaaaaagttggttgtttaatacttactttttgcacttttttgagcaaggatgctctacatcttctacataatcttctctcaaatctctcttcttccatgttgtactactctcttccggttttcagtttttctcgttagttgcagcgcggtattgattgtttcattacttgttaacccttatcaatgttgccaaacataagtttaggtacctttggctttagtctaaccatcctagttttgtattcacttagttttccctgattcctctctagatgtagtaactgcaagaaaaaggaaaagtgaaaagcaatcagtacttgaagcaggtttatagaaaattacttctataatatgtaaaattacttctcagtggcatgcaagttacttttgaaaattgataaaattacttctcaaatacaaaaactttgcatcatgtatatgattatctgcatccgaaacttgaaaagaagatgattgagctatagtgattgtacaccaagattaataatcatattacagggaccaaatatggatttaattactattctacacaacctagaactcatcatcttcagaccagacttcaccagaataggtaggaggtttagacctacataactgcatatttgaagtctgctaactcaggcagaaactgaggcctataagcctgctaccttggaacccgaccaagtccctacttatttgctgattgagcttgaatatggcccattagaccaacatgctgctaatctaggagcagcctaattttcagggttaatatagattcacataagctctgactacgagtactctgaacattttttgctaatagagaatggttagcgaaggctagaggtaatggtcacatacagcaaagcaactaacataatcgtcatcaccaaagtttgctcacaagagttcagtgacttaattaacctcgggtaaaatcaacaagcagtaacaaataactgagaccaaaagtcgctgtgtttcacaacaaatatttcattcgcgagcccaggaacaaaacaagataatccatctagagaaaagagagatagagaagtgatgaaaaacaatgaaatacttgcaagcacttatgaagcaacacttgcaatcagctatcagaataattgtctgaaactaagaaaaaatgcagttttttttgggaggtgctgatgataaacgaactagatccaagacgaaatggaagacactgcatctttacctctctcaaagcttggccctgcactgacggggctccggacgggcacgggaccaacactgagctgccgctcgggggccttgagctctctcggctaggagaagtatgtacgaggacgaggacgtgggtggagattaggaggacgatgaggagcgggaggaggtcgaggagccaggggtggagcgcgacggtgtcggcgacctgcgccatggtcatgtgctaggagagcacggccgggtgccgcaacggccggtggaaccccaccaccggctccagcaccaccaggttgttcgagcgccgacgccgtcgtcgatggcatcgcggaatccaccaaatcgtcattgcatttaccggattttggagcgctcgaggggacgggatgaggaatgctcgacgatagcagtcgccacgccacagcagaagcccacaatcgtcgtcgccctcgccggatttgtgggagaaagactcgccgtcgcctgatttgtgagagaaattcgcagtgggatttgggggaagaaactgtgttggagtgtcggtctctcttgggtgtaccggagtctgccacgtggcttccactcgggaatcttctcagctccgcccgcgcctggatcggatggctacgccaacgcgctgggctctcccgcgtgtcgggcgatacgacgaaatcgagagcgatcttgaattagattttacgtatttttatatgttttcagttttctttttccttcttttacgcgattgtttcgtaatctgttacaagtattctttctgtgttttttcactttctttttatccgatttcattttttccgttatagtttttatagcatttcagtttccgtggaaactttcaactttttatatagagaatttatatatgtaaattatatatacataaactttgtatatgtaaattatatatatataaattctgtatatgtaaaactttatatagtaattgcatctgcagttagaaagttaaatgtataaattttactagaaataataaaatgttgacggattttttttaaatgaacaatttactatgaaactttctatatagactttctattgttgtcgaaacgacaactgcatacgtcgaaagacgtggttactcaacgatggttggaaaaacgaagtgtattaagttttgaatttcacttgggggatccccctgttacatggccctaggggactatttatagccccattacaggttattactactagggtttaggttgtacaggggaatttacatgattacccttacgaaagggacatttacaggggtacataatgttataggggctcatgggcccctaatgggccgtctggcgatcgccggccctatagcccttaggcttgatgggccggaaaggcttcctcgaccctcgcggggctaacttgccatggcgaagtcgtcttccttcggcaggtagtcttcgccttgcacccttcgcccgagacgcctctggcctggcaaggcactcgtacgactcttcgccttccgccgttcttgctccatagcctttgccacgggtttcggcagattaggtcgaagggcctcatgccatccgccatcaagcccctcacaggcaagggtgagattggagcttcggccgagaccgtgcaaaccatgtggtatggtatgtggtgccccctttcgaccgatgctcctgccgaaacctacattatccctgccaatgaagtttgttacttgtgcggctggtattattttgccgcgcttcgcctcgtgcgattggtggttatatatattctcttttcccgggccgaacggaacagtattgggccttcccttcatgggctttttactgtgccgctcggacggtgggaatttaccgtttcgcctacccttgtgacacgtggtgctttattattggtgggtaggcgaacggtcgcctgggtgagctatatattcccacccctctttccttttcattggtacgcttgccatttttaccgcgcgcactctcttcctccgtctcttccttccacagcatttcttgacccctcaggtgtttcgcccattctcttccttcgccaccgcatatacgccgttcgccatggcccctcgcaagccaaacccagcttcggcgaaaggaccggatcctggccgggtcgatgacgacagcaccgcctttttgggggtctctcttgtggacgacgtcgagctggcgaagctggtcagctctggggcattggttgaggggcaggctttcgccgcggggaaagccgtggtgccgaggcctatcgacaactggacagtggtgttcgccgtcttttttgaggcggggctatggtttccgtgcaacgtgttgttgccgaagatccttcaccttttccaagtggagcttccacagctgagtccgtcggcgctagttcggatctccatctttgactgggcgtgccggacttccgggtttgagcccagcgccgagctcttcggcgccatatttttcgccaccgtgaactcgaagacggtgattaccccagccggaacgaagaagacagtgttcgggagcgtgaactttaacgttcgccccgagcggtctgatctctggccggtgaacactgccatgtcgaagtgggaccgccattggatggcgaggtggttctatcacaccatccccttcgcagctggttctgactcggcaaaagccctccggtgccggcgtagggtgattgcgccgaatcggaagcctaagatcgccgtggacggcgctatggaggcgcggttcgtcctactgtgcaaggtttgctcccgccttagctgccgtggcttggtggaggagttctgtatgcttcgcatctttcccctctcccagtcatggcgggtcacggtcgagcaatgcgaagaggctgatggtttgccgaacttggttcttcctgaggggatgaatagtaagaccgttcttttgctgtacactcctgtgctttgttattttgccttgtctgacctttaacacagctacaccctttacttttgcagtgtcgaccctcgatcaggctgaagccgaagcccgcaggatgatcggcgacgtttcggtcgtcgagtatagccagctgctaacacgacaagcagctaggcgggcaaaccgggtttacaacggtgaattgcctccccgggtgaatccccaaaaagccgacaacgatgcagggccttcgcgaaagcggatgcgtggacaagtgaagcttgcccccaggaagcgaagggttcttgcttcgtcggactccgacgccgacgatgaggacaatgccgaagaacgtgacggcgaggaggaaggagaggaagaagaggaggtggaggccgtggccgataaggccgcgaacgaggcgaccgaagaccgcgtcgacacgcccggctacactcctaccccaagtctaggtcacaacgagaccggggtggagtcgaacagctccctccttcgacgaaaggatttggaaggggcgaaggccctagttgcgttctcgtcgggcaaggcggcgaaaggaggtctggtcaagaagatctcaaaaaagaagggactcgtcgacatcgctcgcgttttcagtgacgacgagtcttctgacgagactccgacctcacctgctggccgcagtttggacctttcgactgctccccttgctccgctcggcgttgctggggccggcggtagcgccgccgccggggcttccgcctccaccgaacggatcgtgtcggctgcggcgagggttttcgggagccctgtgcgcaagccagccatttcgccgctggtcaaggcgaaggggaagtgtgcggccgccgaagcatctgcctcggagtattcccttgcggcgccccacttcgcccctggtgacttcgagacccgggcggaccttattccctttgtggagggagtaagcaatcttgtcttgcctgccggcaccccgagcctgttcaccgaatttaacgagttcgacgaggggtgttccaccattaaaagtctggcggttcgggtatgccttttcttccttcttcgttttcctcttccctctttttttttacgtctcgcaattaaccttttgtccttttcgtccgctcctatctttcatctagattcttgcggctcactgttcgacggagcgaaccgtgcgggcccgttttgacggttttaagagccgtcttcgggccaaggacgacgaaataagccgcaagaacctggaggtggagtccctggcccgcgtactcaaggaggcgaagactgaagtcaaacgccttcagtccgaattggacaaggggaaagaggcctgggccgaggttgatcgcctcaaggccgaactggagaaagagaaggcccattcggcggtgctcatcgactactacaaccttactgagccgaagatggaggctctttgccagaaggctagcagggccgaggcgagcgccgcggaggagtcgcagcggttttcgtgggagaaggcgaagatcaccgaatccgcaagaacggcttgccaaacgctccgcctcgccttaccgacatgggcgcgaaggtgcggggggtccctgccgaggatgcctcagccttcgacttctccgagtggacccagcaggctggcggatcggtttcggactgcgccaccgcgtatggcgattgctgtgcgcgtgtatcggcggccttcaccttaggccttctgcagcagttcggctgcgagcacatcgccgagttccctacctatgtaaggggggactgggagattagtgcgcagaacatttcgccagctcttcgcgcgtggcgaaaacagttctggcagaaggatggccggtccgctgccaaagcgtgcctcctggagcaactaacgaaggcggaggcggcagatcggggcgaagaggaggaagccgcgggcgaagaggttggaggcgatgctcaggatcacccagaggtgtgaggccctccgccctttccttagatttttgtagttttcctccctcttttgcgtttgcctggagaggcgaatgatgtatattcggcaggctgccgatgaaccttaaaaaaggcttttttgtacatttggaatatatgacacaatcttaattgctttttgatgatcgaggtctttggcatatttttatttcgctcatttcgcattatgccatacctccccctgcttccgcctattcttaccatgtaagctgtgttttgctatttctgcgctgtctatcagggggttcgccgaaagtcatgcattcggcccccttccaggagctggcaaagtcaaaacgagaaatttgtggcaatgaagggtctgccgaaggtgcgatgtccatttcggcctgtttatcgcgaaatggagataaacggtcgcagctacaaggttttcaaggttgccaactggctgcgggcgcaccccgggtgaacctgagaagattacgatcttgttcattcaagaccctcagaagacgtttggaggatatggctcgtttttggcgaaaccatcagaagactaatcgtcaggaaacgatctttcagcgtcgttacagtttagtctgtgtatcgccccctactcctcttaaggttgtgtatgatattagtagtgatgacgaacctagtttgccttatcattccttagggagggatagtgattacgggggcgaagatgtaatttacttgtaaagcgaattgtatcgtgttgtgaaccttctattcttcgattattttttcgaagttaataaagaacgtgctttatttccttttcgctatttttcgcattgtcacattttgtgcttttgttaggtcggaacatgccggcccctttgcatatatgagcgaaataggtgtactgacttttcagcttttcgtcgttcgtcttcgatctgtagcattctgtgtcgaaagaaacgcttttgcttttatgctgatcggacgtaacgtcgttcggctatttattttccgagacaagctgttgcggtttcaacgttcggcgagcaatgcttcggccgattcgtttcgccctcctggcctttttcgctgatcaggcgtttgccttggggtttttccacaaattatcaatcacacgaaaaataaaaagaaggcggaggacacagagattttatactagttcgggcctccaaggtggataatagccctacatccagtttttttttctttttcctctcttctcttttttttctttgccgaaaggcttacatagtgccgaagggcttacatgacagtatgtacatttttacaagttggcgatttgggtgccacccattctagacatagaagcgcttgagagagacagcattccaggaatggtcgaactcctcgccttcgagtgtcgctaggcgaaaagatcccgtcctggacttatgtttgatgaggtacggtccttcccactttgattcaagcttgccaaccgctactgggttcaccttcttccttaggacgagatgaccaggcatcagctctgtgggtcgaacttttttgttgtaagttgccgaagtgcttgtggcgtacttatgcatgtgctcgagcgcttcgactcttaccccttctaagagttcgagcgatacttcgcgcccctcttcgcccccagagaacatcacccttggtgagttagcccctagctctgctggggtcattgcctcatcgccataaagaagcataaacgggctaaacttggttggtcttgtgggggtcatctgaagggcccagagaaccgatagcaattcttctggccatttgcctttcgctgccccctcgagtcttttctttagtgcttctaggatcttgccatttgtacgttcggccgccccatttgattgcgggtgcgcgactgtcacgtcctgataaattcatcccgaaataaaaatcattttctaaaaggaataatagaattaattaaaattcgaaaagaatttggcaaacactaaaatacgtacaagaaaaattcgaatgtggcccggagaatttttgttaaattctccttggtctaaaaggagccctcaaattttacttgaattttcagagcaccggaaataattattaaacaacaaaaacaattatcaaagtttattaaaaagaaaaacctaaaaataaccctccttcctcctttgggccaagtctggcccaaagtcctccctctctcccctcggcccgtggccgaagtctccctttcctccctctctttctctccctctccttctctccctcctcttgggcccctcttcccctcccggcccactccctcctcctccctctctcccccaggccgcctcttcctcccttcccgcctgggccgcgtcccggcccaaaccgcgccacctagccgccccggcccaagctgagccgctcccctcccgcgcacgtgcgtcgcacgcgcgctgagcgcgcgccccgcgtggggcccacgcgccaggccggccgtcgtcttcttcctcctcccgcacggccctctctctctcccgtgaaaaccctacttcgttcctccctcgaatccgcgtgatttaagcgttggattccaaaattaattggggggttttaatccccattgaatcctcttcaattccccccaatttctcccttgattcgtgccttcaatcgccgggaacgcccgcgtcttctccggctgtctcccatggccgccggccgccattcccgtcgccgttccgccctctcccgtgctcggttcgcttccctccgctataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgccgccgcctcctcttcgccggcctaccctctgtttcccgcggagacctccggaagtgcctccccgccggcaaccgtggtgttgccgccacgattccgcctccagccgcctctccctcctcgccggagcgccgtccggccgcgccgtcttctccctcggcctcgcagccacctcctctccctcggtcagccctccgtttcgcggggaaagcaccggagacgcgtcctcgccggcaaaacagtggcgttgccgccactgttccacctccggccgccactgtcgcgtttcccgtgcgccggccgacgtcgccaccacctccctcggctccgcgacgccgccctcatccccggcatcacctcctcctcgcccgaagctcgccggagtggcctcctcgtcggcgtccagtacctccccgcctccggccggctcctgtacatcgccggtacgccgatcgacatcgccgcgttgtcctctcctccagctgctcctctgtttcgccggacaccgtcgcccgtgctggcctctccatcctcatcgttgccgacgtcccttcggccgcccgttcatcctcgccggctcgtcgtctcgcggcgccgcctccgtcatcgtcattgcagcggcgtggagcacgccgtcctcgtcctcgtgcagccgctgccggctgtcctcgtcgcctccttcgccgtcccggtcgtcgtcgtcatcgtcgtcctctcgtcgttcccgggcgtcgcggcgttcgtccctccgtcgagccgttctcgtccgtcgtccgcgttcgtcaagcgagccgctgcagccccgtcgtcgtcttcgtcctcggctccgcgtcgtcaagcttcgtgccggccgcgtctcgccttcgtccaaggatcgccgccgaagtcgttccctcgccgtctgtctccgccgcgcccgttcgtcgttgtcgttcccacgcctcgtcgcgtggtggtaaggtctcccctcttgctgccccgtcctcgtcctttcgttgtcgcccgtgctcgttgtgcggttgtcgaccccggtacccgtgtaccggtgtcggtagtcgttcgcttgtgcgtgtggtgaccgtgttagtgtgcccgctcggtagccgcgtggtttccacgtgtgcagcccgtgtggtgtctagtggactccgttggtcggccactcgcctcggttgacacacgggatccgcttccgtcgacccgtggaccgtctctgtgtactcggtctgccgcggtcctttttgttgacatgtgaggtccgcatgtcaacggcgcagccttcctgtcttttctaggctagcgcttacacatgttttataattgcaaagcttaattataataacccgtaaatctccatataacatcattaaacttcggatgatcatatcttggtcatacgaactccgaatcgacccgttcaagtctcttaatgtttgttataacctaaagaactctgtgctttctttttatgtattgttattgcttctttataggcttgtagctttgcttgtgtgcttcgcgtagctttcgtcgttccggaggttcccgaagcgtggttcgcggccgtcgccgaaggttcggaaggccgttatctctgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtattctattcatggttccactagtatgaatttaggtagatgcttcgctgattaattaggcaatattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtctgtataccgtggtggtatgtggcacgtggttgcacgtgaggaaaatgtgtcttgtgggtaaagatgtacacctctgatcagagtataatctattcgaatagccgcgccctcggttatgggcaagccgagcaatgtacccaagtcagtattttaattcttaaaatttgctcaacaactaaaatgtggaatggttggcctgggttggcttgggacgagctgggacccagggtcgggttgccagttcggtctgaatcatcgtaggccttgggttaaggcaggttcgtgcgggttcacgaccttgattaataatactgtgtagctctaggatcgtctttttaaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaaggtgtcttaggtggagtcctggcttataccccagttgagcgcctgtgaagatggagccgtaggcccgctagtccgctgctgtttattattgattgtcaggccttaagtgcctttgtaataatgtaaatattatcgatataataaagatgtgctttttgtatcatgtttgtgtggtgtaccccggcttttcctgggacggggactaatacactagcgttcgggaaaatgcaaattttctcggtcacgacagcgaccgacgcgaacctgatttccaggttaagcccttcgcacatttctctgaacttatcagagtcaaactgtttgccgttgtcagtaatgaactcttttggcactccgaaacggcaaacaatgtttttccacacaaacttctgtaccgctgccgaagtgattgccccaaggggttcggcttcaatccatcgagagaaatattccacagctacaattacgaatttatacccgtttcgcgccaccgggaacggcccaatgatgtccagtccccatctggcgaagggccatattggcgcaatgggctgcagattatactggggcgcggcttggcttcggccatgacgctggcaactttcgcacttcttgatttgctcaacacagactttcaacacagtgggccaataaactccttgtctaaatactttggaggccactgttcttgcagcctggtgcgcgccacatagcccctggtgtatctcctttgccatttcttcgccttcggcaaaagagatgcaacgaaataagggttgaagtaccccggagcggtnnnnnnnnnnnnnnnnnnnnnnnnnnnnnnnnnnnnnnnnnnnnnnnnnnnnnnnnnnnnnnnnnnnnnnnn

SEQ ID NO: 49748 - DNA, 956 bp, Oryza sativa
ggttcattttattgattcactgccggaggtatatcctgtagttgaggaatgggtggaggatgttcttatggatgaggggaacgcaacaatatttactctcttcgcttgccttgtaactgtcctatatttgcgagagcgtcagaggcgtcaagctgcggccgccaaccctcaacagcctgatggtgcacccatctaatttcaacctttgcatcatgatgctgggattgaagtggacgttaagcttgaggtacatagtcatttattctcagccatatcataccatcaaagttttgtttgatgtctgaagtgttaatggaatgacaacgtccatactgtcatactggaaaagcgggtccttcaactgcaaaatgctgatggctttctgaggttaaaaatcggggtttaaaatgatagctctccttgacatctatgtacactaaaattgactaggataagaactgatcatgactgttggatattgagatcatgttgtgggttctaacagagtagtgcttgtaagtaacgacggttgttcaagaaaacgtatactccctccgtcccataatataagggattttattttttttttcttgcactgtttgaccattcgtcttattaaaaaaattgtgcaaatataaaaaaaacaaaaagttttgtttaaagtactttggataataaagtaagtcacaaataaaataaataataattctattttttaaaaaaaataagacgaatggtcaaacagtgtaagaaaaaaattaaaatcccttatattatgggacggagggagtatttaaaaaggctatctttcttggcttttgcatatgggatgcatttctgttgacggggcatgcactgcaatcagtccggctctcaacttttcatggtcaacaacctgacgacacaattgtgtgactagagaagcgtgttagtgggtagaagttcaaattttaccc

SEQ ID NO: 49749 - DNA, 5014 bp, Oryza sativa
cttcttatgaggacctaagcacaagtaggtggtattgccaatctcccaactgttggcgcgttcttcttctcctcctcttctttagcttcctctgctaggttgaggacatgtatgtagtcgtcgaagcattcgtctattgttctgaagggaatatcagggtaaaggcttgagatttcaatgtctctaggcccgtctatgtagaaatgtgtctggcaaccgtttataaaaatgtcatgcgtcagtgaagcgactatgctctccgggatgatgtcatctgcagtcaaaatgatgaatagatcatacaccatgacaaaattccatttagagcgcgagagtattcttttaggtggccaaacctgcagccatggcgatcaagtcctcctcggtaagcgtcacgcgtggcagtgtccggccgatcttgctctcccacagcgacgccatctcgttcgtgctgaggagattgcaggcgggacggaagtgcacgatcttgttgatgctccgggcgtcgtaggcagccctgatggtgaacttaccaatgtcgcttccagccacgaagaaagctgcacgcgcgcgcatgcagcacaccgttggcaaaatcgcatcgaaggtgaatttcatcatgcggcgcaagcatgagcgtgtactacgtacctctgacgtcgccgtcgccgtagatctggaagcggtcgagcggcggcggcagctcggacgggtgcgtgctgtcgtggtagggccagccggcgatggagttgcagcagatgaaggtgtacggcacgcccgacgcctccgccgcccgccgcaccagccgcttctcctcgtagaacctcagccccgcccccaccggccgcgccctgtccacgtcgtgcccgaactccgacggcagaaacctctgcacccacgcacacgcaccgcgcagaccaaactttacgtgccaaaaatccgagttgtgcgacgcgcgcatgcacgcgctcgtatgtaaaatgtgtagtgtacgtactttgaccgtgcctgcagctcggatggcctcgatgaggccgagctggtcgaggatgctggcgccgcccatcaccgagatcaccacctcgacgccgcgcgcgcggagcgccgcctccacggacttcctcccctccttccccccgacgcagccctgtcacgagcacacacgccatgaatccaaatatgtgttcatttccgcgcgcttaactaagttggttaattttaaactctaatcacctcgatgacgacggcgcctttctggcggagcgcgtcgacggaggcggcgcgcgcggggcaggcgttcccggggcggacgaggatgaaggtgtcgcggccgctgtcgaggcaggcctcggcgacgaaacggccgatgtagccggtggcgcccacgatgagggccgcgccggtgcggcgaggctgcggcacttcttgcagcagcagctcctgagcagcaggcgccatggatcgatcgatcgaccgatgggttcttgctggctaacacccagagctgaaagctgatcgagtgcttggtagatctagcagcgcccggccgtcttcgacacacacgcaatgagtgtggcagtgtggctatgtatggcttttgtaccgtgccagaaagtgtggaggcaggagagaacagtaggtaaacacatggccgccttcgtgcgacgtacgggtgatagacggccaaaactcaagagttaggtggtgaataatcccagattttcctggatgatatctacctagctaggacggcgcaccagcagcgaggcgttaatcaagggcccccgttgtatgcataaaaatgcctctacagaatgaaatgcgccttaaatccaacaaaatttccactccagatacagaaacatgtctcgtgctctgcctccgccaccgctttcctctgttcttcgtgtctctcgctggtcgtcttctcgtctcatctcatctgcccccaactgatatgggccggaaatttgttgagatctcagtgcggtctgggccagtggctatctcgtacgggccgcgatctgggcctcatgtgattagcacacggcgtttaccaccactcctgagcatcgcagttgcgttgctctctcccctctgatctttctctatggaataattgtctaggcatctgtcgtatgatttttaagaaaaaatcactcagatttttttctccccttatatttgcatccaaccataaaaataaagtacagagaaaccgttcaggtagcttgtgattgtattggttactagagtagtatttagtagagattaacacaaatgttgcatttataactaaaattacagtgccttataactaaaattacatttgtaaaaaagtagatatggtatgtaagtacactgtaattttagtacaaatgcactgtaaattttggtaactataatatttatcgttttagtacaaatgcactgcttgagaaaccgtccaggtatctaaagtgttaaatgttgcatttataactaaaattacagtgctttacaactaaaattacatttgtaaaaacagtagatatgacatgtaagtgcactataattttagtacaaatacaccgtaaattttggtaactataatatttgtcgttttagtacaaatgcactccttgaaaaaccgttcagatgtctaaagtgttaaatgttgcatttataactaaaattacagtgctttataactaaaattatatttgtaaaaacaatagatatggcatataagtgcaatgtaattttaatacaaatgtgctgtaaattaaatcatggtgttcatattttggcccgtgctcatcagtttgtttgtattattcattgtgtgcccggtaaagatactgctaggtggtgtcgtggtggtagggggataaatcacgaccgtcaaattaaaccatgcccaagtgatccgacgaaagcaaattcggtgatttgacgcaaaaaatctgtcgtgagacgtatagcaaaatcgttctctatctttgcagtaaaagcgctcggttaatgggtagtagtattttggcttatcggtgacttgacgggcgcgttacgtcagtggaggatatataaggccgcacaatccgcgccgccatcagttcgctctcgccaccaacaccaccgccatttccactcgctcgagagcaccagattagcggaggagataggggtccgcgactcgcgagggagaggaaagcaagcggagttgaggatgcagatcttcgtgaagacgctgacggggaagaccatcaccctcgaggtggagaacagcgacgccgtcgccaacgtcaaggccaagatccaggacaaggaaggtaaccctgctctcttactgctcgtgttgcgagtttgagactgcggttgcatatcgatctctctgcccccatctgcttgttgcatttgcccgatcagatcagtagcaaagaattcgtggatttgggttggtcggtgactggggtttttggctgactaattgtttctgtgcttgtaggtatcccgccggaccagcagcgcctcatcttcgccgggaagcagctggaggatggccgcacgctggccgactacaacatccagaaggagtccacgcttcacctggtgcttcgcctacgcggcggccacatctggatcgagccctcgctcagggtcctcgcctacaagcacaacatcaacaagatggtctgcaggaagtaatactactcgcgcaccgctcccttcttagttcttacatcgatctatcgcaacctgagatgttgttgagttggtcgtgcttgcttagatgagttttgttagcgatgaacagttcagtattttagttggatgcattctattacgagtcagctatgatcaatgtgagcaccttgtcgatgtctcaccaatccaccatactggatcgttttaatttcagtttttttttctaacagcaggggcactaggccactggcaccacaaaggcacaaagtcctctctcactgtgatatactgttgccgtcaggtttatgtttattcacgtcatgtagttagttggatcgatataaggttgataggcaatgcaagcaggaaggttcaattgcgaaccagccagatcggcacacatatacattctgtttcgggtgtgtcagtttagtcatcaatacttttgaaagaatttacaaattgtaccatgctgcaagtcgtttgattactttgttcactctttgccctttctatggcttggtgagagctgtgctgttactcgtttacgttattgggacggttgtttggtagaaaaaatgatcgatcgatccgatgcgcaagataagctgtgtttcaaaatctctcaatgtgcatacatatagtctccctagtcctttatatttggtcagctataaggcaatttggtcgagaattttgtgcttgcaaggtttattgcacaatttgtctttttttgttcacccctttgtcttgcaggtgctatgcaactctgcctcccagggctacaaactgccgcaagaagaagtgtggccacagcaatcaggtgagccttatcaccataaaccatgttttcagtcttagtgatcatgtcctaatatgacttttggagttatgatgcatgtttcattgtttgcaaatggtacttagtagttcttagcgatcttgtcccaatatgatttgatgcctgtttccttcttgtcaaatatgagtagttaacataatggagtttgatgttccagttttggttctgtggtatatgcatcctatatatttctggtgtaccgtgtgctgttaccgtatctaaatcgtttgcatatgctgacaatatgaaacaatgagatgtttcagattttgtcagcttctaagcaatgacatcctcagatgaatatttctccccattgttctgattatgtacttttccaatccattctttttcagctgaggccaaagaaggtgaggtggtgcaggtacttcaacttctgaagagtcatctcatccatcattccatcagtatcatcagagtcaccagcgttcaagcgttatcaaa

SEQ ID NO: 49750 - DNA, 1912 bp, Oryza sativa
cagtttccaccaccaccgccgtcttcctcaagccgtcaaacacacgattagggcatcaacagggagagcaaaagaggaggtagctcaggcagaggtagaaagtagaatagggaggagagatgcggatctacgtgaagacgctcaaagggagaataatctccctcgaggttgcgaggagcgacaccatcgccagtgtcaagcacaagatctacgccgagcgaggtaagacctctcttagtgcaagctatgaggcccgtacttctagtcaaaaagttagcccaaagacacctagcctacagggcaagcaccgatatatgtgtggattaattggatagagacacaggtaaggaaatgaagcccacagtgggcgtgacctagcccaccaaatccacaacttaattccccaactacccctctctctgtgttcggccgtctctttttcttctcccggtgcgcaccgcatcccctcccgcatctcgcttgcatcgccaccgcttgactcccctcctccctccaccgacggccggcgccggatctccttcctccgccgccagcgccggctctgcttctcatctcctccctccggcgccgcagctgtggttgccggctcgcgcggcgaccggcagctgtggatggcaggaatccatccgagagatcagcgtttcgtcttcaacgcgaggcagttggacgacaaccaaagcttggccgattgcaacattacccataattccacgatacacttcgtattcggcattccctgcttttacgctaccccggtgcggattttatgattttcatatacctagaactttcgatctgattccgatttagaatcgtgattttaacaaccttgctacagactaaagaaagtttataaacgtgctgacattacatgcttatatatagttagataaaaatgtgttccctaaatattactccctccgtttcaggttacaagacgttttgactttggttaaaatcaaactagttcaagtttaactaaatttatagataaatatagtaatattataataccaaattagttttattaaatcaataattgaatgtattttcgtaataaatttatcctaggttgaaaatttgttatttttttctattttgggagtacaaggtatttttttcatattacagttgggctcagaaagacttatttttccccgttgagatcgtattgaagtgaatgtgactgctccctttattgtcaaccgtatgaagacttttggctcgtggtgacctttactctactctcttccaggcatacgaacagttcaaccgccttccccggtcagagagctcggattcgagttcgacgagcaaaggagacaggtcggattcgagttcgacgagcaaaagagacatcgccccggcaaatgtcaaaacagtgcactgcccagattgccaggtccaagctaacgtgtactactgcaacaccaaggaggataacgaaggctgtgtgttctacaggtgcccttatttctcggtgagtgactttcctattgttttgctcatgcttatgtttataattaaaccaaatttaaaattaaattagagttgattatatggttgttcaccacaaattattctacagtatttgattttggatcgccaaggacaaaagttttactcgtaaattatttttaaattgctaataaaatgattcacatgtatataataagcataagctaaacagattttggatcgctaaggaaaaaaagttttactcgtaaattatttttaaattgctaataaaatgattcacatgtatataataagcataagcgaaacaataaagtcattcccccgatctatttctgctagtttggaactttggattcctcccgttcttcatcttgacatttttttttccttgtagatacacacaggctggtgg

SEQ ID NO: 49751 - DNA, 1544 bp, Oryza sativa
gagagagagagagagagagagagagagtacagcgtgggtattctaaaaatgatggaaggactccaaaatggctacaacagggagacttttacgagagaaaaatgagtggaaatgagagcaatagactcagaacaaagggtggatgtaatatcatcaaaggacaggaccaccacccatctcacactagctaattaatgggcaccttaaacatatgcaatagcaaacgagcctatgagacaagatgtcacaaagtaccaattttgttgacctttggtccattctcatcatccacaccactaaggccccctttgattcaaagaaaattggccataggaatttatttaggggaaaaaccttgcgggttagctcatcttccgttaacacgatgctaccgcatagtgccatgccttcggaaattggaatgatcaaagttttcattttttttccccgattacattgaaaacgtgcgcgcgcatcaccacacacaccatactcacacttatgcgagtgtgctcaataacacacgctcaaaaacaaaaacaaaaaccaattacatattgttggcccccactatatctttttttttgttgaccggaacccactatatcttttaaaagcacaattttacgtgaacaatattcgtaggcggcatgatttaaatcttagtggatggtcatgcatctacgagaccacgaccccaccatcacaacagtacacgtgctttctccgaagttttaaagtttgctaggtgaaatgccacattactgatctggatgttgatatttgagttgaattttatgaaattcttaactgaaaagtggaaaattcttaaggaccaagtcaagttggcaactgaagtatcaatattttctatatacacttgtcctcacaaaagattaaaaactatgcgcacttcttttctagaaggttctcctagtagttcctagcttggtgtgacgtaatttctccttcaaccaatctaaccaattgaaagaaaaaacactttctccaacaccatgttttttcctctttatttatttatcacatgcccaaacaaatcatcataagaaacacactaccttaatgagaccctccctaacgacggtcctcccaccctgttgataaactaagctgtacccatctcaacccatgtacttttaaattctcctaggttaaactattctcaaggcctcaaggggtggtaggaactaggaaccggcctaactctgagttgacgcccctccaaagtccaatcaagtttccttgatcttcgccgtagccctttccatttacccttccttcatccccaagctcatctcgaaaaggaacgtacacgacggcacgggaacggatgatcatttgccgccggcacatccatcgatcgacggcgacatacaccggccccgcacactgcacacacgcgcgggggtcacacgcacaccatacacgagagctaatcttagcttagctcgctttcttctcctgtgtgtgtatctcgccgtcctcgcctttaaaagctctttagttccccgtcgcgtcagaaa

SEQ ID NO: 49752 - DNA, 5716 bp, Oryza sativa
ccactgtcaccaagctcgtcagcggccgcccgccggagcgaggagcttccccttcttccacccggacggcaccatcacgcgcccctttgtccccgacgcgtcgccgtgctctggctccccgatgcgctgccgtgctctggctccccgacacaccgccgtgctctggctccccgacgcgccgccgtgctctggctccgtcgtgctctggctctgcaacgcggcggcgggggacccatggatcgccgtgccggcgaggaaggtcgcgggtgcgggggccgtcgccgccgggtgcccggcccgctcctccccgccccactctggcggcctccgctccttgcccgccacaattaggccgccgccgctccttccccgccccactccggtcgccgccactcctccccgtcgctccgctggagagaagagggagagagatgggataaagagaagggatagtgaggatgataggtggggtccacgtgggccccaccattttttctattattgtgtgtgtgaactgatatgtgggccccatatgttttaatatttttcggatcgaatttccacgtcaatgccacgtcagatgaagaccgagtcaaattagccacgtaagcgccacctcagccaaaaacggggtcaaatactgccgatggaccttatttaaacggtttcgtaagttgggggacctgttgtacccggttttgctatcaagggacgaaaatcaaactgggcgacaaatagagagacccaaagtgaacttattcccctgaatattacacggttgctcctttgcttgctcggggcatagggctatgtgggccttccaataggccgttatatgccttaacatctcgaattgcattcgacccaggtaagatctggcctggccgcctgtcaacaaagaactggagtaacaagggtcttgttcgtgtgcaacggcagtagttccaatcaaaaaacaacaacggcagaaacggtttcttgcgaattctgattcttggaggcttttatctgcacttctcattccgcataataaatttgacaggatatactttcctattagctcgttgggtcactccaacgtctatgttctgatcaagcagggtggtatatcatctttactataaaaacccaactcctgacattgaagtataaaaacccaacttctgacattgaagtactgaagtactccctccgttccataataaatgcaattgtgggttttagtgtctaactttaaccatccgttttatttgaaatatttttatgattggtatttttattgttattagatgataaaatatgaataatactttatacgtgacttaacttttcaaatattttcataaattttttaaataagacaaacggtcaaacgttatacatggaattatagctgcagctataatgggatggatggagtatacctatgtcccaatataaatgcagttgtgggtttccgtgtctaacgtttaaccgtccgtcttatttgaaaagaatattattagcatttttattgtaattacatgacaaaatataaatagtactttatgtgtggcttttttaaaaaaaatataattttttcaaataagatggacgatcaaatattggacacggaataccataactgcatggacgtagtatatgtctaaaggaaataattggtgcaatatctgcggctgatcaatgatagtcctcttgatcttactgaagccgataaattcaatctctcacgtcgcgtaaaaatacagtgtactcccaccatagaaaattataggacgtattttatttttaaaaaatgaagtctttaagacaagactttgattactgactgtgcataaaatttattcataatatctacaaaaccaatgtttcatgaaagctctttgaaggatgaatctattggtgtaacttttttatgcactaaatatacttataatctggctaattcttggtcaaaatttacaaagtgtaactatttcgaaatagtactagtgtgtgtccagcaacagattggaaatctacaacaaccgattggaaatgatgaccttctagccaaggaatgttactatccgtcgcttgaagggaatcatccaaatcaccatccctgggcacgaagactagacgagttggtggaagctgcagaagtaatacgccagtgcagatgtgtcgctcctgtgcctggtctggtgaagactgaagagtaggagactgcacaagtagagcggcgagcaatatattcaccatcaatctgaactctctgaaatctcccatccatttctgaacatcaatctcaagccatgcgtctgaattctgcaagctcacttctgctgcttctcaaactcagtcacctagccatcgtggccgccttggccgacggcgcggggttcaccttcaatggcttctccgccgcgaacctctccctcgacggcatggccgcggtcgcgccgggcggcctgctcatgctgaccaacggctccatggtgatgaaagggcacgcgtcctacccgactcctctgcgcttccacggctcgcgtgacgggaggagcgccgccgtgatgtccttctccacggcgttcgtcttcgccatcgttggccagtacgccgacgtgagcagccagggcatggcgttcttcatctccccgagcaagaacttatccacggccctgcctggtcacttcctgggcctcgtcaacgccggagacaatggcaacgcgagcaaccacctcttcgccgtcgagctcgacaccgtactgaacggggagttccaggacatcgacgacaaccatgtcggtgtcgacatcaacagccttacctccatcgaagccgcaaccgccggttactacgacgacgaggacatgggattgttccgcaacctgagcttgattagtcgcaaggcgatgcaagtgtggatagactacgatggcctgaccatggagctcaacgtgaccatggctcccgttgagataaccaagcccaagaaacctctgatctccaccattgtcaatctctcagcagtggtcactgaaccggcatatgttggtttctcgtcgtcgacagggataatcttctcacaccattatgtgcttggatggagcttcaagatgaatggcacagccccacctctcaacatttccattctgccggctttgccacttatgatcagcgagcgccgatcacaggtcctagtgattgttctgcccattgtatctctggtgcttgttctagcatcagccgcaatggctattgccgtagcaaaacagcgggctaagtttgctgagttgcgtgaggattgggatgttcccttcgggacacatcgcttttcatacaaggatttgttctatgctaccgagggttttaaagagagccagttgcttggatgggaggatttgggaaggtgtacatgggcatgcttccaaagtctaagatgatggttgcggtgaagcggatttcacatgagtcaaggcaagggatgaaagagtttgttgctgaggttgtgagccttggtcgcctaaggcatcgcaatgtcgtgcaattgctcgattattgtcgaagaaagggagagctccttctggtttatgattacatgccgatgggtagtctcgacaagtatttatatgatcaagacaaacctactctagaatgggctcgaaggcttcagataatcaaaggcgtcgcatcaggtttgttgtacctccacgaagattgggagaaagtagtcatccaccgagacatcaaagccagcaacgtactgctcgatgctgagatgaacggtcggttgggcgattttggacttgcaagattatatgaccatggtactgaaccaaacaccactcatgtagttggcacaatgggttacctagctcctgagcttggacaccgcgccaaagctacaccatatacagatgtattcgcatttggcgcattccttctcgaggttacatgtgggcgtaggcctgttgagcaggaagctcctatggtgcttgtcgattgggtgctcgactattggcgcagcggttcaatcatggaaacagttgatccaaggctcagaaatggctatgccgaggaggaggttgagcttgtgctcaagcttggcctgctttgctcgcatccactggctagtgcaaggccgagcatgcgtcaggttgtgcagtacctcaacggcgacagcgatttcccggaactgagggcagcgcaaatgggcttcagcatggcgactctgctgaagaacaaggggcttaacccagatgctatgtcatacgcaatgacatcgtcatcaagcatcggtactatgtctagtactctctcgggaggaaggtgataatatggttttgtgttgacagatgatatttactacaaatgatgtaggagtatgattgtagtagtactagtggcgctaatggaaaattgtactgtaaatctgtaatggacagcaaaattcctggtagactggattcgtggtagacatggaagttttataggagtacaaatcaagactttgctttcgcatgggaaacatccggagtctgattcttagtgtacagtgtatatctctatgaatgacaagcataatatacaatgtgttttgagttgaaaccaaggaacttgagtgaccacagatgcacagactagtaaacaaacacctccttctcaccacgcaaggttgtcgaacgagtcaaatgttgacggatcgtggccggccggcaaagcaattagaccactactccactagtaaacctatcccctagaaatttggtacccagtagtctgactatctcactactacggcatccttgtttctccctctgtcctttctagcagggtactgtttctgatgatgatgcattagtattgaattgacttggatgaagaccaagccacaaagctgcttgttcagaaacttcacccaaccactgaagacggaagtgacaaaatttgagagctctgccctggctcatgcgtcacggtagccatggtgatcatcaggcccatctccagcttccttgtactcactgtcttccactgcatcaagctggtggcgccatctgctagcgaaaaccagttcgccttcgaaggcttcgccggagcaaacctcagcctcgatggcgccgccgccgtgacgccgagtggcctgctcaagctcaccaacgacaagcacatcaaaggccacgccttctatcctactcctgtcagtttccacttgacgccgaacagcagcgctactgcatccttctctgccaccttcgtgttcgccatcgtctccgagcatgcggagctaagcgaccacggcctcgcgttcctggtcgcgcccagcaagaacctctcggccaccacaggggcgcagcacttgggtctcatgaacatcagcgacaatggcaaggcgagcaaccacgtctttgccgtcgagctcgacaccgtcctcagcccggagctccacgacatagacagcaaccatgtcggcattgacgtgaacagcctgcaattcatacagtcccacaccgccggctactatgatgacagcaccggcgcgttcatgaacttgacactgataagccgcaaggccatgcaggtgtgggtggactacaatgggcaggccatggttctgaatgtgacgctagctccattggtgtgtccaagcccaagaaacctctgctcccaaccggcctcgacctatcgagggtagtggaggatattgcctacatcggattctcgtcggcga

SEQ ID NO: 49753 - DNA, 2828 bp, Oryza sativa
agctgagaaaagattggaaggttgagtttgaaccacaaaggttttcttacaaagatctgttcgatgccacacaagggtttgggagcaagcgtttgcttggaattggaggattcgggagagtgtacagaggagttctctctgtatccaactctaactcagagattgcggtgaagagagtgtcacatgactctaggcaaggggtgaaggaattcattgcagaggttgtcagcatggggcgccttcggcacaagaatctagttcagctacttggctattgccgacgcaagggtgaacttctcttggtctatgaatacatgtcaaatggtagcctcgacaagcacttacatgacaagaacaatcctgttctagactggaacctaaggtttcacatcatcaaagggattgcatctggcttattgtacctccatgaggaatgggaacaagtcgttgtacatcgagacatcaaggcaaataacgtgcttctcaacaatgagatgaatggatgcttgggcgacttcggccttgcaaggttgtacgaccatggcaccaacccaaggactacacatattgtaggcacaatgggttacctatccccttagcttctccgcacagggaaggcatcaccagctactgatgtttttgcctttgggatgtttcttttggaggtggcctgtggccgaaggcctctggaacatgacctccaggacaaccaggtcgtgctactggattgggtgcttgagaactggaacagaggacaaattcttgacgtggtggatcccaggctcagcagtgagtatgttgccgaggaggcgaacttggtgctgaagctggggctcctctgcttgcagccgttgcctagtgcacggccgagcatgcggcaagtcctgcagtaccctaatggcactgtgctggcaccagagatgttgccgacagacttggactatgatacactaatgtttctgcagaatgaaagggttgagtcatacgccatgctggaagcatcctcattggcaacaacagttggccctgggtctgatctttcaggaggaagatgatgaggacttgtggtttaccattgcttgttagttttctgtatgtttatctaacaagtttgtacttataagtcttaatgcctttaatataataacaagctgaccactctatgggctatggcatgataatatactatcatggcaaacatgactaaccctaaagaacatgatataggaaggcttaccacattctctgcattgatgtgctatctatttgggcgaatattacaacatatggtagctagaacgggaacacaaggttattcgcatagggaccttgatgttataccagattatgcatgtggaacaaaatcaatgttttcaagtctccaggaactcggcatcaaatcaattaagatgactaataagcaactaacaaattccaaaaggagcaatgtacgtacaagcatggagaaacccattggccataggccattgcataatgcttattggttcttttccttgctctcttgctcaaccatgtaagccttcttcatttcttccaggactgcatcatttgtgctgcaagcatacacacatatagcatggttattacatctaaaagaaccgcggtgtatttatcatgcactggccaataccagtctacaagcaaagcatcaggaaatcttcagaaaaaaaaatgtaacagtaaatgcttgacagagagatttcccaaatgcattgaaagaaataactttcagcactacgctcctaaaggatgatgctagtacagttacaggtagctttagactgggattctaaaacaaagaattcactgaacttgactccatcaaatccctaacaatgtactacatagcaaaataaagactgaccaaataaaaatcaaaataagcctggttcctactgtcagtgtaatattgcaggaaatactgatgtattcattggtcaataagttagatcctaacttgaaataacagccagactacagcatacaatgattaaacatatagtggaagatatttttgatagcaatggaaatcctcgcccctcatatatgtacagattagagagtaaagatgttgacaaatatcttgcagacttccctgctcatattagtgcgtggatgtttttaacaataagtatctactgaatgaacagtacaaagtagctaatcagtttctgtgattaggctccatgcacaattttccttatatattcttatagcatgttatggaactctctggagctctggtttgtacaaaaatcaacaatgttcaaacacgaaccggaataccgcttgaattactattaggatactggcatataatgatcaacttacaattgatgaaggcaatcattcaactcttttgcttgtttgcggcattgccataccaccgaaaaagttctacctcgagcacactcagcatattttgagcagtagaaatcacactccttaagggccttctgcttcattttgctccgcaaagctgaaaagtgaaatagaatgggctaaattaactctctgatgtgaagtacaagaaacttggatattgtcaagcaaagcacaaaatttccccttaagtacaatattctaacctaacactagagaacaactaattgagaaaactcttttgaaatacaaaaggcacatgttcaaattttctgaatgttcttcctttattattctgtacagcagtcttcagcagctcctaacattataaggaaagttcgttcagtcaatcagtctgtgcatatagtttgtctttcacaagaaagttctcctaaagattcaaaaaaatcaaaggactgatgctc

SEQ ID NO: 49754 - DNA, 4049 bp, Oryza sativa
tcacacaggattgtgttcccatttcaacaagcaacaccagcggagcgcaatttttcgtcagtacctcacccgttacgcaactatcaggcgattttgcagacctcaagaccccccaaatcaacgaattcggaagcttgaacaggcaaaggatgcgggggctcaccttcctcgaccttcttcttgacgtgattctccctggcctcctgcaggtaccccatggtgcagcgaccaggcgcacgccgtatcggatcgacgccggcgagggcggtggccggcgggggggatcgttcagtcggagttaaaccctaactccctccttggaaggggacgcggacattgacggggaaggtctcgctgtgttttcccctgttcgttggtgggcgagggagaggaagtggcaaatgggctaaacttggtcggcccaaaaaggcccaattcatttggcccaacaggccgtgtaccatcagcctatatgggttttctcccctctcctcttcaccaagcaagttttgctgaactgttgaaaatggccaaagttctcatgaagcagcatagatgagagttgagaccagtagacaggtacagagtcgctgccaggatcaccactgaatcagaaaagatgtttctctgaattgttcaggttagagataggagttttttggagtgaatgctcggcgtagttagacctacacagattaatataactcatatatctgacacgtagccattcatgaattatggtagtataatgattatgtacctcctgatgaaataaggaatgtttcttcgtgtcactgtagtggttttcggttcttcacatgggacctgatgattggagattctggaattgctcgtagcttcaccaaatcgcacgagatccttacagctcttttgtaaggcggataattccaattcgttcaccatcaacgaccaaaccaggacaaaatcaaactagtactactactaatcaagttggtaaggagaccaactgacgatagcatccagccaagctcgacgcttttggcaccaacctacccttgtaaaatgccggatggcatcgccgtaggaggccgcgtgtttccgtactacactcaatgtgtttggtgaaaaaagaaaagcgtttcttgatgcatggttatttgacttaacactaacttaccaaggttaaaagcagatactactgtctgctactaaaatgactgcaggtgcatgtgttttcttacggatcaaggttgcagcagagccaagtcagaggtgtccactgcactagacatcccgccgaattcgatatgatactgaacatcagttgcgtttgaacacgtacgcgcatcggattctgatggttttgcggtagctgacgcctggctggagctgcctgcacgtagtgccgagacgtcctgcctgatcatgtcaaaaacaggtcagaatcaggatagtttccacaagaaacgaacccaaatcccatcggcgacagaatcacggacacaagcacacaactcgagctgattgctcactccacgacgggataagatcataagaagaaactgcaaattaaaccctgtcccgatcgcctccgcccaccactctggatgaggatcagaatgggcgcgtgtgggctcgacgccatcgctatcttccacatagaagaaccttcagaaaccgcaagagggaaaaaaattcagtaaagaactggcatatggcttttcaattattatgccgtttctgtctgtgttcgtcagtggactccagtgacaggttattcacaggtattcgttgcgttggagaatactactcccgctgcgttgcttttcgtctcgccatcaaaagcaaccatttcctaatcctaccggctcatccgtgcttcttttcttctgtgcaaataataatgattggttgagatcacgcttaatttgttctgtttgctaaccttgctcccacgaatgatagcgtgcatccggccgtcctggattcgttttgtgttgatgcgtgtgtcatcttctggatggatggagcggtctgattaaccgccggtttatttgacgcttatttatgtgtttcttgtctgatttggatcggtttattggcgatttggacttgcgagaacgatctgccatgttttatacggattaccgtctgcctgtaatagttttctacagttattatcttggtctatatggacttttgtggtgtgtgatgtaaaaactaaggtgcaataattcattatcaatactttgctgcatcgacctaaccacgaccatgccgtaaagacgttccactttcagtattttctacacctttttctagagtactagaattcatgagttcatgatacatacttattttctgcacctgttttttttctagagtcccattgacacggttgagtgctgaacttctggttttagtgattaccatgagagggaccggttccaaagtccaaacgcaggattcctgaaaatcaacttcagtacaacttttgcaacgccccctgtccttgctttgctgcagtacactccatgaccacagcaacaacacgtcaaacagccaaaactaatcacaattacgtcgtggatgatcgaacgatcggtcgagccaagtaggcgcttgtgagaagcaacggtgaaaggaacggcaaaggactaaactaagtggactaatgactgttaacgcccatggccgcccttcatgggccatgatgcttcacttttgcctagctaactgccacccatcagaatccctcgaatcatcgaagagcacctcagatttttaggccccatttgaattggaggataaatggaggaaaaacaaaggaattgaaatcctacactattcatacctttgatttgtaggaatgagaaaaggaaaaacgtaggaaactttccttttcctacgattctagaggaaaaacgtaggaaatttaacatccactccaatttcttggaaaacttctcttgagtctatctctctcatctgaatcctgcgtttttcctgtggtccaatcaaacggccattcctgtgtttttcctgtgttttgcaatcctctgttttatacttgcattcttatcagaatcctatatttttcctattcctccgttttttcaatcctacgattcaaaggggcccttatatcctctaatatatattaccatgtgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcatgccccccatcctatataaggtgggcaggaggccctctagggggcagatgacataacctgatcatcagatcaatacacacccggcggattcaaatccccaaacaggagtagggtattacctctcattgagagggcctgaacctgtctaaatcctttgtctccgcatccatccacttttaggtctcgtgcgctacccccttttattattgccgaatccatgtttcgacaccatgcagctgcctagtcaccggtcactgattaaaatttctagctgtaaaggggctctcccttcttcctttctggaggtataaaatggtattgtatcactagggattaacttgagtctcaagctgactagagctgcgtcggatgaacgccagcctgaatcgatccatgctcaaagtggtcgagaacaaccaaatattctgcactgaatatggtagccttttattttgggaggaatatcatggaagacgattcgaacgactttaatctcacaaagttttaactggtcaatgtagcacaactgtaactactaccaaccatttctttttttttttcaccttgcaattgcatcgagtggagtggccattgatcagccggtgcttctgctccgtgtttttttttcgaggggacaggcagggagctcctgcaattcactatagaagaagagagttgattcaatt

SEQ ID NO: 49755 - DNA, 12011 bp, Oryza sativa
  unsure (1)..(12011): unsure at all n locations
ccgtgagcagcccggagtgatttgccccgggatcgcgtggtntgtgtcgtgtctttgcatacggcgacatgctatgaatccccgctttacacctgtcagatggaccaaatcaccaaacgtgattggcggtccaactgcagagcagtagacaaagatttgaggaacaacaggcaagacatcggcacggcacctgcagactgcggatgaaggcgttcgccgtagaatttgagctttcgtttactgtaacagggctagttggttgtacttgtaccttacggttgaaagataatgacacctagtagatgatttgccggagaaatattataggacaggaacttaatactcattttcttcgaaaagtcatacggaataaatacatgtgctaaagtgttctcctttaagcaggaacatcagagctttcaattgagtagaacaatgcaggtacacattgccgggtttcaaaccgctgctatttttctccttgggatcatggcaagcatttttcgtcaacaagactgttagctgcctgtttagcacgcgtcaccaacaaatgtacagagtatgttaccaagatataatcgaagcaaaccgcctggggtagtgtttttttctctctttttgttcgttatagcctttataagatgtagaattgtaattttttaactgatccattaatacgaaacatcgcactaactcgtagtggttgcttaaagaaaaaatcatagcaaacaaaacaacggccaattccatccttaccaatttatcttgatgtgttggcacggtaaaaagaccaaaatcggcccaacgtttttccatcgaatggacggagaccaaaacaagcaagcaacttggccttcaatcttcttctccttcgcgctctcgccacgcgccgctgctcgccacagagcaccaatccaagattccagagcgggcggtataagagaggggtaggaggctacacccccgccgcctccacactcaccacccgatcgaacaccgccgtcacagcgcgtcgcggcgggggcgatgggcctcttcggcggcaagagcgcctcttcgaagcagaccgccaagctcaagtccctgatcaagctcgctgccgcgcgcgtcgccgtcgcccgccggccccgcctcgggcgccgctccattgcccgcggcgatgtcgcgcagctcctctccatcggccacctcgaccgcgctctcctccgtgtatgtccatgccatgcttttgccttgcctgacacgcgcagagactcctccgctaacagtagccgccgtgttctgtttctgcaggcagagcaagtcatcgacgaggacaacatgctggaggtgctggacatcgtagagctctactgcaaaatcctcatcgagcaggccacgcagctagataagcccaagtatgtatgcaagagcacacagccgtgttcttgactcctcggttgattaattccttgccttgtttcttcgttttcatcgcctctcatcagcaagcttttgtcatctttgggttggtgtatacagagagtgcggcgaggagatcaaggaggcggcggcggggctcatgttcgcgtcggcgcggtgcggcgacctgccggagctgctcgacgcgcgggccatcctggcggacaagttcggccgggacttcgccgcggcggccaaggacggcgcccacggcgtcgtcgatcccacggtaggtttagattgatcattgatccctccaactaaacccatctactaccacccaacacatgccgtgtcatgtcgctcgccaactgcgcgagacatggaccggaacgaactggagttaatgaggacacggttgctctgccgctgcagttggtgcggaagttgtccggcgcgccggcgagcacggagcagaagcagaggctgactaaggtgatcgccgccgagaacgatatcttactggaatttcccgagaacaccggagataccgatcaggttggttgcaatctgcgctacctcgcgatgtaatatccctgtttgttgagatttttcgttggttttatcttacgaagttacggaatcgtatggttgctgtactgtgcaatgcagggcaagcagaatgaacaagccaggaacgtccgagctgaacaatttgtcgaacagaatgaggtcaagagggagcatcacgaggtactagcacttgtacaagatcatagcagttttttctttttctgtagtatctaatggctaatgtcgaggattcaaattgtaacaggttcaggggaggcagaggtttgttgacgaagaagtgaacccgatacttgctcggctgagcgtgcaagaacagtacgccgacgccaggatggcggcggaggcggccttcaagtcggcatcgttcgccgcgatggccgcgagggcggcgtcgagctctcgcggtcggagtcgcaggggaagggatcgagaggcggcggcggcggcggctacgagaaggtgcatccggtgcagaattcggttgcgggcgagaaggaggcgccgccctcctggaagccgcacaagcctccgtcgccatcgacgtcgccgtcgtggagcgacaggagcacggcgacgtcggtatggtcggaggggacgcagaaggggaagggcgtcgtgttcgacgggagcgacgaggaagtggacgacgtcgcctggactccgcagctgcgccggcctccctacaggagggcctccactatgggcatcggcggcggcgcgtggaacggggaggccggcagggtcggcgccgacccgcagccgttccaggacggcgtgtacaacaactcgcaacacccgcgcccgccgcacaggaggcacgcctccgagctcggcgccggcgccggcgcgccccgcgagcccctggtgtccctggcgccccaacgcggccagtacagggacccgccctacaggagggaccccgcggcctacagagacatcaacgccggcgcggcgcaacggcggcagccggacggcgccggcgcgagaccgtacgagagctcggaccacgtccacccgccgtacgctcggatcgtgtcggcgctggaacgcagcaacgagcacatcgcgcggcacgaggaggtgcgcaggatcggcaccggcgagcgggtgctccaggagagggtgtacggcgccggcggcgcgccggggcgcgcgccgctgaaccaggagcaggggaggctcaactcggtgcgcacccgaagatgaggtggtgtcttccggtcgttggttttggcgcggcgcagcgcattggtcagtcagctcagctgttgaattccggtgcaggagaactgggggccgttgcttttttgctggcaaaccggaggttcgtcgcgcgggatccctggagatacagggaaagggatcccctggcttaacagctgtgcagttgagtcatgtcagtgactcaactgcatgtgcagttaaattagaggatctgctttcgagatacagatatgatattctgcctctgggaaatcaaatgtgtataattaaaatggattgcgctagaaacgaaagagaatgtacaaattacagaggtgatatattcccttttttttttgttgtcctgtacaaaggagttgtaatcaccgttttgcgaaaggagacgggttaactgagtctttacggggtgatcgatgaattgcacaactctgcacgctatttgcacaaagtttggatcgatgcacggctgctgctgctgctgcgctacacctgaaaaatggcactctgcataagtgcctagatgtgtaatggctttgttatctgcgagtaaaactactgaactagttgctatctcagccgtgcatgcggtgctcgtcttcactgtaccatcttaaaataaaattcaccacgcacaaattgtgcttcctttcgtaactgcttgaagcagagcagcacattaccctggctttggtgtttctgcatgttgtttgcgttttacatccggtaaatttctttgcacgtaagcacgtttggctcgctgtcttctcattgcattctgcatgctttgctcattgtcattctctaggtgatgctcaattgctcccccacccaatattttccatatgcaagaaaggagtacgacagttcatgtacaccaaagtgaagcaacaaacacaaaagttaaactacccagaacagaagcaacatggccctacaaaacccttgccccttcatgcagacttcctccatcagctcacacaagcaactcgcattctcctcctccttcctttcccccacgcaaaggaactgaccatacaactgataaggtcggagttcatataaccaacagcctaggacaggaacgccgccgagaaccgataacttaacaatggggttcctccatcggaagacctccaagcagacgagcaagctcaagaccctcctggggctcgccgtcttgcgcatcgccaccgctcgccggccccacctcgctcgcaaatccattgccaccgatgatgttcgccagcttctcaccctcgaccacctcgatcgcgccatccaccgggtaagtgtctacgaccttctctgatgaagagagggatccacattgctccaaggcgaggcgtgctaatgccagcaatgtcttgattttctcctcacaggcagagcaggtcatagcggaggacaacatgttggaggcgttcgaaatgatagagatgtattgcaagcgactcatcgagcatgctgcgaagctggacaagcctgggtacatacatttcatttcttcacacttgacttgatcgcgtccttgtctcttttccggtcacatgacaattctatttggtgtgtccagggagtgcaccgatgagatacgagaggctgccgcgtcggtcatgttcgccgccggttggtgcagcgaattgccggagttgctgttcgcgcgcaccatccttgcggataagtttggcagcgacttcaccgaggcggccaaggacggcaccggaatcgtcgatcccatggtactagatagcatatactatccattcatttcacgagtcaatgatttgtatttggaaagatggaggaatggagagttaacaaagttgggtcttgcagttggtgtggaagttgtccagtgatgcgaaaagcatggagctaaagaggaaggtgacgaaagagatagccatggagaacaacatcatagtggacttctctgagctccaagatgcgatcaaggatgaagaagactgataccatcgggagcttgagcacaacacatcatgctagaacaactatgggagctcagagtactcaagacgacaaccctgtttctaactctgatggatcttattagtgtatatcacaagtcaggtggggaagcaccggtgctcacaggaagctatacttcctttgataccagctcaaaaatgtaaaaaaaaactaggtgctgtgtgtgcactccaagattaccaagctgtgaatatacatgtggatgtccacccgttttttacatgtcatctgaatggttatgatattttttttaaaaaaaataacatgataggttaatatgtaatatatcatctcacaaacatgcaagttcaaattcgatttccacaagttgtaacaaaaacaacaaatttgactgtaaatatacatatactagttaaagtttaatttgttatttttgttatagcttgtaggagtcaaatttgaacttgcatgtttgtgaaatgatatattacatattaacctatgttacaattttttttttgaaattttttcataatcatttaggtgacatgcaagaaacgggtggacgtccacccgagagattagaatccatctccctgtgtaaattgcaaatacagatcagacaaagtacacacgtatttatcgttgcagttacagtgcctcttttttacccttcaaattgtgcaaacttttagtttgtgcagagtatatactgaagatttaaatgatgtctgctataatatatgtatgatgaacatttaaacgatacttgtaacaattacatatggtgttccttagctccaattagtggaggatgaatgtgctctacagtttagccagaggttccgacgtttggtcgtcaaaataatgtggatttctttatgaattactccttccatttaatattataagtagcttttgattttttaaatcaaacgctttaaaagtttgaccaagtttatagaaaaatataacaacacttatagcaccaaattagtttcattatatccaacattgaacatattctggtagtttttttgttttgtgttgaatatattgctatttttttataaacttagtcaaaattagagaattttgacttaaaaaaaataaaacgaattaaagtatgaaaaagaggtagtgcagtatcgcagctggctttctacaaaggcacagaagcatagggataaaaaccacataagaaggttaagcaaagatgtggaaatatggtgctacgagaataacatggtttctctgcataaagaaggggccacccactattctacactcatatctatggtactaaacaagcatgattctgtagtacttggtgtcatgcattttgacagaatatgaaaaagtctgaattacacccctaaattattgcatcggtccgatttacacccgcgaactacaaaccagacattttgtgtaccgaattcttcaaaccggacaaatactaaaaactattttgagttgttttctgcacaaactagtacacacgtggcattccaactgaaaaaataaagaaagcaacagtgggcccacatgtcatatctctccctctatctctctctcgacctcagatgtagcgatgaaggaagggaagtaactcgacgacaacttttcgatctaaacctcaccagcgccgcttccatgcgttgagtccaagcgccgctgcggcaaaatcgcccaattcactatcttttgcaatgtactagcatgtcaacaaagagcaagaagcagtagcaatgtactagcatgtcaaccaatcttttggtttccgcggagccaattcctcttcttcgtatctgaaaacggcaaggaggacaccgcctggtgtcctgaaacagaagcagcaagagcaaggcaacaaagccaacaaggcaggagtagaaggccttggcaacaagtatataagcagcgggtgcaaccatgtcacttgcagctacggccaacatcgtctctgcctctccggtgagccaactaattaataagcttcttcctccttcacgattgagtatttgagcttagctagctcactagatggcaatgctggatgcagctacacgtgcggcagcacaatgacgggaacgatgtacctgcacatctgcaaccagaaggcactgacgacccgtggtcagatctagttgtgtacctgccttcctggccagtgagcacgacggcgcccccttctctagctctgtccgctaggcgcccctcctcgagcctcggtgttagactcctgctaccgcgccgctgctcgctagcgtcgtcactcgcgggacttcgccgtggacacccatgacccactacctccctgccctcccattttctctcttgggctgtgaagaaaaaaatagagaagatagagctatcaaggaattttttttgaactttttaattttaaaaataaaccctttcaaaacttatttataagatatgaacctttcagccaagccagccagactggcgtggtaaaacaacattgtcatgccggtctagatggcgtggcagtgttatttggtcacgacggtacaaaactgtcacgcttgttgcgtgtggcatgtcagtgttgttttgccactctaagcgggctggcatggccaaaagattcagattttgaaaataatattttgaagggtttattttaaaattaaaaaataaaaatgttcaaaaaaataaaaaaaaatcgatgtcaagtgggccaactgtcatgtagattaaaaaaaaaattaatcgccgcgtctgatgccacataagatcaaatccaatttgtattgggatagggggttattggtccgatttgaagagttgagtgggtagaatttttggttttatagtttagaggtgtaaattgaaccgtcgcaataattcaacaaggtaattaattcggagtttttctcaacaaaatactactatctcaggggatctttcttcagctcctagacaattcaccatgctagagtaatgtcaaggggtttttatttccaaaagttgcacttagtatatagtacatacacgatctattctagcctccttgcaaggaaagtagcaagttgctcaagctctacacggcttggttacacaaggggagatgggtgtcgtgttcgatgagagcgacgaggaagtgtagggcgtcgcctggactccgcagttgtgtcggcctccttacatgagggcctccatgatgggcataaaatacttaacaaccctggttaatcgctaagaagaatgcacttgtctgagctcccgaagactacaatggcttgcttatttgccaagagctggatactaagcccgccgtttagcagccgaggttgtgagcatgcatgacagcatgactgcgttcgtcttcgctatgccatctcaaaaatcgttctcatccagcacaagttctgcatcctccaatatcaggcatcgtgttttccctgggtaatgcatgttcttcgtgtttatctctggtgaaattttttgcacgtttggcttgcagttttctcatagcattgtgcatgctttgctcattgtcattatctaggaatgccgcacgtgatgcccaccccccattttccatatgcaagaaaggagttcagcagttcatgtacaccgaagtgaagcaacgagcacaaaaattagactccccaaaatagaagcagaatggccctacaaaatctttgcccctcaacgcagacttcctcatcagctcacacaagcaactcgcatactcctcctccttcctttccatcacgcaaaggaactgcccatacacagttgccaaggttggagttcgtagccaaacgtcgaagccaacaacctactaacctagtacaagaacaccgacgagaaccgacttaacaatggggttcctccatcggaagacctccaagcagacgggcaagctcaagaccctcctagggctcgccatctcacgcatcgctgctgtgcgccggcctcgcctagctcgcaagtccattgccaccgatgacgttcgccagcttctcaccctcggccacctcgatcgcgccatccaccgggtaagtatctacgacctgttctgatgaagagaggttgctccaatgcaagccatgctaatgccagcaatgtcttgctctctcctcacaggcagaacaagtcataggggagggcaacatgttagaggcgttcgaaatgatagagatgtactacaagcgactcatcgagaatgctgcaaagctggacaagcctgggtacatacatttcatttcctcacaccagactttatcgcgtcctctatctcttttccggtcacatgacaattgtatttggtgtgtacagtgagtgcaccgaggagatacgtgaggcggcagcggcagtcatgcttgtcgccggttggtgcggcgaattgccggagttgccgttcgcgcgcaccatcctcgcggacaagtttggcagtgacttcgctgaggcggcaaaggacggcaccggcattgttgatccaatggtactagatagcatatattgtccagtcatttcacaagtcaattttgcagttgtaaagatggaagaatagagagctaacaaagttggatcttgcagttggtgtggaggttttctggcaattgaacagcatggagctgaagaagaaggtgaccaaagagatcgccatggagaacaacattgtagtggacttctctgaactccaagatgcggtcaaggatggagaagactgatgccatggggagcttgagcacaacacatcatgcaagaacagcttggacggaagatcatagtactcaagacgacgaccgtgtttctgtctctgattaatatcttattactggtcattgaaacttagggtggggaagcaacggtgctcacgagaagataaacttgctctgagaccatctcaaattgtaacaactaactatgattgtacatgtgaaaaagtgtaaattactaacaaatcaaacagtgcacacgcagatttcttgtggcagttgtacaatgcctcttttattttcccttcaaattgtgcaaacttttattcttgaaaaagagaaattggtccaaagtgacttagtgacttatcaagtttgcaccacagtatatattgaagatttaaacgatctctgaaaaatatctgtaggatgaacctctgaacttttttttttttgactaagaacctttgaactatctttgtagaaattttatatggtgctcgcctagttcccattaatggggggatgaaattgccctaatagtctaatttagctagaggttccgacttatcataagatgtttggtagtcaaactaaatgcggatttttttatgaattttcactggtggcaacctacaaaggcacaatagcataggactaaaagccacagaagaaggcgaagcaaatatttggagatgtgatgctacaagaataacatggtttctttcaatcaagggcaacccactattctgtactcatatctattgtaccaaggaagcatgatttttgcagtagtgcaattacttggtggcatacatgctgacaaaatactactatcttaggggatatttctttagccccttgacaattcaccgtgctaagaccaatttgctagagttatggtctaggggttttgatctccagaactcacgcttagtacatatgcaatctattctagcccctcacaagtaaagtatcaaggagttctacacaaccgcagcttgtttgggttttaaagttcaagatttgggaaaccatggggcatggcatgttgaacacaagagaccagaatcgtggaattgactaatttattgaactcaaagtaacatgtcattggaaattatccagcaaacataataccatttcagttttaatcgcaccaatttccctcgaacctatcacatgatgatataaacaatgcagaaagaaatccttagtaagaggagagcaagcaagggcacgaaacctctctcgtcgatcactgtagcttcatctccatgatgctcttggcctttggggcgtacagagagtacaccaccgcatgccgttttgccacatccagctgcttcttcccgtccgcgaacgccgtcgccaagggcacggttctcgcagaaggcatccgctgcacacggcagcgcgtgtactcgtggatgttgtagttggataactgccatgccatgcggaggaagggtcagagcctccgatctcgtcggtgttgccaccaccgccgctaccatggatgcgcttcctcgcggatgctttttgtacgctagagaacggagtagagaagagctctcctgaatccagaaagatgcttgggctaatgcctaatgggctaggcgcctaagcgcggagacgagctaaaacaatgcttttttgtcaatttaacacatccaccctcatggagaatcctattatgaattggacccttagagtgtctaatgtcaatgtgcatgtccattgtcaaagtgtcagtgccaaatcaaatcaagagtcattaatcagttcaaaatgccgttgtgatttgaccttttgtccgtagtaggtcagttcaaacgataatacttttctacacataagaaaatagtgaaaccatgaattggaagattatttactttgctccatataaagttaaatgatggacaacacagataaagataattaaaagttgtataaacacatatcaacatagatattataatcttccaaacacatatattattttttttgcttattaactacaacaaaaatttaaagtttgaaacttaaatttagaattgaaacttaaaccgaattacctctctaaactcaaaaaccagacatcgttcaccttaaactttcaat

SEQ ID NO: 49756 - DNA, 1207 bp, Oryza sativa
gccccagcgtgagagagatggaatgggttgagaagaggtatgacatgtgggccagggattttttttttttggctgattggattgcaacgttggcgtcacgtgtgcaaggtcaagtcaaaaccactcaaaacaatattcgggggcttatttgtccggtttcaaaagttgagggtgtagaatgtttggttttcgagtagaagggtgtaattcggtcgaccacgatagttcagggggtaaatcgtactttttttcctttttaatttgctaagaacatatatacaaagttttgtttttttacaccttatcagccataaagcaaacgacttaactgtggatcatcatggaacatgctttatataattgattattttatgcactcgataatacatgatctttaattcgatcaacgatttggaatagtaacatacatgatggagttcaaaaaaagtcaatacacatcgaatgaatgtgctaatattttaacttttttacatctttatctaaatcttagaagcaaccatactgcgatattttggccggccctgttttgtaactctccgcttttcgtgagacgttaaaaactaattcggcaaaatcctaattgcgaaaattttcgttctttgtgtgagagtctaagtcgtgccaggatctcaattcaatcccgttgttccctctcatcgaaatcaaaatcctccacctcgtaattcctccttcgactcaaatctccaaatcaaattccgaaattcaatcgcgtcctttgaatcctcggcagatactcgctcccaattccgaaaaatatcaaaccctaccttgagtcttccttgattcctccctgaaacctcgagttcgaatatcgaatttgaatccaaatacaaactccaattctctccaaatcagctttccctgcaaaagtctattttacctccctcgggtgttgtgggccgttttccccccttagctgtcacaccccgaagttttcctccctggtcaaaattgtaaattccaaatgaccccaagaaaatgcagaggaaatcaggagaaaaccctaagaaggtaatgcaaataataatcggaattgacatgtggaatttttcttgagttctacatgtcgaaattcattaacaggatttttagtggaattttcagagccctagaaataattttaaccaattaaaaatcactaaagtgcaattgttaattccaggga

SEQ ID NO: 49757 - DNA, 1529 bp, Oryza sativa
gcagcagagcaaggcaagtcatgcttgtcacttgaacatgttgatcctatattgcaaatgctctattgttttctttcaaatattgcattgtttataatatcactatgggatggatacctattgttacagccatgcttttggatatcatgctcctttgttagcttgggttataacatgattagattttggactaggacttgcttagccatgcttagttcaactagcacacattggggatctcatttaaaacctagactatagttttatttgataatgttggtttaataccaccgctctggtgttggttaattaaaatgaaccacatggtgggctgtgggtgcatggttttgctagtcgcacccatggcagttaaggaccggttcgcgggatgccctggaagaatttaccgtgcttaccacaagccagcgtgggcaacggctgggcttgtagtgtagctttcctctagccgacgcatccaggcaagggtgggcgtgatggagtttggatgggccctgcgacggcttatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgtagaacttggatagtttaggtggatggttgggcctgtcgcaacgtgggttagcgttggacagtggatgttaatactgcttaattattacaactgttttcgcattaaattcctgtttataaatgccagtatttatgcaaatgaaccactctagctctcctttgttaattccctgcatcatacccccattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgtttttccgctgcatttctgtaagactttataatgtttgtaagacgtggatctgtatgtcaacattgtcgtttgtgtaccccggctggtcctggacggggattttaatgcacattctgcttgggattccatccgggaatttctgggcgtgacattagcccacctccctctctcagccgtttctcctccctcagcctcgcacgtgcgttgcacgcgccgagccgaaccgagagagagctctctcgctctctcgttctttctctctcccatcttcgctctctctctctgctcactcccctcccggcgccgattcccgccgccgcctctgaatt

SEQ ID NO: 49758 - DNA, 1901 bp, Oryza sativa
gatccgagccgttggctcaacccctctcgtgctcccctttgtaccggtgaactccctctcgatcgaatcgctgcgtcgtgctccagtgaaaccccgccgtcggccaccgttggttggagctcctgttcttcttcctcctctctcccggcccgcgtggctgccacgtaggcgccacgtcggcgccacctcgacgcgaccgggtcaaagctgacctcggtcagccgcctccctccgtcccccaccctcgcgcgcggtccacggagagccaacatgctgcgcgtgggcccgccgcacaccgcgtccacccgcgggccgcgcgtggaccgcttcccccccgaaccctagcgccaccctcgcatgcgcccatcccaccgtgggccgtatcaccgacaagtgggccccaccgggaccccgcgcggtggaatcggtccaccgggccgtctctctctcccccgcgccccctctgttgggccgcctccccgtggccgcgcccggcccaatggctcggccgagcctccttcaaccctttgggccgcaccaatgccacccgagaaaagtccaaatcacatccctcatccctttaattttccaagggatttaataaatccttttcctttgtttcataaataaaattctttattccaaaattctatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttctagtaattccgtaaaattgagatctatttaatggcactattattcagtctaaatagggtctttttcttggtcttttgtttaggtttttgtttgtttgcgtatagttgcggttaccggattttcgccgatcgcgggttttctcgaagattcgtgaagctccgtgaagaccttgagcaaggcaagtcaccccttcaaccaattgctcctataattggaaaatcattattattttgtttgcaacttgcattattagaatcacacacttaacttgctgggcctcggtttgcgtgccaaaccgacggacctacccagtagtcgcactaattcctataggttgtactaccctgattccttgtcgctccactcttgtggtacctcggtatccgtgctctctgagcgcgtataccaaatatcccacatacaccgttgattgtcgaaaaattgggaaatgggtttgagaagccttgaaaacccgacatgtggtgtcggtgtgtttaaaaataaaatgaattgtgaaaactcacgatgcggaggtggtgcctgcgtggcgctgtcccgtattcgcatataaggaccgattcctgtgggaaactcatcaatcataacaaagtgcaaccacaaggtggaatggacaccctagctaagtaactagtcggttcagggaaacctcgcatgccaatagttggggaacgccggggcggggtcggttggagccaacccgggttcctggtaaggcaagaacgcgaagcttgccagattaccgatcgaggtggttggagtttgatttgtgaaaactgatctggcctatatttatgtgaaggatttgatccttctatgtggcatgaggtaaccctgggtcggcttgggaaaggctttgttgcgaacctccgataccgacaggtgttcggaataagttcgtatcttgtgggtaaagtgtacccctctgcagaggttaactaactgttcgaacagccatgcccacggtcatgggcggttgtgaggtggttcccgttgcgtagatttgtttgcttgtgctttgtgaaaagttgttgtgtgggaatcgtaaccagaatcagcctatgt

SEQ ID NO: 49759 - DNA, 1863 bp, Oryza sativa
ctgcagcccaatgatctgacccgggaggtcggtacattatcaattgaggtgctgaaatttgagacgcacgtctcttttcgacccgaacttaaaaagaaataaatcacttagtgatttcaaaatgatttcaaacaaaagatttaccaaaacaaccttgcctctcttccaaacttgcatgaaacacctaattcccgtgacttgctgagtacgaaagtactcacccttgctctatatatgtatatatagatactctgtcgcgaagtgaagatgaagtgaagtgaagattagggtttcgtcctggttcccatccgtcgcctgtggtgttgggtgttagaccgttggttccgctgctgctgctattgttggtgtttgcctcgtccgtgtcgtcggttgcattctcgggctgtctgagctgcaacctaagttaaggtaaataagtcctctatttattttaaggattgcaatgattcatatttgtcaccgtgggtaccagcgctatgtcctgggactggtattgagatcgcggtttcgtaggaagcggttcgcgccgtttttcctacgacacgctcctgtcaggtgccgttgtacggcagtgccggatcggggtgtgacatatttagatcgtctggtaaaattttacacgctatcacatcgaacgtttggacacatgcatgaagtatttaatacagacgaaaaaaataactaattacacagattgcgtgtaaattacgagacaaatcttttatgcgtaattgcgccatgatttgacaatgtgttgctacagtaaacatttactaatgttgggttaattaggcttaataaattcgtctcgcagtttacagacggattatataatttgttttgttattagactacgtttaatacttcaaatgtgtttccgtatatccgatgtgacacgccaaaactttacacccatgtatctaaacacaacctttatcccgtcgatagcgaggcgtctgtgatgacttcgtcaatctctaggatttgccgacccagtcttcgaagatgctcataggggtagggtttgcgtgcgtgtgttcacaggggtgagtgtgcgtgcgttgtgggtgtcttgtgttgtactgcgtaattcttaaaaaaaaatgaaacttttaaaagttttatgtcagcgggtttatttccaaattcataaagaactagtactcaaaatgttttgagatgaattatggggcaatggggcttctgaagaaaatctttattattaggggggttacactaggctgtgtttagttcctttaaaagttaaaagtttgatttgaaattggtacaatgtgactgaaaagttatgtgtatatgacaggttgatgtgatggaaaaagttggaagtttggatccaaagtttgatctaaacacagcctagcaaaagtgcagaactccaccgttttttcggtgccaaataaaaaaaaaaacccaccgtcttcccgtcttccgcttcctgggcggcgcaccgcggttctttggcgcgtggggaacaacgatgagctcagtctcggacccccaggcgaacggcgaccaccggccgccggcggcggagatggaggacactggggtgaaagtcgaggaggcggatgcgggtgagacgatggaaggcgtcgcgtccatcgcgctactgccgtccggcgccatctccggccacttcatccgcctcccggactccgtctgctacggtctccacggcacacgtatccatctctcttcgttgcctattcctgcacttgctggtgcctgatcatggggggctggctcttactgcatatttatagcctgaatcgtctgcggtctcacccaaaaacccttttgctctcaccaaaaccctctctt

SEQ ID NO: 49760 - DNA, 968 bp, Oryza sativa
acttaaatttctggtaatggaatcgggggaggggtctcctcccttgctcaaaagaaaagaaggcatagtgagataagacgtgctaaatcgtattagacaatgccctttactagcgtgtcattcaaaagaaaatgtgtataaaattgtacgacctgttattatctaggaaattggggtttgttttgtgctttatgaaaaaaaatcatgattaactgctggtgccttatcgacatgtaatggaagcttgagtgatacacagtaagataatatgttctgaggtagataatatgttctatctagtataagagaatcaaagtgggtggaattgtgcaccatctgtatctgctagatagaaaaaaaaatttaacttacattattctttcccttttcttgtctgtcatgtaagcgatatcttgtgagagggagtgcagtcgaggagaagattaccgcctgataaagctttccataattgattttaaggtgagaaattctaacttgtccaccatcaagcacctactatttttgtgctatatatttccttggagttggatctataagaagtatctttgctcataagagttaaatatcctcatgaaactgcgatgctcatttgacagaacaagcgagagaaggtggctgtggtggaatgcaggggccatgatgctgctcggttgcaaaacattgaccatttgcatgggtaactactttttgtcatggatggatttcattagaactaatgcagaatttactatctatcaacaatttctcaaataagaggattgtactgagatactgtgaatactcattttctgaggctctgtaggcacataattggattacaatgaacaccaaagcaacatactatagtagcatacttcgaataaaaccgagaaaaggataaatggctcattgtaccaattattagtgctatcttgtgtgtctttgttctctgtttttcattaaaattt

SEQ ID NO: 49761 - DNA, 2062 bp, Oryza sativa
  unsure (1)..(2062): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaggcagccagcaacgttgccgttgaaggtccatccaccttcttcaatgaagaatcttcccattctgttgatgatgatgatgatgatgatgatggtgatgagggtgacaccgaggcagctgctgaggatgctcccactgatgttgatgagggtgacaccgctgctcagtccgatgagtctcatctctccggcgatacagagattgttccctctgatggagatgagtgatcatcttcttctcttcatagtttctcgcctttttggtgccttgatgccaaagggggagaaattgtgaattgaagggggtcatttaaatccttatcctttttgctgccttgactgttgtctggtcatttgaccggaagttccgggtcctatgatctggaggttccggccaggcagatttcctctctattatctctctctatatggacatgtaatcgtattctattttggttgatgtntgtctgttagatgctttattatcctttatgtcagtaagttagaccatatggatgttgcattttgatgtgatgttgtgttcttttcatcttttttgagtgattgccatgtcatctagtctttctttttgcatcactcatcattcaagcactttcatctacatctcttatttgatgagggcagtgtgaagtttcttttgagctttccttcatcttatgcataatgttttcatttcaagttctttatatgcatatctttagggggagcttcacacttctctcatcattcaaaatttaaattctattatctttttgtgtgctttaaccatgttgtcatcaatcaccaaaaagggggagattgaagatgcacttaaaccccctagtgggttttggtgattaatgacaaggtggttaaagaggactaacatgtttatcaagtttattcataggagtttagtcccaaagcgagttgtgatggctaagaatgcaaggagaccccccaatttgaatgttcctaagtgcaaaaaacaccgaaggtgattagactaggtttttcactttcgaaattgagtttagaaaaaaaaccgtactattaagaggggtttcaagtgtggttctagggtatacaaagtgagtcaaaatatttttggaatcatttttgaaaaatgattttctcctcgggacagagagggctacccggaggttctggccggaacttccgggtgccgtttatttgcaaaaagtttcctaagtactgcccggaagttcctggcacttttgcccggaacctcctggcaggtttccagttcaaacttgtgagtaacggctagatgacgtcacctagtcgttatatatatggatttcgtccctaggtcaccctttggccattccacttctgttcattcttgttctagggttttctagccactcccaagcttcctttacttcctccactcaaatctagagcctatcttgtgagattgagagattagatgagagagtaggagtgttttggggatggctttaagattaggtttgattgagcactttggataccttgtgggttgtcacttgggcttattactcttggagatcttctcctagacggttaggtgtcgcccgtgagcttctaaagatcttgtggatgtcccgggaaagtttgtgaaagttttcctcacctccgcaaggaaacaaggtaagtgagtaaagattcttgtgctgagttttcagaggtcctaggtagagcaacttgcacttgtggtcttttctagaagaaattttgagttggatcttggtggtcactcaattctagaaaatgacctagaagtgttgagttgaaggctgtggacctcttctgggatctttgcataagtgaggcaaggggttaattgagacccggctctttggagcacctcaacggagagtaggattcatgtgatccgaacttcgggaaaaaatcgtctttgtctctcttg

SEQ ID NO: 49762 - DNA, 1141 bp, Oryza sativa
tttgtcagcttggctaatgcagatggtgccccggaatcctgaaatataatagcaaagcacatacttttagcataaacttcaatccacccaagtggcactaacaaccacatttctatagaaggacgcgaaaaaggaggttcatgttggccaaagaaacataccatctggccgactagctagaactgatatcagttaaggagtcagtgagatttacctctgttctagatccaagcctgcctaatagtggattatttgagtattgtttctgtgcaaggttccactttgatgccaatggatcttggccatccttgacaatctcacccttagaaatcaacattctttgagcctgaaatgtgatatgaaaataacttaagctgtgttcaggagtattagttggcaacttcttcccctcgcacgcaaaacgaagcgactcattaacgtatgtttaattaagtattagctaaataaacttgaaaaaaatatcgatatgatttttttaaagcaactttctaatgtagaacattttataaaaaaaaatacaccatctagcagtttgggaagcgtgtgcacagaaaacgatggagtagaagttgggaagaggatgtatagaacacacccttaatgatagaattgagaccattaataacttaaaacacacccagaactgattgcatgctcattgttaacttcgttgagctggatctttgctacgtaatctcgttttattcccttggttgtctacagaaatgaaatatgagagattgtgatgtaacaaagatatttagtttttttcctgcacatttgctactgggcacctcagacactttaggtctttatgcatattcaggcagacataactaatgtgactatcttggttacacagtttcaaaaacatctgttatgatttccatttccaaatgttgggattatcatagagcactcagagacatgcacatgcaatagtaatcccagactaaagagtgtttggctctcatagtcttaccatgtgtgtagccgataccatgtcagatatagaattgggcccaacatttgatgatgtggtactctgttcacctctggagaaagatagtccacaagtaccctttcacattactcaacgttctaattgaacaacaaaaaa

SEQ ID NO: 49763 - DNA, 1701 bp, Oryza sativa
ttatcctaaaatataagtattccgagatgattttgtgcgaattaagaaattaagtgaaattagatgacttaaagttgtgattagttaagaagagaggcagataaattaaatataatatgattgtgattggttgagataaaaagttaggtaaagaaaaatagctatattttaggacgaatttaaacactatagatagatatgtacattttaggacaacaagagaatttactgaatacttttttttggctatatatggttatgccgagaaaatggataggtatggctcgaagcctgtttctgtgtccacaatatgtccagaaaaattatagtatagcctcataaaaaggatcaagcaattgtagctttgtgaaaattctagtaagcattagtgttcagtagcattctgcttttctctctctctctttttctctctctcttttttttacctagaagcattctgcttttctcttaaaggcatgtcttttttttttttaagaattacacagtacaacacacgcacactcactcctatgaacacacgcaaaccctacctctattttttttaagaattacacagtacaacacacgcacactcactcctataaacacacgcaaatcctacctctatgagcatcttcacactcacccctataaacgcacacacgcaaaccttacccttataagcatctttgaagactaggccagccaattcattctggagattgatgaagttaccacagacactgctttatttttagaattacatagtacaacgcacgcacactcaccccgatgaatgcagacaagccctaagtacaacacacgcacactcactcctatgaacacacgcaaaccctacctctatgagcatcttcacactcacccctataaacgcacacacgcaaaccttacccttataagcatatttgaagactgagccagccaattcatcctagagattgatgaagtcaccacagacactgctttatttcgcacgcacactcacccctatgaacgcacacaagccctacccctttgagcatcttcgaagactgggccgcctcgctgtcgaggggtatgtcgcctaccaccgaaagcacaaagccgttaaatactggaaaattcgctcccatggagagttgaacctaggacctaaggtgctactgaggatcttgtaaccactaggctacatgccctttcgcttgaggcaggtttttttctctatctctactattataaaaattgaaaatatttttgctaagattttggtacacaatccgagtccatttgcaatacgctttttgcggtttgtccgcttccatgtgatcctctgcagtccatcatccttacgagcccgtcatatgctttaggccgagtttagatccaaagtttttcttcaaacttttaacttttctatcacattaaaactttcctacatacacaaacttctaacttttctatcacatcgttttaattttaactaaacttctaattttagtgtgaattaaacacacccttactcgatgttgtttgcctggctatatgttcccgaatcgttttcttatggggcatttgcaaatttgccaccggttttttgaatattgcaaggataccactcgaatgacagttctagtggcatttttgcaattttctagtggcagttttgcaataatgattcaaagtagtggtaaatttgcaatt

SEQ ID NO: 49764 - DNA, 3723 bp, Oryza sativa
gatatacacagcgcatagctaaaataaatagttggttagtagatcaaatatgtctaattacagcattagtagcggattgacagtagcataacacagctaacaaattgtgcttccaaggaaagaaactgtacaattgtttcagttttcctgagctccagcagtttaattagccggctggccggggtcattaattaagcttttgctgctggggtcattagttataaaatactgaacaattcacttgattcatcgaatgccatcgggtcatctgaccccgatgatagtacagctccgcccctagccgccgagaagaagcgcacgcgcgccaccccgggggccggtgcagctacggctacgcgaccatcgtcgattaagcacccctaggcggtgggctctctgcttcaccgcgccaccacacgtctacgccgaccaccaccaccgtctcacgttctcgaacgttcccggagcaaaagttggtaagcgtgatcgttcgcacttactcagaagtactatggatgttagtaattgtttggaggtcgatcaacctgcacatctgtcgttttagaatttcaaaaagttattttagatatactggcagcacagtacgaacgtacgtaacatagcaaaatagaataataggattcatttgaaaataataagagaatattgatctctattaaaaagtcccagtatatacatgatgcataaaaggacccttatatatataagagtttaattgttaattttcttcatcatgccggacaaatagtaatggagacatgacactcaacgtcggtcataaaatccttatgtttatatctcttctctatcgctatttattataaaaattaaaaatgtttttgtcaagattttgggattttgatgcgttatccgtatttgagttgatttttaagttcgttcgcttttagaaattcagatccgtgtttgagttggaatttaagcttattttcttttggaagtataaaaggattcgtataagaaatcttttggaaaaaaaattcgcatgctaacttgaattgaaatacaaactactaattgcaactcatgattttcttaagaaaaaatccaagtctattccgacagtgaattttactctagctaaaccgtataataacaataaaattaaaatagtatttacccgttgcaacgtacggacattttttagtaaaaaaataaaattccactctctttgtgattagttggaatatttgggttgctgagtcagatttaaaaacacctgttatgttacatgaaatgtatttttaaatatgtcctaaacttgaaaagatgcatacaacttttgatcaaacagtaatccacagacaaccaacatcccggtccagggcttaatatgattaatagaatactcgtatcaacaagttgcaatttcttttccggaagccaatctctaaagaactccgaggttaagtgtgcttggcctgaagcaatttagggatgggtgaccaacccggaagtgcatgcacacgagtgaggacaaagtgtgcagaaaagatttgtgttggtctgtgagggcaccaggactgggtgcacacgagggagcaatttagggactgtgagggcaccgaccgagaagtcccgggtgcacacgtctatgacctacgaaagctactagatgtaagtgagtccggcccctgagagggcagtatatgacctacgaaagcctgtgagggcaccgggaagtcccgggtgcacacgagggagcaatttagggatgggtgaccgaccgggaagtcctgggtgcacacgtctatgacctacgaaagctaccagatgtaagtgagccgaccgggaagtcccgggtgcacacgtctatgacctacgaaagctaccatgtctatgacctacgaaagcacacgagggagcaatttagggatgggtgacagaccgggaagtcccgggtgcacacgtctatgacctacgaaagctaccagatgtacgagggagcaatttagggatgggtgaccgaccgggaagtcccgggtgcacacgtctatgacctacgaaagctaccagatgtaagtgagcccggcctgagaggacagtgtatgacctacgaaagctaccagatgtaagtgagcccggcctgggagaggcgggccgttacaaagtggtatcagaaaaggtctatgacctacgaaagctaccagatgtaagtgagcccggcctgtgagaggcgggccgttacaaagtggtatcaggtcgttacaaagtggtatcagaaaagacttgtgttggtctggtctatgatctacgaaagctaccagatgtaagtgagctcagcctgggagaggcggaccgttgtaggtgggctccacatgtcagtgactgtttgctcctgcgacgacgaatctgtgccgaccttgtttcaccgcctccgcctccgattcgacctccgcggccgccatgaaattggagcttccgggaggaggaaatctcgagaagtagagagagaagaccacagcgtgggcgagcgcgtcggcgtcattgattccggcgacatgaagcccccgccgcggccgcggccggcaacagggctggtggggtggatccgtcgataccgcggttcaagtgccaggagtgccaccgcgcgctcgtcgtcgtcggcgtggactccttcgccgccgataagctcccggctcaggccacctctgggcatgtatcctctgttcatggaagtattatgggagctagcaggatggataattcttatgtcgtgctatccaagcaaaacaaatctcatggccatggaattcccccacgcccaccgagtgcagcagccccacatatcgaacctaaccagccaacaagagcgatggagggttcatatatagtgcttccacctgctgctgcttccatatacaagacatctacttctgaaggaggtggtgcgcagttgccaccaccaagtatcaattccagcagtttgttaacaggaaatagttttcactctaacgtgactgtattaaaacgggcatttgagattgctacgtcacaaactcaggttgagcagccaatgtgtctgggctgtatgaggttgctctctgataagatggataaggagattgaagatgttaatgctgacattaaagctcatgaagtttgtcttcaacatttggagcaggaatcctacaatgtcctcagcgatgctggttttcaggaggagaaactgaagattgaagaagaagaaaagaagcttaacgctgctattgaagaagctgaaaagcaatattcagaaattagttctgagatgaaggatcttgaaataaaatctaaagaatttgaagaattggaagaaaggtattggcatgaattcaatagctttcagtttcagttgacatctcaccaggaagaaagagaagcaattttggcaaaaatagaagtttcacaggttcatctggaattgctgaagcgaagaaatgttctcaatgatgcattctatatttcacatgatggagtaattggaacaataaacaacttccgactcggacgccttcctaatgtacaggttgaatgggatgagataaatgctgcttggggtcaggctgctcttcttttgcataccatggctcagtacttcaccccaaaatttgaggtccggattaagattcatcctatgggtagctacgcaagagtcacagatatccacaaaaatacatatgaactttatatcatgctaaccag

SEQ ID NO: 49765 - DNA, 1101 bp, Oryza sativa
ttttgctgagttcgctattagcttggataaaaagaacaatgtaccacctgagaagtcattaaagctcccatacaagattgatggtgacaaggtagggagccacacaatcttcttaagttttaataaagtggagaactggacgaaagcactaaaatacacgttgtgcaacttgaagtgggtcctctactgatttatcggcaatacgagtttcgcaccaccccctggatctttgtgtgcagcgcaatcatctaagagaaatttagggtttcgagtttagctcaagattttggtgaggagtgttgctggtgcactttgtaaacactagttgatgcaataaaatcaaaaagtttcaatctacatcttcaagtttgtcatctaccggtgtttatgggtccagacggtctaaccgcaggtctacgcacggtttgaccggtgggatagcggcggtaggtgttcgggtggtctaaccggcgaggctttggtggtctgaccgacggcaggaaggcggttcgaccggcggcgacaggacttcatcatctactccgtttgagggtagtttttatttccactaaaagtttctattttgggtttttggttaattctaccattcaccccctgatcttatgcgatcctacaagtaatataattgtatatacatgtgtttataattttcattttctatatgcaatcttaccgttcttccattttggaaacatttttttgaccgtgaggctcacttcactatataggtgagctgtaattttagccgtgaaggtccacttaaatacttgtggatgtgttctgatggtcggtcgtctgcaaagattcattattgtagacgaccaacttaaatagatagcctatcataaatcataattgatatatttttgctgacgaccggtttaagactccacgtacaaacaccaccatcaccggcttcttttagttgaaatcatggtttagtcgaaaacagtatcaatttacctctgaccaacatgtcaaattgctatatagatgtgctgcttgtttactcccatgtgttatgctttcatcatagtattatactacttccattaacgggtattagcaagacttaattac

SEQ ID NO: 49766 - DNA, 2153 bp, Oryza sativa
cttatgacagggtccgactcaacttctatcctatccttattacaattccaagttctaatttgtaattgattgcatattcatactaaacacaaactctatcttatcttttagaaagaataaaagaaatgtttctcatatgaacccactcataatatatactccctccatccaaaatgaatatttcgttggttttgtcaagataagttaattactcttggtcttggcaattaaaaaaaaatagatcttaaacttttggatgaaaagagtactactttaaataatgctaatggtggtatccaagtctgtctcaaacaccataaactggtatatatgtggggctataaggtatccacacgtgaataaccatgtaattgttattcaaccgtatgctttaatttagcccttctgaaaataggcccgtagaataaaaacatatgatctagcagcatatttcagtacggctgcattaaaagatggcattatatgcctaatcaactaactatactataaacttattgtttttgcttttgttgttatcttttataatatatgttgcaacgcacggcctttagcaagtttcctaaatgaatttacgtgtcacccgtattattgatggcatttcatcatgcgttgcacaagtagcagcataagtcggttgcaacctgtactgcagctatcggcctattcgcatttgttgaccaagtgggcatgcaaaatttcgcgttgctttctgggtgttttacagcgcggctccgtgtaccgcgcgaggaaagaaaaggtgggtgtgttccacttggtctgcaagggaggcagccgattggcagccaaaaggcgccacatgcgaccacagctgcacccacacacccaccttgctctttctcgcaagtgctggatcctctacaaccaccaccagaatgtgcagcaaccccagggtcaaacggcaatgtcaaaggctatgtgaactagaactacacgtcctgagatatttgatgacctcatgtgggattaatcttcgactgtttgttcgcggtaattgagagagtaaaggccatttgacgcagcttgtagtagaaaggaatgtataaaaatgttcatgtttttctcacttactctttccctccacgagattacggtagagaaacaacatgtttttaaaagattacgatagagaaacaacacggtttaaaagaaaaaatgaaaaaaaaaacttaaaaagaaaacgtgaccacaggtccacaactcagtcacgtatacgagtcgctgacagacttatcacgtgggggcattttacacgttggcttgggcgcgcccaccgtactgtagtcggcatttggcgagtggataaaccctatggacggccacatggttccatgtgtccaccaaatccaagagacggtggactttgggaggaggatatgtgggtcgcgcgcgtccttccttcctcgcccctcgcgggctcgccttgccgtgcgcgtctcgcgcgagcgaatcagccgcctccacttggcttagctagctagtccagtactcgtgcccccactccggcccaacgccaccgcaacacctgtcccaccctccccgcctataaatccccggcgccggccgcgtcccccggacaacgccgcatcattgtgtccggctccggctcccgggacacgacacagcgcacgcccagagcgcgctactacttgctttcgagagggttgcgtgcggctttgcatgaggaggaggaggatgggggcactgcacgtcggcgagccgcgggtcagcttccagcagcagcagcagcagcaggtcggcaagaacgggcagcaagggcatggccatggcgccgtggtggaggagatacacgggctcatcaaggtttacagggacgggttcgtggagcgcatcccggcgatccccgacgtgccgtgcacgtggggcacgacggcgtcggtgccgggcgtcgtcatcgcgcgcgacgctgtggtcgaccgtgccacgagggtgtgggcgcggctgtacgcgcctgcggcggcggcggcggcggggagggtgcccgtggtggtgtacttccacggcggcgggttctgcgtcggctccgcggcgtggagctgctaccacgagttcctcgccaagctggccgcgcgggcggggtgcgccgtgatgtc

SEQ ID NO: 49767 - DNA, 4183 bp, Oryza sativa
ggcacggcaagctcggcgccctgaccccgctcgacgtcaagggcgccatcctgatccagcccttctttggcggcgagacccgcaccgcctccgagaagacgatgccccagccaccaggctcggcgctgacgctctcgacctcggacacctactggcgcatgtcgctccccgccggcgccacacgcgaccacccgtggtgcaaccccgtcaccgggcgtggcgcgccgcggctcgactccctgccgctcccggacttcctcgtgtgcatctccgagcaggacatcctccgcgaccgcaacctggagctctgcagcgcgctgcgcagggccgaccatagcgtggagcaggccacgtacggcggcgtcgggcacgcgttccaggtgctcaacaactaccacctctcgcagccgcggacgcaggagatgctcgcccacatcaaggctttcgtcagagccagatagccccagccagtggctaagcttagctgacactcgccgtgtcacgctaattaatccatcctaatccatccaaccatccaaccagtttctgctgcagcagatgatgagtaggtgtcgtgtaagctgtaaattaattacttttgtagtacgtgtcactcaagacaagcgttgtccatcccaatacccaacttggatcgtcgtagcggtgtcggaaagcaaaagcgtagcacataaaaacgacactgccgctatgccacgatgttgttgctccgtgtatcattcatgttcatcaatatacttaaaaagcaagttgtggatactgttttcaaatcgggttgccgtcctcgacgacactgatggtgttgcatcaaggaaaccggaaaagtttccaagagcaaataattgtctgattgtctgctgctttctgggctttgcatcaggcatcatcaagtgaatagaagaactgatagtcgtagtagtatcctctatctcagaatatagcaacctaaaatcagatggaacgtattctaatactataaatctcgttttgtccgattctaaatttctataatctggaacggaggtaataatattttttcctctcttttccccgctttgggaaggttcaggctagatggagcccagcgaatttggcccggcaattccttctctaacaagcacgaatcatcatcgccatcatcgtccatcggctacgattagcgtcaggtcattagggcagaccggcagaatggaatctttggtctcttcccaatgcaatgctgctgctagctcccatggccatgattgagagatgccttgtgcactgaagccaccacatgattcgctcaatgctgcagcaaagtcgcaaaaagctctagtgctgctgctacaagtgcatcagacaaactgttcgatcgttggatgcatcatcagctcgttcctgctgttagagtttgtgtcgaatatacagctcgctgcgctcgtgctcaaggttttacctccagtacaacattctctgcggcttgtaagattggatcgcacgcagaattccgcattcttatcattagctcaccaaccccatcatagctgcagctgaatgcgtgcaagcaggccaacatcatgtgtgatcatgccggtttctgataaccacggtagtagtaaatggctaggattagttagttgcttctactgacacaccaatgagaccatggttggttgcagaagtaatactatcttattttttcttttccttcgccggggtggcgtgaagagccagccgagatttattaagagaactatcttattttttcttatattttaggacttcgatcagactcttgtttgatttagtcagaatgaaaaacgtcaaatgcattcaggattagtacgtaactagggacctgaaaatgcgtactcctaagttgtttcaaaaagcaagtatgaaactgtaagatgtgaagggtaaccaactattagtctgaaagtggatttggtagaaacttcagagactgtcctctaaccgacaaatgccattgctcatggtagactgttctctaaccaacaaaatgcagaattttcttctcatgtttgacaagaaaaatgaatcgacaagtagcttagagcgcctctctatcaaactttcttccgaagtggcactaaaagctcgcggcatttccttcagaatctgccgcggaacgcctttacaacagtagccgcggcattgcggttttcggcagatcaaaatcagcatggcaccgatgtgatcatgatccgatatggcggatattagagatcgacatgtaccctacccgagaatctcaatctatccccgtagatctcttgagaatccctgacttcatcctctcttttgccaagcttctcagcacattcagagcaccgccggccgtttcgtctcccacttgtttctctcacaagatatcacgatcaaaccaccgcgaaaaaaattaaaactttattcctgaataacgatattctcaaaatctttagctgatgtaaccacacgggccttgcaagtctgcatgatgcattgacctcatgcttgcccgcgcgtgcgtgagggagatgtttgccccaatatgtcaaaccgacctgcaagcgatgtcaaactgagatgccgcggtgcaatttatccgttgtttcttttgtaaaaaggcagccgtggtattcgataaattgccaatctgatctttgcgctcctgattcatgcatgagttgcgctgaacgaatataaagattttgctttggtacttcgtactgcacatgtgtttgaagatgcatgcaccgatcagtgcagcctgttctggaagaatccgaatagctaaagagcaagagcatggaagatgtcaaataagcagctgattctgagttgtgaaatgtgtgtagcattgaaacatttttttttttggaaaagagcagcattgaaacatatgtaactcatttatataacacaaggacgtaaagcttgtagaggtcggggatgtaatcatcttccttataaagaaaataacatatggctgtcattatctgttaattttagctaacagcgcattaacactgacataacaatggtcttaacactaacataacaatgctacactggtgagaatctggtaataggaatgatcatggatatctatctatggagatatgcacacttaaaagtggtagaaacaatcaagcacgccgtgcaatagcagtatggaatcattcataagaaaacgactgatctagactctagagcacatgagacttacatggtcaaaaaccacaggaagatatactggatagccaagaacaacgtgttggtaagctagagagacagtgccgctagaaagatggaagacaacgaaaagtcggtgcatcgtccagaattcgttccaaatggtataagatgcatcatgatgaagctgcaaagcgaggcacgggcaaaagcggctggagatgcaactcgagaggaatctcgcatttgccggatgctaacttgacagggaagcatcaggcgctctccttttagcttggaggcgcccgagcgagtggctgactaaaccagatagatgcctcctttgactatggctggaatgacaatgtccatgtcctctgctacggacggatggatggatagattgcaattgcattatggcacacaagtaggagcttcgctttttggaggtcactgattgagaggaacaatccttattccaaagaactagcttgcttgcattgcattggatattccagggttctttttcttactgttctggtgtgcatatatatcttcttcagaccttcagggacgtactgtagtgtagtttgtgcggtgaaaagtctgaaatatcaagagcttttcatgcactgcaagtggcatttgactgcagttttcactatatctcagtcatatcctgccaagaaaggaagctatcctgagtgggaggtcatagagactcctctggtttttgtggaggttgtgtgaaaattctagtaagctatgaatgtaaggaaacaaacactttcaggtggggaatatgtggacacgatgatcacacttacgaagcactagacgacttttaaggtcccattttcccagtgctatgctgcaatgtccaacttgagcaaggaaactggtttctgaaatggtacagcactagttcgtagtgataatgcagcatttctaagagtacaaaaacatttgggaatggctgagtccc

SEQ ID NO: 49768 - DNA, 2296 bp, Oryza sativa
gtgacttgatggtgaattctcgaggtctgggatgaagtaaatgactagtatgatgtcatttgtgtggtcagcatttaggcaaggtaatgcgatttggttaaaccatactgtattgtacgcttaattactaaggggaactaaagtcatctattatattattaacacagccttgaaaagaggcaccacattcgttgtgggagctagaaattcccacattaatcggagaaaaagaaaaagaaaaaggaaagaaaaatgagagtccaagtagaagtacaatttaaaaatagttgaaattcggaattaaaaataaacaatattaaaagaagtttccatataagaacccaatacgagattaatcaaaattcgaaataaaaataaaataaaatccaaaattagaaaaggaaaggagagtccaagtagaaatacaatttaaaaatagctgaaattcggaattaaaataaggaatattaaaataagtttcaatataagaacccaatacgagattaataaaaaatcgaaataaaaataaaataaaatccaaaattagaaaaggaaatgagagtccaagtaggaatacaatttaaaaatatctgaaattcggaattaaaaataagaaatattaaaagaataatccatatcagaacccaatacgagattaattaaaattcggaataaaaataaataaatctgaaattagcaaaagaaaataaaagaagagttcaagaaagaatacaatttaaaattagcaaaaattcggaattaaaaataagcaatattgaaagaacaattgtcacgccccgaactagccccgaacagaactagcccgtgacgctccaaattaacctgttaaccgataccagtcccaggaaacagtgctggtatcacaggaagacagattatcacagcaacataggtctctttattacagagtaggagtacagtcatgttgagctgcggacagatctcgagctcacaactgcattacaaaagggaacaacggaagccaagacttggaccaatcatcacaggcacgacttgggaactagaccgaaaccctaaaactcatcatagccgacttgctcctggaagaactcctcatcagcggcatccacttcatcttcttcagcaactgggggggagtattatttatatagagcaagggtgagtacaggagtactcagcaagccatgggaattaagtgtttaatgtaggtttcaaaggaaaggctgttgttttttcaattgattttatttaaacttctttttggaacatctaagtgagtgcttctcaaacgacacggataagacagtgcgtctcgtccggtcggagtatgtgtaatgtatcagtctttgaattgatcaaggttggcacccggccaacagctttcaaatggccacccgggcctagctgatcccatcagccacattttccaaacatcgatcccattccacaacagcaatttcacaaagtagtagtcaaacaaaactacgctaggaatcacctcacatctgcccatgaccgtgggcacggctgttcgaacagtttaataacctctgcagagggggtacactttacccacacgacattactaacccggatcacccagcctgtgcagaacggccacgtctggagaccttgaggctttcatgacaaggcatttcgaaagccgacacaggttcaccatatgccaacgagaggggtcccagaccaacaccaggataggtcccagaccatactgtgtcaggaaacccgggggttctccccggcaccaccccgttgaattcacatgtctcttagcatcatggctcccccgattagctaattactcagccaggggcatcccattacacccatgtggtcgcacttgtcttatgttcggatgaaattccaaggaaacggtccttagtgcaagagcgggaaaccgtactcccggtacgtccctcggtctgcgattttggaaattcatttagttcgcaagcaccgatccaggtgtcgggtttttccaagtcttttgtaaaacctcaagttttacccatcgttggatgttttaaatttgaggggaggtgttccgatgcccgtgcccgaaggcccatgcatcgaaacacaacagtcgacaaaggagttttaggtattcaataattcacggagggtaattgcaacaatttagggtttggggccggcaggctatctcgcaagccgcggccgaattacgtgtgttaaacctattcatgcaatatttgcggaaaagaaatacttaggtttaaattataggtgcgagatgttcaaaggtgacttg

SEQ ID NO: 49769 - DNA, 2412 bp, Oryza sativa
ttctcaacaatttttgcagtgttccaactagtagtagatgatgctgtgatagaattgtgagtgagaatcattaattgtgctccagttgataacttgatatactagtacgtaccatctatctccagatgaagcaaatcacaaagacacaacctgatcaagcataattgagatggaaaccaaacaaggtagcgcctatagaaactttcgctggttttttggtggaaacactttcaaatgaaatagcaacatttgctgaatcacagctgatcacatccatcaagactgtaaacttcactgaagaaaaccatataaacagcaacaaattcttgatctcgggttgcttcaccaccacatcacagctttggcttttcttgggagggagggaaaaaaaattattttcttgaatgggtcaagtaaccatttccaactttccttggactctagcctacttcagtaaccttttcaacttttggggatatattcccgttgtggttggttccccgggccttccggtccacttctattcgccatttcggtggtacaacccttccaccatattatctgtggccttgtgattggatccaggtggcggggttcgccttttccgcccctataaaacgctcctcgcgttccccctgtctccccacagcgatctcttcgaacgaacacacagggtagcgctcgcgtagtcgcgtactccccggcatgctcctcacacagacgcgatggcccagggaagaggcagtgcagcgcaggggctcgccctcggcttgctcctcgtgtgcctcctcgtcggctcagacgtcgccgccgccgccacctacaacgtcgactggtcgttcggcgcggacagctggtccaagggcaagaacttccgcgccggtgacgtccttggtgagtgatcgatcaaaaaaaccgtttcgttacttgattctactactatggcgcgcggcggcgtgctgcatgctgctgcttgggctaacttgtgtactgtgccgcgcagtgttcagctacgacccgtccgtgcacaacgtggtggcggtggacgccggcggctacagcggctgccgggagtccggcaccaagtacagctccgggaacgaccgcatcacgctcggccgcggcacgagctacttcatctgcagcttctccggccactgtggcgcagggatgaagatggccgtcaccgccagctgaagaggaagccaacgcagcacaaaagcagggccaggctgctgccgctctagcctgtagctatacatatttacatgtgtcgcccgaacagcaataataagaggcagcagccagcaccgcgtcatcgtgcaggttttgttgtcatagtgcgtcgcaaacaatatatacagccatatatgtgtgttatgtagggagagtggtaggtgaggcatgagtgatgtgtgcttgtatgtattatcagaagtcaggagttgattactagtaaagcacatcagcttgtttgtttgctctctacagcgcaagcagaatctgttgtctttgtcttttagttttgcctgattgatgatggttttcttcctctgggttttttatggcgtggcagaaatagttctacacatacactcccatttcctggtttctcatacgttccttttgtccgagttcattttctcctcgtcgcccaaccaaacattcctgataataattaagctgaaaaatatcataatacttgttaggaccagggatgaaaccggtcggaaactttcacataaatctgataatgtaatgcaattcgtaaagaaattctacacaccaccatatcttattttagaggaaaaatgatggttcaagtagttcattcaactagtgatgataaacgataatcaacctgaaaaaatgagtcagcccaaatcgagcaaaattaatggcccaagtgccaaaggccgtctctatggcccatatcaagtgctaaaggcccaaagcacatactgtcccaccaaccggcccattagaagcccaagatccccagccaatcaggtttcaggagacacgtcctaaaccgtgggacccacatacacgtcatgccaatgccactctcgacgagaaaattgcatatctaccattgcataagattggcttcgcagaaataccatcacttaaatcggcttcgctagaataccactcctaactagaacggcttcgccaaaatgccattttggacaaaaatgaccctggttcttctcccttcctccaatgccggaggagctcatcggcagccaccggtgccaccttgccggcgacgatgggggcgctgccatcctcgtcgtccccaccttttcatcctgcccgccgcgctaggaggaggccgtagccgacgccatcaacgttgatggggccgaactcatcggcgacgaaagcggagcggatgaactcaccggc

SEQ ID NO: 49770 - DNA, 1892 bp, Oryza sativa
cgcccggcgtcccgctcgcgcgccttcctgcttcacaaattcgccgccgacgcaggagacctccagtctagatggctctcgcctactccttcttccgccaggaggtgagatgattcgatactttgctagttcctcctgcaatttgcgcgtctaatgaggattccgtgatgtagtaatttatgtgaggttattagctcgctttcattgggctggggagggattgtccttgaagccctattttagtattcatccacagtagaaatctctgaattttttgttccagtagggtttccccccggatttgggacatttttcccctagttgttggttaagcaaccaattccccattctttacccagtttatccagcacaattttacaatttttagttttaccagcgactttttagcatactgtgtatggacatgtgattgtgtttaactgaatgaatttctctatcatctctggaggatatacagtgtgcagggccaacagtgtttatttggtgctaatgcattcctttgaggttgtaacaacacgtgcccttttggcagtccaactaaaaaacttggaagttggagagtgtattataaacattttgattttcttcaacttttctaaacatgatgtcttatgcaattcaccttaccctccaatgccctgatccatgttacacttatgtatctgccaatcatttacattctggagcaaaaatagttttactgatccagtaagaattttcatttcacgtctttattcttgctataagaatcaagcatctgttttactgttctttatcttcttgagaaaagacagtggttttaattccatgaaacgaaggtccatgtgtagtccttttttactttctctttgaaaaaaatatggaattaatatctgttcatatagcttcttgttgagttttattatgtcttttgttcacttgcatcaaccaagcatgattggagcatcattgtaggttgaaaacatgcaagtttctcagttttgtttgaatttgtgtcctaaaacctcatggtttgattgaatttgacccgagtatgtgtattggtgctctattacatatatcatctttccatcgtttataccacgttaaatttcttgtacacagaaataaatggtttaaacctatttatttccttctgttcagattacagaggaaactatttctttttgttagctgaaaaatttgctcttgcagatgtatgaagaagcagtcacactttatgctgaacttgcagaggctgcgcttacaagctctttgatctcgaaggagcctccagtgattgaaccagtcaggttacacagtgggaccgaagaaaacaaggaagccttgaggaagtctcgaggcgaggatgatgaagattttcaaatcacagagtaccaggcacaacgaggcaatactgttgcaatgcacaaattagggcttctgtattactatggcctacgaggagttagacgtgattatgggaaagcatatcattggttttcaaaggctgtggagaaaggcgatacacgggcaatggagcttctcggagagatctatgctagaggtgctggagttgaaaggaactacactgaagcatacaagtggttgacacttgcagcaaagcagcaacaatactcagctacaatggactgggttatctctatgtcaaaggttatggggttgagaagaaaaacttgacaaaagtaagtatcatgtattagagttttgaaatttagttgcatgtttgtattgggcttacagcctagaaaatagaatcttgaattgcattccattgttagacgatagaatcttgaattgcatttcattgttacaactcactatatccactgctatcgttgtttctagtcagggaaatctgtaggccacta

SEQ ID NO: 49771 - DNA, 1463 bp, Oryza sativa
cagcccgagattacaaccgacgacacggacgagacaacaccaacaacggtagcagcagcggaaacaacggactaacatctaacaccacaggcgacggctgggaactaggacgaaaccctaatctttgcttcaacttcatattcagagctagcagaactatatttatatagagagcaagggtgagtacttacgtattcagcaagccaggggaacttaggtggttaatgcaagcttcaagggtaggctgttatttttcaatcagttttatttgcaagttttcaacaatctaagtgtgtgctttccacaaccagagcgagacaggtctcagctcggtcgggggtgggaagtgaacaatattatttatcaagattgcacaactcccaaagttggcctcaaagctagtttcccaaaccaaaccaattttccaaactttcagagttttggttgtctccaaacaaccagtcacttttagggactccctgtcccgctgtctccctgatagccacttgcctttccaaacatcaggtttcccaaaccacatcactttttcataaaacagggggaaaataaaaactacgctaaggaatcacctcacatccgcccatgaccgtgggcacggccgttcgaacagtttgttaacctctgcagagggggtacactttacccacacgacattactaacccggatcacccagcctgtggggatcagccacgtcgggagacttccaagctttcatgacaaggcatttctaaagccgacacaggtttaccatatgccgacgagagggatcccagaccaacaacaggttaggtcccagaccatattgtgccaggaagcccaggggtcctccccgacaccaccccggcgaatccacttgtctctcggcatcaaggctcccctgattagctaattactcagccaggggtgtcccattccacccatgtggttgcactatcatatgctcggatgtaattccgaaggaatcggtccttaaaagcgaccgcacaagcatcccgcccaggaatggccttgtgtcgcaagttttatttttaaagctcattttctttcacaaggcaccgacccaggcgtcgggttttccaatcgttttgtaaaccaagttttacccaagatgtctaccatattttaagtttgaaggcgaccgtcgatactcacacagagtgcatgaataccgaggcgtgaccaggtggttacaaggaaacatgatataacaatttaacaatggaaggattaaatgcaacaagttaggtatgcccaccgatctgcctcgcagacggggcaaacatattatgtgcaatcctatcaatgcataatattttgcaagcaatataattaagttcaaatataggctcaagatgttcaaaggtggcttgccttgctcagagtcttcacggagcttcccgaatcttcgagatatccacgatcgaccgaaaatccgcaaccg

SEQ ID NO: 49772 - DNA, 1394 bp, Oryza sativa
ttcacagtagctcaatgatgtgagatgtgaaaatgaacacgaccatcgactacatctccacaactttgtagaaaccttgaataagtaactgacgtggttaagtatactgattacccagaattacatctttgtgtctctgacttaatgcaaatgcaatttctacgccacccttacaatgccttgatccacactctgtaggttaaaagcaataactctggcacagcatctaatggcaacgatcagggtttacaacctcctaagaaagcagcaagaacaggacatggtgcggtaagggaagacacctgccaaattgaaagcaatgatccatccaatcgaaaacaagaattatacgaatcaaatggatccacagaccaaatagaaaagttaaatgttcgctcatcatcagcaagagcaaaatttatggagaaatcaagcagctcaagaaataagagcaaaaagaccttatggggccgtacttcagtgcgtgcaattgttatttgcatactcttacacattagtgagactagggcaatctcataattttgggtaaatacattctttacaggcaagaaaagacctgtcagcagaggagattgactattgcagtgatgacgagtaagtatccagctatatattattgtattgtgctgttggaagagttccagacatatcctttagaagcactgaattatttttccctttgtgattctaccttatctctttgctctcctttttgtctcaataactaactactcctttgatggtggaccaacaatgggaaattgagtttgttagggtaataatgcaaataagtgatattgcttactcttttagcttttacttgtcatcccgcttgtcttcattgcaacaattaaatatatatatcttctgttatgctaatatggtatcaaaagctatagaaggtttttcccattttctcctgccccaacattttcttgaacttcccttccactcccattaggattagtagtggatagaagtgcttgtgaagttaaaataaaagcacacttccataatcattcctggaattttttggttcttccattgcatgattggtgaattttccagttgcttctgtattgtactgtttagagtttgtctcttatctttggttaacatatttaaaaatatcaaatcaagaacagttggaaactttaagagaagatatcaaacagcttttacactgttgttaaattttgagatatttcttttaattcgaaattttcaactaggactcttattgagaagcttgagaacagcaagacagatctccaatctaaaattactaaggaggtacagacttttccctggaatcaatgagagattctgtagcattaaatacttacacatgaggtgatgtgctgtctatttca

SEQ ID NO: 49773 - DNA, 3805 bp, Oryza sativa
tagtactagtactatcatgcatgcatagcatggagcaccccaagaatccacaggtttgtcacgtcccaccaccgtttgttgccatctccttttccttccagctacgccgccgatgcagctagccagctcccaaaccccaaccccatgaggccgacccattgacgaacctcaccggcctgacgcgcgcaggcgcagcctctcgcgctcgctacgctccggccccgcgcggccgcggatgataccaattccccggtgcatgtggcccgccacatggcgaggcaggcgacgagtgacgacacgagccgccgcgcggatcgtccaaccgcgcgctcgtaggacggcaggagtcgcgccgatccacttgtccttgcttccccgcgggagcgccgtgacctttgtcttcgctctcccgcgggggtgttggcctcgtctgtgatcgcaactgctcgcaacgcaaaggagttgagattgtccagaagtgcacgcttctccctcgatcgatcgatcgatacacgtttttgcgaacgtataaggcctcgcgcgggccaacgtgcatggataaaggcacacggcgcggttggtagtattatactatatgctgctgtcgggtgaagtcctccgatctgtataggatctgctacattatcattgttgttcagtatcgtatcgtcaaaatcaacctgcagtatgagtaccaataatgcttcggttggagaatgcaagatgtacttacactacgaggtgtgtcggacatttgtgtcagtcagaacattgagaaaaatacgaaatggagaaagacaggaagagaacaaaaggtacactgcgagaccaccgtggtagtgtactgtaatctgtgtgcgcccctgctataagaaatcggtttgtggataggttaaaatgactagcccatttccgtacagccggagtcttttggcctaagtgtagggtagtatctgtcgggttcatcagccaagtatgatcatgggagaattatgcatgagtaatgatggcggaatcctaatgatggtcagggaacgaaaattgccacttgagttccctttggagcttctgaagttttgtgatgggagtaattttacgttcttaaatctcgaggtatctatctaaaataaatggtatcttaagataattaatacctataactttggatggagattcacaaataaaattaaataatttttatgatcttgttatgccgtgggagtttttattagtttgtgtgtgcttttgtttattcatgtgtgagtttttgttaaattggtgtaataattatcttaaaaaaactaatacttaaatataccaaattttataatagaaagtacgatatcttctaaggatgtgttcggatggccccttttctcaacccatctctctcgtttaccgcgcgcacacttttcaaactactaaatggtgtgtgttttgaaaaaagtttcaatatgaaagttgctaaaaaaaatcaaattaatctttttttaaaaaaatagctaatacttaattaatcacacgctaatagatcgttccgttttctgtgctcactgtgctggatgggaacagaaccagagaacacaccctaaggatggtaaacttatcatttgtgatgattgtatgaacattcctaatgcacgggttctcagggtcaggtgctcacgacctcaggtgtcattgtgtcaacactcaaacagaaagaggaaatgctctagctacacatgtttcacttcatgttgcaagttacttttgtcgtataacaacatgaacagaacacaggttaccagaaaagtcacaaatgtcgagcaaagttggcaagacccagcttgtttgaaacacagaaattatcttgcttttattgggaggaatcgagatgtttcattatatatttgtcttctagagacattccatgttaaatttgtagaggttgtcatgctagcgaaagcagatcaatatcaaccatttcgttcttttttttaaaaaaaaaagccggtgacaggatctctgctagatatattaagaagagttggcctggcctagcttataaggaagatcgggcctaaaaaccacacaaccgaccaattaattaaaggagaactggtaaaacccacacgatgagccaaaaaaagaaaagcttgcagcaacaaaacaactagcacacaacatagcgcaaactacctacaaacaaccctactgaagagcaggaagagaagcccccaacaaggaaacaacatctaggatgttgctaaaactagtttagcacaccggactaggtatttacttacaagaagagatgaccgcttcaacaatgcccctaagggaaaaaaggcgtccattgacattgacatcgctaaagatagataaaaactgaataaggattttgccttaggctctctaaattgccaatcacctccataacaagatgaaggtgttgtgggttattgttacccagctcactacacgacataacagtttcgactctgccgcaacacaaactacacagcaccacggaggcgaacaacaacactactccttcgcccacaccaaacataaatagatggggatcattgttaccgggcttgccacatggacaagtaactctgacctttgcccaccatgcgaatgctcaccaatacgattccataaccaccacctccatgcgcggattttctccaagaaagtgttgttgatgccgaaggtcgctcatcctctgacaagaagacaccaaaatgaccaaactaccacctctcctcctaccatagggctcctcgatcggagtctagaagtagaatgaccttaagagggaaggagctctaaggtgagagaaggagcccagtcgaccaaacggagttccgctcaccgtccttcaaaccaccaccagcgtcgatgctcatagtgacctcggtgacaatccatcaagtggtattgcggcaagaagtacctgcaggctgtggcttctagccaccctacttcggcactctttgaaccaactccagaagctccgatggtctccctatgacaacttgtgcgacaactcttccactccaactccatctcgtgcagcggcgtcagtggcaccctccaactccaccttaacagcaatgctaacgtcgagctcccagtcacctgccagtgaagtgggcaccccattggccacccatgcgcccccaacttaccctgttggtaagtgcactgccctactccgacgccactcctctcgccaccatgttcccaacccctgcgcctctgtcgccaaacttgaatcgctgccaccttcacacctgcatcgccgccgccgccacacccaccatcggggggggggggtcgccactgtcagatccagataatcttttggatctggaataggtccaaccaccatgtttccctccagacgcaggttaatatagggttggatcgtcgtaggtggtgggatggggaggggatcgagagtgggggacaacggcatagagggttgcgtcgccacccaacaaggagcgaccggaggtatgtttttcctaaatcaaccatttagatggctttgtcagggattttcaagattagctcaggtgatttttcagctgcctcacgttgatactcctactccactagaaattcgtcctacctagctacatattcctactacgtactctcttcatactcgtaaaggaagtcgtttaggacaatgtttaagtcaaaccttaggagtataaatcatgaataactcttaagttgttaagtttgaaaatgtaaaaattatatgaatatatttatcttgaaaaatattttcataaaaatatacatg

SEQ ID NO: 49774 - DNA, 3712 bp, Oryza sativa
ttttctaaaaacaactaagtgagtgcttctcaaacgaggcgggtgagacagtgcgtctcgtccggtcggagtatgtgcaatgtatcagcctttagaattgaatcaaggttggcaccccggccaatagcttttcaaacggccacccgggccaacaacttttcaaacggccaccggggcctagctgatcccgtcagctgctgatttttcaaacatcgaacccctttccacaacagcaatttcacaagcagtagtcaaacaaaactatgctaggaatcacctcacatccgcccatgaccgtgggcacggctgttcgaacagtttgttaacctctgcagagggggtacactttacccacacgacattactaacccggatcacccagcccgtgggaatcagccacgtcgggagacctccaagctttcatgacaaggcatttcgaaagccgtcacaggtttaccatatgccgacgagaggggtcccagaccaacaacaggttaggtcccagaccatactgtgccaggaagcccaggggtcctccccgacaccaccccggcgaatccacatgtctcccggcatcaaggctcccctgataagctagttactcagccaggggtgtcccattccacccatgtggtcgtacttgtcttatgtttggatgaaattccaaggaattggtccttaagtgcgagatcgggaaaccgtacacccggtacgttccccagtccgcggttttggaaatttatttagttcgcaaccacgacctaggtgtcgggttttccaagtattttgtaaaacccaagttttacccaagatgtttttcagattttaagtttgaaggcgaccgtcgatactcgtgcagagtgcacgatttccgaggcgcaactgggtggttacaagggaacatggtatgacaattaacagaggaaggatcaaatgcaacaagctaggtaggtccgccaatctgccttgcagacgggacaaacagattaagtgcgatcctatcaatgcataatatttttcaaacagcataattaaatttcaaatataggctcaagatgttcaaaggtggcttgccttgctcgagatttggagcttgatcctcgaaatcctcgcactgcgggtcttcgggctccgaaactacacgcgaaacgggacaactcaacaaacggcgaaaataaagccctatttgtcggtgacatgggaccgggagtatcgtgactagaggcttgggcagccgcgctcacccacgtggcctgaccccctcggggggggggggtcgggcccgagggtgacatggccacccctccctctgtctccccgaggggtcgggccgctcccgtttcggccccgaggtctggggcgccccgaccccctgtggtgttggcgccacgtgtgtgggttaggtgagcacagcggcgctcacctaaccgcatttatgcgggttggacgagcgcgccatgccgcatttaatgcagcgcagcgcgctcgcttatccggtccgtgaccggtcgcagtatgtgaccggtcacagaccggtcagatcgcgggttaggtggcagcaggcggcctgtcacacgcctcgccccgtcccgtcggaatgatgagagcctccaggcactcgtccctagccggagccggcgtgctaactcctggagttagcacgccagtcccggccagatacattccaggcttcatcgcaaccattgcaaggaagtcattgtatgaagaaggacagacgtgcggcatgctaaactgacacgtggtggacaagaatgaccggtctgtgactggtctgacgccggtcacgtcatcggcagacaaaccgtgctctcacgttgcatctgcttccggcgaagtggaggtaggtatgacccatcccatcggagggtcattcggacagcggccattgcaaatctccgcccattaatgaaggaatgacagggtgatcccctgtgtcaggcgagtgacggcgctgggcctcactcaaggacaagctgtgatttagcttccaagcgaaggcgtgagccaagttctggtcaagatagggtgggtccccacccaaaagaagggtaggtagaagtggtgcatgtggtatccccttgagatataaaaggaggaccttgcccaccgaagaggggggatggagatccagaacaagaataggagggacgactctgagaatacctgagctcgtagaggagagaaagaggaagaggggttctagagcctgaactctcttgctctccagctctctgtaactccttcacacacagatccaccagaacacaggagtagggtattacgcttctcagcggcccgaacctgtctacatcgcccgtgtctcgtgcatttgctctctcgcgaatattccacagatcgagggtgaagaacctcacttagcgcccccggccgaaccggcaaaggggggcctgcgcggtctcccggtgaggagccccaagcaccgtcactattaatgacctctaagcgtgccattagatagatctcgagatttgaggaattttggaagttgaacggagtcaaacggatttacggttgggaagatattgaatttctaagattattggatttttggtctaaaggaaaaatgatttaattaaatcctttttgaaaaaaaaaataaaagaaaagaaaagagggaggcaatatagacttttctcgggcgactagggtgcggcccgagagaattggggcggtccggccgagctaaatgggccggccggcccaaggcggcccaaggcgcgcgctcgcatgggagggaggagagagagagccagtggaccgggctcaccgcgcgtggtcccgagtgggacccgcttgtcggcggttcggttcaccgtgcggatcgagcacgcggcgcgcgcgcgcgggcggggctgggacgcggtgcacgcgcgcggttcgcggaggaacggatgcggcgggcccacgcgcagcctcacggctcgcggtggaacgcgcgcacggggaggggctgaccggggtcggctcgacccggtcttggccgagctggcgccgacgtggcgcctacgtggctgccacgcgggccagcgggaggtagacgacgacgccggccggaacggacggcggacgacagcggcgagcggcggagtgaaccacggcgatacaggcgaaagcgagcacaccgggtggttgcacgagacgaggggagacgagccaacggctcggattcgccggaggatgcccgacggcggcgatttgcggcggcggcaaccggcggagggagaagggggaaacggcgacgaggtcacgaggggccgattcccggcggcgagagcatctacgcggctacgggaatccgatgctagcgttggattgggcggagctgcgccgagcgaggccggcgacgagcggcgcttccgagctcgggcggcgacggcggcgagcacacggcgagcggcggcaacggtcggggtggcgccggctagctatggggaggctactcgtgctactacccgagtctaaggggaggagatggagcgaggagggagaacggggagatgcactaccgtgcgggcgggcgcagtgacgagaggccgacggcgcgggagtaatctctccggcctcgggccggggaagaggaaggagagggcgcgcccggagtccccttccgcgtccttgctcgtgccggctcctccgacacgcgcaacaacgaacggcgacggcgaacaga

SEQ ID NO: 49775 - DNA, 1884 bp, Oryza sativa
ttcggcccatcgaccccgggggaggcaaaatagactttgcggaggaatttgatttggaaggatttggattcggaattgaactcgacgatagatcggggatttgagatcttgagatagcacgggcactagacaacaagcaaagaaacaaatttcgcaattagggtttttaagagataattttcccgctaggcgccacgacggaacgggcgctacaatgtatcacttttcaataaatatttttatagaaacaatcaatcaaagttgtgttttgaagaccgtgtcgttatcctaaatgacttcctttatgagtacggagggattattctgtacttacccacgctaccactgcatgtacagtactgtacctgatgaaaatcagagagaaaatagcgcagatgaattactggttgttggtcaaatcatgaaaagacggtgatgaccgcgtcgttatgcctagcataaaacctgggtcgcaaaaccaaataataaatcatgaagaacaagttaatgcagggtcgaactaccgaatcaaattcaatcaaaacaatactgaccgaattaatgaccagcatcgcgccatcgcctccttggctcctcgctgaacgaagccttgaccgttaaggttttttcacctaaaaaaaaaaaaaccctctcctgctgtcatgcatggctgcatatatacaggctcgctgctcttcagctaaacactcccgcgcgcgcagccaaagattcagaaccggcaaaacctgtagcagtagcactgtgcaagtcttccacaacacaaagcctgttccatttctaaccatgaagcttacattacttggcaactgtatccatcaccctgttcttcttctagtgatcctcgcctgcgccggcattgcaccggcgagcggcgccggcgggaggtgggacgtcctccagcgcagcatcggcgtgtcggcgatgcacatgcagctgctgcacaacgaccgcgtgatcatcttcgaccgcaccgacttcggcctgtccaacctctccctccccgacggccggggccgccgcaacccgcgggagcgcgtggtccccatggactgcaccgcgcactccgccgagtacgacgtcgcgttgaacacgttccgcccgctcttcgtcttcaccgacacgtggtgctcgtcggcaccgtcgcgcccgacggcaccctcgtccagaccggcgggtggaacgacggctaccgcaacgtgcgcacgatggccgcgtgcgaggcgggcgacgacacctgcgactgggacgagacgcaggacgcgctcgccgcgaacaggtggtacgccaccaaccagatcctccccgacggccgcgccttcatcgtcggcggccggaggcagttcacctacgagttctacccaacggccgattcttccggtggctctgctatctcactgccattcttggttcagactaaggatcccgaggagaacaacctgtatccctttgtccacctcaacatagatggcaacctgttcatctttgccaagaatcgcgccattcttttcgactacaagaagaacaaggtcgtcaggacgtaccctgagttggctggcggcgacccgaggaactatcccagctcgggctcgtcggttttactccccttgaagccgtccccaacagaggccgaggtgctggtgtgcggcggcgctcccgccggctcctacacctcaaccaaggacggcaccttctcctcggcgctcgtgacgtgcgggcggatcaagatcaccgacacggcgccggcgtgggtcatcgagacaatgccgtcgccgagggtgatgggggacatgatcttgctgccgaacggcgcggaggtggtgatcatcaacggcgccatggacggcaccgccggctgggagtccg

SEQ ID NO: 49776 - DNA, 5286 bp, Oryza sativa
cgatccatccaacgacgcgcttcgtccgacgatcgtcgatccctcgcccaacggcgcggcggtgagcgtgacctacggtgcgtcgttgacgttgcagttcgcggttccgccggcgaggagagcgcgcggcggcggcggcggcggcggcatcgggctcgtgtcagtcacgatggtcgcgccgtcgttcacgacgcactcgttcgcgatgaaccagaggctgctactcctcgacgccgtgaagacggcggcgctggcacgggccagcacctaccagacatccgtggtgatgccggcgacggcggccttggcgccgccgggctactacatggtgttcgtggtgaatggccacatcccaagcgaagggatctgggtccacatacagtgacactgacagggggtatagctgcaagggcaagactgtagtacagtacgagtaccattttaatctgttgtcaccatacagttgatagtgtgacactgtgactgttaccgcttgcatgagacagtaagaaaaagaaaaaagataggagaatgtctgtaaaatcgggggctcttgaaaaggttcacgtgaaccgtgcgcacgtgatgtttcctcagacgcatctgctcttggcaactttggccgctgccgccacggcgctgcaaagcttcggttttttcttgccatgcgtgtgcgcgcggtgcgagtaggcggacaaaaaggcgtgcgagtaggctggtgtagtgcaacctgctcaggagagatccattcggttacgcagccatgttggggtgggattgggaacgccgtccgtgtgcgcgcctcgccggtggggcggcttcggtgcgtcacgtgtgcgcttgcgggtgacgggagcgcatgggccacgggtagcgaggcagcggtggccatcatcacacggtcagacggtctcagcctcccagggaagaggggaatttaactatttaccactatattaggtttcttaattatccaaatacccctcttaaaattgtatttaattttttatcattggagatagacaacttcttatttttttaccactttatggcacgccaacaaggctaccctatcattttcttccttctccacctcctctctatcttctctccccttctccccaatcccccctcctctcgtctgctcttcatctctccctccagttcggcgttcaccgtcgtgaggtcctccgccttcatatccaccgtggcgaggagcaccttcgctgttgctcggcctccatcgccgccactccgcctcctcctccgccgctagaagcccgttcgacgccgcttcgcctcctctgccaccgccgccgccgctgctccgcctcctccattgccgctctgcctcctctccactgtcgccctcctcctccacggtcgccgctgcccgccactgccctgcctcttccacctccggccgtcgcaaccaccatgaaagagccggcaaggaggtgaacgaggaggagtggctcgcagtgaggcaagcaggggcccaatccatggcggcggcggcgcactgcgtcgtccttgtgctcatcctcgtcaccgctggcgtcattgcctccgccaatactgttgttgctgctcgtcccggtggttggcgggcggttggatcctcaccgactacgacgatggatgaggtggagtaagtgggtggagacggaatacgacggcggaagagggtactcgttgatttgagttttggttttgctacttttgcataaacggtggctcgtacaagaaaacggaatgtgcttggtggttgaaaaccgccaagtataacgacgagttattcttaagaaaaaagaacgtttttctggatatgtgatatattcatatttatgtacaaaagttatttttagatggagagagagatcaaacggtgaatagctagctgcatttcaaattggctatcttcatgcaaagtgggttatcctggtagtttgaggaatttaaaaacaaaggaatggttgggtattccatgcattttaaaatgtgttctcttaaagaaaaaaattattctgtctcaaaactattttttacttcttaaaatacttaattattcatataatcaagtagatagtctaccctaacagatacagtggaaaatctgtttaaaattgggtcaggtaaactcacagttcttcaaaccatacttcgcgggaaataaaccaggatattgttgtaacactacccaagaaccacattttgactcggttctatccctcttagagattgtattatagattatcacgtgtaaacttcccaagctcttaactagtacaattttaccaaaaaaatctatatattaattgcttatcatattattttagaacgacttaaaataaatcattttactttccaatgtcaaaaaaaattgctttgaccactgattgataatatatcatactccctccattcttacatattcgtcgttagaacaaacaacttttttgcaaaagttagtgcatttgcttgataaaagcgtcatatattagtgactggaggtaatacagcaaaataaaaagttatactacctccgtcctaaaatataacaactcttagctatgaatttggacacacggttgtccagattcatagtagaaatgcttatattttggaatggagggagtaccaaataatgtgttttgttactataaaaattctttttataacaaaagtagccatttatcagtcttaaaaaaaacaaaattagccttatgcgcaacaagttagatctacccctaaaaaggaacttgtttttggttccgtgagtctcatcggttgcccatgattactaataagccaaaacgatttgttagagaataaaaattaatttatgggtaaacttttatatatttgttcgtagcgacctcaaaaccaacgttaaaaagaaattacgttgaaaacatcttagaatcaagttaatttttttttaaaattttggcttttgctttgatttattagatcaaccgatgaggctctgtgactgttggttgattgcttcttttgttctcagacataaatgagggcgatcgcaatgaatatgcccatggctgtttctcgattatgctatgcgtggccactctgaagtctaaagacgctttgtggttgcaataccaaattctgaagaaataaccagaacaaactgggcgaatgctgaaatctcaatgagcagacaatgaactaaagaggatggttatgttactggggaaaaaaaagaagctcacgtaccattactctgtttctagttgtggacagtcccttatccccgtgcatgaacaagagttaactgatgcctgtatggtggttggagtaggtgtcacttgtcagatctcttgcagtgactggttgcattttcttgcaaatgcttctggctgctgcatctgcatgtatcgcttcttgtgtgtgaaagactgaaagtacatctattcatgtaccaaccattggctcagttaacattgtagcgattagatgcttctttagtactagtagattgtagtctacaaccgatagcagtggtggtactagtaatttaacagccaaattgttctgtaactctattcatgtcttgtagctgttgcatcccgtgaactcttgggacagtcatgttcatcgattccgaaatgaatcgactctaacacttgccgaacaccagtagtagtttttttttttcctttttggagagactgaaaacttggagtggttagttcagagctagagagagtgttcatttggtcaggcgtgagtttatacgtacttcatcccagaggccaacatagccacatggccagatccatatgggcttcggtctataagccgtgttgggtcaagatcacgtaaatagttagggatagttattcactcctaggaggctgggccgggccggaccgtgcggcccatttggccagcactaattgctgctattagccatttcattttttagataatgtattatgtgtagtccatttcttgaatatttgggccgcactaattgctgctattagccatttcattttttagataatgtattatgtgtagtccatttcttgaatatttgtttttttaatgtaatgcttataagcagatctactcgtaacatgttttaaatgttattctaaaaaatgtttcaaatgtttttcttttgtaaaaccaaaagaaacacagattgatatgagccatgagttcttttctcatcttttttctttgactcaatataaggagacatactacaaattagtactactcacttcctgtagagaataaaactcaagtttgaatctcctaaagatgaagatgaagataaaaattaagtgttttacacaaaacgagatggtaataacatgtgattaattgagttttaattattacaaacttgaaaaatggattaatctgatattttaaagcatttttcatatagaaagttttcgcacgaaacgtaccgtttagcagtttaaaaggcgtgccacgagtatccaaaattttatcactcacttaggcctgatttagttcccaactttttcttcaaatttccaacttttccatcacatcaaaactttcctacacacacaaacttccaacttttccgtcacatcgtttcaatttcaatcaaactttcaattttagcgtggactaaacacacccttatagaagaaacgaacaggggagtctcacttcctttcttgtcaatcagccaggttccttctgaaactgatgtaaggagtacttctactactaataaccaggtttctctgaaacatgagcctgaacagctactctgtcaggctgtcactgccgactctaacaaaggaatctgcaaataggagtccatccaaacacaaaacaagattggaacaaagtggcttcagacttcagagcctaccaaaagaaggcacatgtacaccaaggataccacaaacagcacagaaatgaacagcctaaaagcacatgaggctgcttaaagccaagccgaagccatcacacctaatacttcaaatctagccgttctctgtaccaagaaccgaacactcaacgacttaatcaccatggacacaacttccctgaaacttcatcacctcgacgtctgcatgacgagcgacagaaacatccgatggagttgaagaatctcccgtttcgtttcctgacgagcaagagtacaacaacgtcaacgacgcccacgataacaacagagcaaacagaaatggaagcaatggaacaagagctcacgttcccagattggttctagtcactatatccggcggatcacgggctcctcgtccc

SEQ ID NO: 49777 - DNA, 926 bp, Oryza sativa
gaaggagggatgtatattagacttgggccgagcgaagggaatgggctgagcaagcaagaagcggcccatcggctgggagaggatcattagacttttgctgagagttatttgaaggaatttgagaggcacttgaggtgggatttgaattccaatcgtatatctgaactcaaggatatatggagagtcaaggatgggcagcaatttgcaagttggacttcaaagagggaattagattggatttcgtggatgaagggattcaaggggtaggtaggttggtaggtcaagacttttagagagagagagagagagagagagagagagagagagagagagatgggctggaatagaaggaagaagtggacctaggagagaaaggaagaaggaatccaacattatggggaggtaaaatagactttcacagggatgactggaacgtcggttcaaatcgtttgaggggttattgatcttggaatatttcgaaagaattcggccgaacgatattcgtgagagaaattcggatacgaaggtccaaatttcgagaatggttttcgatgaatcaagggaagggttaggattcacgaggtggatgtttgaactagactggattcaaggattaggcaaaaatatgtggctaggatttcaggaatgaaatccgaatataaggatccgaacttcaacattatttacgagacaaaaacagggattcggactatcgaatttgaggattgcaattgcgggaccttcgcacgaagtaacctagaggtgatttgagtgcagactcaaatcttgagagatcaacggaacggatttattaggaggggaaatatctcagaagaaatttagaaacaggttttgaatacaagggtgagacccttttcaggcaaggacttttagagctagggttttggcatccgagaattgagatg

SEQ ID NO: 49778 - DNA, 12357 bp, Oryza sativa
  unsure (1)..(12357): unsure at all n locations
nnnnnnnnnnnnnnnnnnnnnnnnnnnnnnnnnnnnnnnnnnnnnnnnnnnncagtcctgtctagcatctcggtgagcatcctggactccttaggaagcacatgcatgcatgtatctagcgaaaacgaggccccaaagcagcatgcagtagcagcctaagcacagccgtcgctcagacccgccgccggcgctactccaatgtcccataaccaagaaaactagaggaatggaatcgcgagagcttggtcttcattttatcttttgacctcaacctcaagcgagccaccgtttgccgccggcgagctcgagatcgacctcagccatggctagctctgctgtgtctagagcagagggatgacttccgtgaattagattaagcgcagggatccgtttacaattgtagaaacacactgacatatgggcctaggactgcgggttgattcctagaaaccccaagggcctttgtgcatattggtccctcacagccatgtggaccccatcctttaaaatctgaagaataattaagaaaatgcccaaacaaatatatgtttagcagaaaaatgcacaaagttgtaaaatctatataaaatcaaatatagctcattttgaagtgattccagttgctgtagattcttgaagttatgaactttattccaggaatataaaacttgacactcactgtacaaataatgtctctaaaatttatctaagataggtcatacataaaacatgtacaaacttataaaatacatagaaaattcatctcaactcattttgaaacaaactcaaaaactgcagattcatcatcatgcactctctggttaggtgaaataaaagtaattacttactttgcataaaatgcctctaaaactattatatctaaaatgattagttttagataagctaaactttagaaattcatgtagaacccaatttagcttcaatttgaataaacttaagttctataggatcaccaaaacacgtatttccatgttatgaaataagattatatacttactgtgtagtaaaagtctctaaatattcatataaggatttactaacatagagcaacctttaatttgtaaaacttgtagagaatttatttttagtccaaatgaaatgaacaaagtttctatagaaccagcaaatagttagcttcaacatagtaaaataaaatttggcaccttttgtagagaacatagatcaaaaccttaacttagtgaaataagaatttaaacacatagtgttatttaagtaatacataaacatgtataagtatatatacactttaggtataattaaacctaaataaaaacttgattgaccagtgaggccatagttccatactcatccactaaaacttagaagaacttaactcatatgacaatttctaggttaatataatatattgctagtttagattagagcatctctagtttataaaatatgaaccatagtagtacagaccataacatgtgaaataaaaatgttttagttaaccaaattattccttttattcaacttaaacaggaagtagcatgttctaaacctataactcaaaagtcatgaacatataaaacactatatgcctaaaacacgttgtaacttgtaaaatctataagaaaatcactataactccaaaaattgtgaaaccaaatgtgttagtcttagaaaacacatctccacacccctgtgaagtctaatataataaaaatcactttacaaaagtattttataacactacctaagactactactataaaccgataaaaattctaaaattcataactcccaaatggaataagataaaatagatattatttcacctaaattcattttagatcagtaccaacccactgtgcataaatcatgcattttagagcattttggattttcagctctttcggtgtttaattgcataacgtgtcatttatatagataattgcataatcggtgaaggactggattaggtgctaacgtttctctgatcaaggcaagttttctcctcccatcctttgaacacattgaatcccatgatttgaggaatgaaaatatttgtttgcaaagttgcatgtgaacttagactatatcggtatttaaaattgggttaaggtagttatgacctatttgctacatacccccaccttgaataattgatcctcttgctgtttgaaaccctagaaatggttagagtacactctttgtgctcaaatgggtttatatatgctctatgtgcaactacttgcttagccatgcttagaaatatgcaaatgctcattccatctataattaaaatgtgattttgatacatgaacctttgctagaataaaatgaatatgatgggtatttgcgaactaaaatgtgtaaaatgtgattttatacttgggcggcaagtggtgtgcatatggtgttagttgcataccgatagggggagtgtttgcccaagtccataaggaccgaacttgtgtcacccatttaaagttattcgtacatccacatgtgctagtatgggatggtctaagctgattaatctatttaggactagccttgcattctggtaggccggtgtgtatgagttcgtataattcagaggagcttcctatttaccccgacgtggtagtttaggtgactaaacatgtccaatacaacggtattgtgccacgtggtgggttcccgtcgtgtccgccaccacggcgttaagtttaaggcgtgggcccaccacttaacggttctagacatatttccaagtatgcctaggatggaggaacacgtatcgtgctggtgcaaggctagattctaagtagtgtaaaggattcgttgtgacctctagtccgcactcataatgtagagtgtgtggtacttggccggcactgaaccaactagagtgtagcctctaggcttctatcatatcatgtgggtaaaggtgtacaaactctgcagagttctttaaactaatcgattagccgtgctcacagtcaagagcgctttggtgatgtgtcatgagtatttaaactaatcgattagccgtgctcacagtcaagagcgctttggtgatgtgtcatgagtatagactatgttttaaaaatgtaatcatgtgacattggtttgaaattgataaatgtgttgagttgtgtgtgtggtgatacattatgacttattgttaagtatgacaataagagattgattatgatggaattatgaagaagttaataatgaaacttaaaacttgtctttgttaattgaagcatcaactcctttacaaaagaattgcgaaacaaaacttgctttatgctgaaattaaactacatattgccttcctttgaatatatgtcttacatgtagtatgataggattgatttgtgcttgccagtacattaaacaagttaacttgtttaatgtactgacttgctgttgatataaccttttgtttgcaggtttagatttagtctttgagtgatgcgggttccgattgcttcttctaggatgagaacttaatggggtaaacccctagtcgatgtgcttgtgattgggtagtcaagcttccgctgttctctaataagtctatttggccggtcggtctatgtaattattaagttgttgtaagtcttaagtttcttttatcttagttgtgtttgctatgtataatcatgtttaagatgaaagtgtgaatctagtgcactagtgcacatcctgggaactagatttacatgagtatgagttaggaatatttgagaggttgtagatctttagctatttttgtcaagtttcctgaatgtgtaacacatctggtcgccgccttcgagtggtttgacgggcacatatcaggctgaagttgactggcaggctaagggcttagcaatgtcttcaatatttctctctcgaggcgtccgatgtttcattatgcttgtttgatgacttgaattattcacttcatctctcaaatataatggaaggtctggagagcctacgacactcttaccgaatcactatcaaatcgactcaaataccctactctaattggcaatgatagtcattctaatataggcccagaccgagcacaagtcatatcatattggctgtatcggccatcagcctcataaaccttgatcaacttacactctgtcttctagcaaatacggtatccagccgatgcgcaatccgactccaaattcaactcgattccacaccaaatctgcttcgatcttcttctttcttctccgaatttgatgcaaaattccgttgttaacaatattatacaaaatctctctgatttgattttgtcttcgacataagcccccataggcttttatgtgggcttggcttcacttttatataatgacccatgtatatatactccaggggtgttgattacgtgaagaataacaactcaatcatgttaacatgaattcttgaggataactcttcaacaaggcatagtgctgaagctggtcaccaagcaaaaaaaaaaagtctaaaacaactacttataaaggtaaactaatactatgtaagtacaacgttattatacaatatttaattctggtagcaacaatattttgtgttgtatacatataaacccaagacttcatatttaccacttaagcagctattagttaggtctactatatactttttggacacaaccattgtgagccttatgcattatattgctgagtagatgttctcatcacttgagcatacggtacagcaagtaatggcattaagacctagaagaagtttgcttgtgtagaagaattccacaagaataagaaaatatctcaatgtgaattctagatgaacattaaatacacaagaagatgacgacgtgataaaccttgaactccactcgatacgctcacggctttgattggcctgatctttcggtgagttgagataactacgatttgggagcaacgttgacgatccgactacaaccttacaagacgtcgttgtgttacgccttagcgatcgatacacctcccccttggttgttgatcttgctggtgcagatcaatcttattcctgcaagcaaatcgaagaaacaagtaagaacaagataaaagcaatatgatattgcaaataggaattgaataaacatgataagttggggttctgaagacgagcaattaggtggtatagccaacacacgtaactacaaggtaaagtagcaatggctaaaactttaatctaacaaaacccgagaaattataaagaggtcctgttgacggtcgttatcgatcagtttcgactgtcaatattactaaaatagaggagaactagtgatgcttgcaatggataaatatattaaaataataatattccactagtattaggtatactaacatttttcagagaatgaccataaagtggaggagaatcgacatcaacacagacgataaatcaatcggacgatgtcgagaaccagacttatgtatgaatgggccaagaactcagaattgacacgacaaactgagccaaaattcacaagtctgcggagaaaaacaacagagtaggggtgggcataaaaaccgtgaaccgaagaccgaagccgaaaaaaccgtaaccgaggccgaaaaaaccgaatttccagttatcggtcacaacatcgtgtgttaggtctaaaagaccgaagttctttcggtgagttcggtcatcgtcgttaattaaccgaaaaaaccgaaggaccgatcaacccaactgcatgtattcttttccaggcccattagtctattgcgtgtgtacagcccacaagctaaccctcctttaaagagaaaaaaacaccttatcacttatccccatattcccctccacacagaaatcacggatgcggcatctctgcaagctctcactccgccgccgacggaaacgagaaaactgcatcccgcagtcacgcctccgcttcttcccatgagcttccattctcttctccccttcccttctaagcttcaattgctccactgcccagtgcccatgaggccatgaaccgaggatctgaggggtgaggcaagaaacgccgcaggcttaggctcggccacccgcagttggtcgccttggaggcgcggccgcgcggggttgagcaatcgtccgcgaacgaggagggttgagcaagctggtgcgccggaggtaggcaagcaacagatgccggcttggggtttctggtttattgatttagtcaatggggaaatgtaatctatgactttatgactttttgtttgagattttgattaatctctttgtgaatttgtatattcaggacgtaattgataattttgatgcattcccatgtttggttgttctgcttttgcttatttacttcgatgtgcaccttgttaaatcggtcagctcgggtaaaactgaagaccgacccgacacttcggttacccgaaatgtcggtccatgaattttttgttgcaaatatcgggttcttgttttcaaagactgaagttttaaaaacccgaacaaccctggccgatttttcggtctagaccgaaagcccacccctacaacagaggaggccgccagctgaaccatgggttggttgggccggccccaagtttggccaaacttctctcatcgccgctggatgcagggtttcttctggacggtgtggattagctctcaatgacggttggagggtatttctgaccattccaaccgtcacaaacatcattggggtgctatataaacccctcaccttctcacttcacccacacacctcaagcaatagctctctcatttctctcaagtttcctcaccttctcacttcacccacacacctcaagcaatagctctctcatttctctcaagtttagtttagtagtatctagctggtggaataggaatagagtagaaatcaggagtccggaagccttccgaagagttcgggtatgactctagtagcttttctcttctcttttgtaagctttgtacttttattagaatactcttctttatatatttatggtattaaaatacttgccgaatatatgaatatctactttatattatgttcatgttatactgaatatacagctaacttatctgggagatgctttggtgcgggtataatgtttacttatgcaattactctgtcatgacaatgatattagagtagtatctggtagtttaggcgtggtgtctagattacgggatattattatttggggttatatattgcggatgagaggtgggccgctgatggtgacagctcagtacgggtattcctccgcgccggtatataatcctaagttaattccctggggagggtattcctccgtatttagcccgggttgtatggtcatgacggactgtcgtaaggaactcggcagtcagtgatggcttctcgaagtaccaggaaggcatcgaatagagggtattagctagtatatcagttaactataatgtatgtatactatgtatattagaagtataggaatagattatctttctcttttctatccacttaggttagatgatatattatgagaatgagtagttaatgcttgtgtgtcactctacccttagattatcttaacccctgcttagaatatgatttcacaagtaatatataaattattagtcaatgttctctctatatgatctttccacgggataaaataaatacgataccattggaatactctcgggtgaaatgctacaatgttatatccgtgcgcttgcggatgaactctgtaaccataataaaccaggagtatttttgcgtcattgctgggaattatatttctagtaatgtcgttaagaaatactaacaggtacctagctatttaaggaggctatttaaggagttgggatgatgtccaaggggtctctaaggtcatgctccaccagattggggcgcaccccatatgggtcccacttaggctagggtccaagacgaagttacgggctcataggcccattatagatgacacaataccttgggcggatgactaagatggaattttaagatgaggttggatcctttggaaagaggactccgagatctttccatcaagtaatcacaggccgaaaacagaggttgtatgcatatttggcggccgtttgaagtcagcaatgtagcaggtggccgaatcagattccaaaactcatgtggcttgatcttgatgtctcccagttgagctatgatgtgagcaacggttgcatcaatagtggctatgatcatatcatgacggtaggttatttatgagttataaggcatgggatgttggccttaacatgggctggccagacgagacttaattactccccaaagtagattgtcatattgcgagcagctcgaatggaattttgacatcaatttcatggcaacagtgaagcacgtccgatcaggacagtctgactaggtcttgttaaacttgttgggattagcatgtgtatccaaggaaaaactttccttgtcatacaattgttctatataccactggtatgaaaggtgaatgacatttagcatcaacataattttctttatgaaaaatgttctaaaatgctataggtaatagtatatgcatgttttaattattccatcatatagatagtcctagaatatctatagttccataaaaaaaaaattagagcgtgacatttgttatagatctaatgaccataatacactgtaaatattgcttgggtagctttctatttataaattgactatttattatgttatacatttttaaactagaggtaaaggcgtaaatagttattttctattttatatatatatatatatatatatatatatgtatgtatatatgtatgtatgtatgtatatatatatgtatgtatgtatgtactactaccgggagcaactactcccatcttatctatgtggcagtgcaaatttctgctatttcggagtccccattggcgtgttaattagccatgtcatccaacccgtttagaatgataaccattattttcatgggatacaaacaattttgaatgcatgttagttcatccgccagaggagcagaatatggacactacgattggcagaaaccattttttctcccattgatgttctgttccgtttccaaataatgttctgctcctttccaatcgatgttctgttccgtttacaaataatgttatgctcctttccagttgatatttttctgcttctttttaatttcctgcctttcttaacgtcttctgcttagtgacgattttgttgaaggagcagaagatgtgcttctgttcaaattagttttctgctccctttctaaccgatgttctgctccttgcctcctttcctaggtcacatactccatactgcttcctttcatgtttctgctcattttcaagtcttataagcttcatatagacgatgagattcaatttaacaggcagaaggtattctgcactttttattccttgttctatgcgttcttacaaatttgaaatgacctgaatggacacaacagacgtcacaaattatgggccggggagcaaaagatgttctgcaattgtttctgccgagtcctatgtctaatagtgaatggaatcggtttgtgaaagagcagaagatattctgttatctctaccatccattgattcaggagggggattatagctttctgctgcacaaattctgttatgccgttgtgattaaaaagagtatcatccctcaactcggctgtgttgtacatccataccaacagaaactatcctgagcaaaatataacatacctatttaagtatgtaaacataaactgcaattagtaatcaataggcagaatatgaactgccgttacatagagaaaaaattggtatttgttctgccaacaatttgttttttcgatgatgttctgccattttctttttctgatgttctgccatttttttcaattggccagctacatatcttctgacggttagaagcagagcatattctgccaaggcgagcacataggaacaaactccaaccgaatgttttgcatgcagccgatgatttagcatttatttgaactaataaactatttagttaattacttaattaaacaacccggtctgcagaagtttagtagattcagggttattccgttaaatcgatccgttaagggaagggttactcccgggcaccatggtatcaaatgcacaaaatcattcaaatatttcaaaattttcaaattatgagtatatacctagttataagaattcgatttatacctacacctaacaacaaaacaactcaaatttaactttatctcacaatccatgattacatacctaactaattatatgtttggatgctatatacctagaatcaaaatctaacaaaaacaagttcaaattcagttcaaacttgctttgaactagttagtaaagtagttaatgttaatatctaaatatttgaaaaagtttcatactcatttgaattggatatatactcaatttcaacaatggtgcccgggcaccatggagcaccaaacaaatttataatatatatatatatatatatatatatatatatatatatatatatataaacatgtatcaagtgaagtacataaattttataatatatatttttttatataatataaacaatacactgctaatgactatacttacttaaaaagtaatgtagtagcattaaaataaataaaatttataatagtttaataatattatgtaagttttcagatttcatattaaaagaacctacgaacaagaaaatcgggctgcaagaaccggattttcttctgaattatctaaaattcagaagacaaaaataatcgaggaccaaacaatacctagcaagaagttgcttaatctctagagctatgatctttatattggtttttgccaatctaaactaactcatcacaactaatgaaaatctaaactaaagataatgaagggatgaattcaagagattcaacgcaatgatggaaccaactaaagaaatagattcatcgccggttgaagcgtcccgtctaccgcttctgcttgcgattcttgatatgccccgtcttgctggtgtcagcggcggcctgccaattcaagccaggaggcatcgctatctgcgtccccaatgatgctgcagtcaccttgcgtctccaatgatgctgcagtcaccttgaaagaggccggacacaggagctgctcagctggaaccgggaccacttctttttcttgtttgtcatcaggagcttcgagaggtctggagatggagattcttccgatcgtcgccaagctcccctctgctgctgccgtgcgccctccctctccttctgattctgcctgcgcccactctctccctcgctctctcttctactaattgacgatgaaagaataactcgaggagaaaatacaaatcggtgggctcccttcccctaccttgtaccattactagtaatgtaccattatatagagcgtcttgattcagcggcttagtttttctctctaactccaaataccacccttgatatcataaacttcaaaactcatttttttatttttctttcaattcaattcgttagtgactcaattatgcttccattttcattttcaattcaatttgttactgactcaattatgccaatggcgccctcggagaaatatgaatcggaacggaaggcagctgttctaaggcgatgtggcggcggagaggtgtactagctgcgctggtcaccggttgctacttgcggctcctgcatgcgcgcggtaggatggcagattggttgttggtggcttgatgactgtcattccgatgagggccggatccactggtggcgctccaaaaaagcttcggatctgatggtggtcgttcagggaggtacggtagtgacgctgacggtggccgacgtccaggctatggcggtgccgcttgatggctatcgaccgatgtgatggtggtgatggcgtcggtggtggccgagaaaggtggcagtggaggtggttaccggccggccttgcactccgatgatgtgtggccatgccgccgtggacgtggtggcagcgaggactagcggcgtcggcgctcttggtggtggcgacatagtgatgttgggcggtgtcgggggctagtcctccgatccgtccattcctcggtcacaggaggagagggctggtgacgacggacagcggtgagggactagccctccccctgcaacggcggctcaactaatgggtatggtgatagtggtggttggttggttcggccatggcagtttgtgatgacgatggcggatgctcttggtgttggtgtcctagggatggcggtgacttggcgaggtccggcgctggttctgaccatgaccaggtgaggacaagggatggtgatcatcgatgacggcgctggttgacaatgcaatggtcgttggctcgcccgat

SEQ ID NO: 49779 - DNA, 11135 bp, Oryza sativa
atggtgattgtgttctgcagagggagagatgatgcgaatataggtagctcggactagttctaattctcctctttccccgtcttgcactgcgacggaaagaataagtcttcgatgaaggttggagctaagtcttctcgcttttttttttgtgtgcgtgtgtgtgtttgtttcttttcctcagtgtgaggtttagagtctatgatctcgtgtatgtgttttggctatgtatatcctttgtagatatagagaccggattaatgaaaaatctattatctaaaaaagatttgttggtgactagtattatgacaattatgcttccaatttgttacgatttcactacatgttgtacgagccaatttatttgaaaagcatccgtgcttgaccacaacattttcatcctcccaatcgagatgaacgtatttacaagttgtgcacttgtgtacacacaattgcaacgttttctttttccttttcaatactttgtttgtcggtaccaacacttgaaaattttgaaaaaacgccgccgctagcgcaggtgtcctctaacatcttcctgatcatgcccccactactgatatgttttttctttgagaactactactgatatgttcgtcttgtttttttattcatactagaaaggtaaagatcatttaatttgtatacatgtatcaacggataaataatcagacatgatgaagaaaaagaacatcaatcatacgggaaagcacgatatgtcgtcctgctttatctcaagtagagcaagaattgacggaggaattagcaactttaatcaaccttttcagttggcatattcttttagaaagtatctacgtgtcctgttaaccgtttggtataatacaaatggaatcagatgatacaaaagtgggcaacgatgtacataagatccacacggactttgcgagtctcgttcgcttgctatctccacatccacacggactctcgttcgcaggttgctcgcgagtcatgacccacgcagtctcctacgcataatgggaattggacacggatgacgtaacaaaagttttgacaaaaatatcttccattttataatagtatatatctatacaaatatttaacatttataaaataatttgattaaactttagaaattttgatcaccaataattttttaagtgtttagtttaaaagcagaagaaaatatatacatagttaaagaagtactatcaaaaaaataatccagttttgaaatgaaggggagatcatctcatacctcccgtttagtgttcccattagaatttagaactgtccatagtcatgcatgtgtgtgttggagagctgccttgcttgggggctgggcgcagcaggctcatccgatgggaacgatggacagaaaacccaggtgaccagggaagagcaaggagccttcggctgtgtctgggaaacaggacttatttcaagaccctatcacatcggatgtttaacattaatttagagtattaaacatagattaattacaaaatacattctataaccttggactaattcgcgagacgaatcttttgagcttaattacattatgatttgacaatgtaatgctacagtaaagttattataattatggattaattaggcttaaaaaattcgtctcgcagattagctctcatttatgaaattagtttttttattagtctatgtttaatactccaaattagcgtctaaacatccgatatgatatggactaaaaaagttttagccccatctcttcacgtacaagagggatctggggaggaagacgagtccgatcggtcattatctaaaagaaatatttctatgcatgccaccatgctcgctactcacatgattcctgagaccgactcaatgatgaggcaacgtaccaagcttccagcaacaacaattttaattgttataatagtagagatatgtgagatgagcggaaaatgaacttattttaggatagagagtacatgtgtaaccacactaccataagaaacgttatccatatgaatatatacttacttcgtccaaaaagaatcaaatcctaactataaatctaaccaaatgcttgtttaggggttcatagccagagttcgaggttttttttggacggattacatctcagtggaaatctgacattgtagtatctctgaactcaaatattgtcaaggttccatttacaatactactattgtacaaaacaaagttaaagcacatatcgacacggtagagcggaaacgcctaatgccgagtttcatcatagtccctaaaattttcaaattctacgagaaaacaaagttctgaacaagattgccaaacagcacaagattgtgcctgtctgcgtatcaatcggtgtaggacttttcaagtcaagtttattcagcatccactagcattttttacatcgataagccaaaagttttcggtactacatgctagctactagactgtgacagacgatctgggcgcacacttcctccatcgagacaaatttcatcatctggtagcggcggttcattccccatatccctagtcttgtgcaggagaaaagttcctgcaacgatggtcacaaaaccacataactgtgttgcaatctgtgttgcattccgtgagaatgaatcctggaatagaaaaggcaacgatggccaaatatatcagacaaaaatggcagattgtcagttgaattggaaatacaaaacagttatttgaactcaaaacactcttggtcattgcaagagaacatcaagctgaaaggataatgctgtaactgctgatgggatgtaattttgaaatagtaggatccattgaagtcagggacacaggccaaagcaataagtgatgaacaaccttgtggagttgtggtctagtgagtttttctttttctttttttttatttataaagatggtctagcagattaatttcctccaaatgagttatcatggaaacacctaaataaaagcctggaattcctacacccagcaaaacaaaacatgatcttcagatatagaaaaaaaaaactgaagttcaacctatacatttgaactcgtgagatataaacaaaccttaactgcctaaatcttattatctgcagagatacctggcagttatcataatgcaattcaaaaaacagtttaaacttttttataattctttaatgtacattcagaagaaaataagaaaaagtaaagcaaaagcttcatatattattgataagtttttttttcaaatatatagcttattgctaaaaagtttcttctaatttgtggcacagtgccagtcagtaccagggtttgcaatttcggttgccaccgaaatttcggtggttgccgaaaatttgaaaattttgtgatttccgggtttttcggaccgaaattatttgaacttttaacatgttttgactgaatttgaacgaattttgaccaaatttacaaatatttgagaaaaaaacagaaaattttggggagatttgtgcttgctggtgggggccgaaatttctgaaattttgaaccgaaattttaaaccattgtcagtactaatctggagcgcattttctctcagggagacaaacactacaggaatcacatttgcagatacaattttaaagctatttgaaagtaacaagtacatcaccttgtacataatcatgttagcaaaaatagtaagtatggtgaacatcacgtagtacacaggagagaccacagctgtattaaatgagtccagtgcctgcaacaaattaaatagtcagaactcaaacagagttcaaacacatatttctgcagcagcctttatgatttagaattatcaataaatagtactacgtatctattttagaaataactcacaatttggattattagtgtacaatcatatcttctcctttactttcagaacaaattattgacttgagtagttatgctttgatgataaggattgcaaaaaaaaaaaagacatattccaaagtgtgttacacctgcacttacctttggaaaaactaaagcaaataaagcatttgccatactttcataggagtaaaaaataacaagctggccgtaatatgctagactgcttgcttagtataggttatgaaacaaacatagggaaataaatatatttgagtaattgaggcttaggtcatgtcagacattatagagcgattatttgcatattgagttacactttttgacataagctgaaatgaaattggaagcatagaaggtttaaaagtttgttgcagaatagagcacctcatgcatggccaaacatgatcacccatttaagcaaactcacacataaatgcaaatttacacaaatggcatcaacattatgaatgcttaccttatttaagtagttcaactgcaccaaacaacaaactataacaactactatgaagaaccatgtttggatgtagatgaactgatttgatccaccaaatgacagcttcaaggcaatggcaactgcctttacactgataacctgttccaaaaaccataattgtattaatccacaatcactaaccacatccattcaattaactgaatccaaaggtgatgtatgtcttatataccgtgagagatcccattgttgaacagattgcaatataaacaagcatcttcctgtgtccagaacgttcagcaacccagaaaatcaaaaatagaacagacaccacagccacacatgaataaacaataaaacctgcagaagttatccagataacaaaaccttgtggttaacattctataagaagttccattcttagaacaagtgagagaataagtaaatgctcgcaagagaactttaagatcattattattgggatatattacccaaagttgcaaaattttgcgatggttgtagtcttgcaattttccatagtattggtcaagtcagggaatacattcagttttaccccataaaaaggggaaaaaattaaacatccacattggatacatcgtcctacaattagcagatttagtaataaagcttcctcacaaaaaaaaaagattatgtagtaacacatgaaaatactagtgttttttaaaatgttagcagtacaaaagtatcctacggtatacatattatattaatacgaaaagataaaaatggatcctgttggttctttattgacagaagtattcaagtagtttacctggctcagtagcaagatgccatatttcatctattgaatcaatctctctctcctttggggcatgcaaaactataccaacagagccaacaacacacaagatacagccaacaacaccaaacatatggagtttttctttcaagacgaagtgtgcgagcactgcactgcatgaacaaaatagtaaagaaacaaaaaacatactttgatgcatgagtaaattatagaatgtggtatggatactacctaaatataatgctaagagctcctagaggagtaacaagtacagcgggagcaaatgcatatgctgcaaagtttgctacctcgcccagaatcactgcaaggtaaaacaagatgattaggaataacgtttgagcttccggttcatatcacaaatattggttcacatctaagtatcagtatccagtatgttgatttgaactctgtattaatgagatggctaccctttttgaaagtgaaataatcagaaagggaaatgtaaataataattataataataggatagatcgcagcagtgatattgaattgcagggcatgatgctcataagcactactccctccgtttcacaatgtaagtcattctagcattttccacattcatattgatgttaatgaatctagacatatatatctatctagatttattaacatcaatatgaatgtagaaaatgctagaatgacttacattatgaaacggagaagtactttttagcgattatattctgcagataaattgctaagttgaaaaccatccatgttttttttaaaacaaaggtcctaatctgagtatcaagtgttcagaattaagctgatccaagatttgctttttctcaaactttgcaaaagtacctactccggattcctgaaatcctgaatcatatgataatttaattgaaggatgtaaatcatgtggattggccctaggattactgtactggtggtggatctacacaaaacttaatgctataattatagcattcagtgattatgcttcacactaacccatcatccaccatttttttcttctattttttatggttgaagtaaacaacaaaaaagtgaaccagtacctatattcaactaggacttattactcaaggtgtgtgacacaattcagtcagtagtgagcagcaaatccacaatgcagaatacttgattttttaaaaaacatatgactagaatacttcaaaaggcatggttctaatacacacttactagttatcatccccaaccaccataatggctcatacaagtatgagaacctccagaacctacagtgcatattaaaaaatatgaacaagtaatactacataaaaggctgaaagaattcaaaactgcacttgaaaacattatgcaattctacatataaaaagcatttgtttgcaatgtcaaaagttcattcagtttatatagttgctggaagatgtacaacctgctcttaccccagaatccccagccttcttgagcccaattttcttgataataaagcttgatccgataaatgcacttgatgatatggccagggtcaaccctctcacattgtctatagatgttaccatgccttctggaatgagaacctatgaacctatacctacaatccaaaatagtctaatgaagaaaacatttcatatattgaacttgtagacagtgatgttcaacctcaggttgcttttgcattaactcccatgtaatctgtagagaaagtggaatagatgcctcaccaatgtggggaggtgaactctcatatatatatatagcagaattacaatcaatactagggagttacataagaccaaaggtctaggagagtaactatctaggagtgtaaaagtttaggagataaacagcctatagattaataaataatcctaatacccgcccacggtcgcagcgggaggagcacgaacgcacagactggaccgaaaatcagtaaataactgaaccggcaagcctttggtcatgatgtccgcgaactggtgcgatgaagggacatgaagtacccggacttgtcccaaagccaccttttcacggacaaagtggatgtcgatctcgatatgcttcgtccgtcgatgatgcacgggattcgctgtcatgtaaacagcactgacattgtcacaatagacaatagtagccgaagcaatcgggacatgaagttccagtagcagttgccgcaaccagcagcactcggcaacggcatgagcaacggcacggtactccgcctcagcactggaacgagagacagtagtctggcgcttggaggaccaagaaaccagattgtctccaaggaagacacagtagccggacgtggaacgacgagaatcgggacaacccgcccaatccgcatcggagtatgccgtgagggactgaatcgggccggagccgatgtggaggccggtggagaggctgcccttcacgtaccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacaggcaggccgtcggtggcggagagcttggcacgagtgtccactggtgtcgatgtagaatggcactcggccatgccggcccggtgaagaagatccacagcgtactagcgctgcgagaggaagaggccggcggaggagcgcgtcacagagatgccgaggaagaagtggaggtcaccaaggtctgtcatggcgaactcggagcggaggcgagccataagctgctgaagtagtgacgtggtcgaagcagtgaggatgatgtcgtcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttgagaccatacagggacttctgcaatagacagacagcatcaggggcagcggggtcaacaaacccggagggttgctgacaatagacggtctcctctaggtgaccatgaagaaacgcattcttcacatccagttgatgaattggccaagcacgggatgcagcgatgctgagaacaacccgtatggtggccggcttgacaaccgggctaaatgtctcgtcgtagtcgatgccatgctgctgcgagtaaccacggaccacccaacgggccttgtgacgagcaagagtgccatcagagtggaacttatgcttgaatatccacttgcccgtcacaatgttggccccaggggggcgaggaacgagacgccaagtgccgttgtcaaccaacgccttgtactcatcagccatggcagtgcgccagttgggatcagccaacgcactgcgataattggccggaacaggagaagcagcggtggcgtgggtagccgtgtaggtcagcctgtcaaccggccgtaaggagccagtctgggagcgcgtcaccatggaatgcggctgaggagcagtagccgtgacaaccacattgggtgaagatgatggcgggaccgtcacggtgggccgacgggtgtagacatggcggaatggtgacatggtgccggctcgggtggcaccgaccgacagggcagcgccgatcgaggaggcactgaccaagggcgtgccagctgagcgggcgtcacgtgccgcagggacggtgtcgttcggcaagcgtcggccgaagaggggaacgtacggttgctcaacctccgtggagggagccaccgtaaggcgtcgcggttgctcaacctccgaggagggagccaccgtgagaggtcgcggttgctcaacctctgatgagggagccaccgctggagggagtccctgcaacaaaaaatcaaaagacgagggagcagggggagttgccgcgaagggaaatcgtgattcgtcaaacacgacgtggcacaaaatgatgatgcggcgagtggagagatccagacatcggtatcccttgtgggaggccgggtacccaagaaaaacgcaaactgtcgaacgaggggcaagcttatgtggagtcgtggcactcaagtttgggtaacaaagacagccaaagacgcgaaggtgggagtagtctggggtggtgcgatgtaggagctgaaaaggtagtgagtggtgaacagaggaggagggtctccggttgagaaggtaggtggcggtggcgagagcctcagcccagtaggaaggaggcatagaggcctgtataagaagggtgcgtatggagttgttcatggtgcggagcatccgttaggctttaccattttggggagaggtgtaaaggcaagagagtcgtagctgggtgccacgactagtaagaaaggaagtggtggctgtattgacaaactctctgccattatcagcctgaagggttttgagtggtaagccaaattgggtggaaacatactcggcaaactcaacaagatgacgatgaacatcagatttgtgtcggagtggaaaggtccaacagaaatgactgaaatcatcaagcaccactaaataatatttaaaacccgaagtactcaacaccggagaggtccatacatcgcaatggacaagctcaaagggagcgaaagtgcgagacaaagacctatcgaaaggtaatcgggtatgtttgcctaactgacacacatgacataaagaggtgtctattttattacaggaaatagaggacatattccgaagactgtggatggcggctggaccagggtgactgagacgacggtgccaaagcgtggaagaagtggcgagggagcaggacgcggtgttggagggagtggcagctggaagggtgtagagttccccgtgactattgcagcgaagaatcacgcgccgggtctgaaggtccttaacagagaaaccaaattcatcaaactcaatggaacatttattgtcgcgggtaaactgacgaactgaaagtaaattacgaactaaggaaggggcgacaaggatgtttttgagtgcaaatttggtggttcctatgggtagaaaagaggtgccacgacaagtaacgggaatagtttgaccatttccaacagtaataaaagtgtaagagttaggcaagcgtgtaacgaggataccatcagtggaggacatatgagatgtcgcgccggtgtccaaaacccagttgtttgggctttggaaggccatctggttcagtgctgcaatgaggccagcttgctcccaattgggctggcctgtaggagcagatgtgggcgacacaaatggcccagcatatgtggtattggcctgggagtagtgggccgtcggagccggcccaagaaggccggccgaagaggggcgccaggcctgttgctgggccggccaggggttaaaacaaacccaaggcccggccagcctccagctagggttggccacccagccggtcgaactccctccagcagagaagccgccgccaccagaggaaacgccgccgccaccgccgccagagaaggcctggcgagcgccaccaccacccccactgccgccgccgttccctcctccatttccaccgccacgtccaccatttcccttgcggttgcggcggttcgtgttgccgccggtgcgggcctggccagcagggaagccgccgccaccagtcccaccgcccgggaaggtctggcgtgcgccgccaccactcccactgccgccacccccaccgccagaggagatgcagccgccgggagggcaggaaccggagccgaagccgccgctggccaccagcgccgtggctgccgccaccctggcttcgttggcgatgcgcaactccttcagcaggagggtgttgcgcgctgaggtgaagctgggaggacggctgcgccggcgatgttatctccggtgttggagaagcgctcgttcaggcctcggaggaggttaagcacgagttgggattcggtgacggcgtggccgacgtcgcgaagagcgtcggcag

SEQ ID NO: 49780 - DNA, 2316 bp, Oryza sativa
gctccatggcgaggtcaaggacgttgtcggcgactgacccgaagatccagctgcggatgcagcagtcggcctgttcccaagccgggtcattggggcgtggaggagcggaaccgtcgatgtgagccatcaacccgaacttgccgcacaaagatgtgaagaaggccctccatttgttgtagttcgggtgggtgttttctagggtgatggggacgtgggatttgacggcgaccgtggcgtaggggtggaggaattcgctggtggtgctggaagaagaagaaccactcgaggccgaggaggtggaggactgagttgattcagtcgacatggctgggatgcagctgtgatggcagcgtgctagagcagcggaaaagaaggtaagagcctaggctctgataccatgtagagaaagtggaatagatgcctcaccaatgtggggaggtgaactctcatatatatatagcagaattacaatcaatactagggagttacataagaccaaaggtctaggagagtaactatctaggagtgtaaaagtttaggagataaacagcctatagattaataaataatcctaatataatccttaagctaagagggaagataggagcaactagatgttggctgattacaaacaattgtttgtttgaccttctgaagatttcataatcaaggaataaatttgatttatttatgtttttcaatgaaattatttatgttcgaatgctatggtgcaaatccattatgagaagaaactggtttagaaagtgatacgtttctctattccttgctaaagcaacatggaaaggactgtaggcttcagacctctccaactcatagaacatgccagagaaaagaaacacttaaaggaaatacttgcataaaatcgaatggtcataaatgtgtacagcatggaatggggaagcagcttttgcctgttgatactacaaccaaaatgtaaggaaactgaactttgagacaaaactcgatctgtctactgagaaaaaaaagtagtataataagcatgacggaaaaatatcaaatcgtaataagcgttctacatggtgcagaacatagaagatgacaaaatccatgttttgtgcaaaattcttctttggtagaaattaaggagatctgaatttgtatttcactcgacagaaatgaaatgaggacatatagcattagcaagacacagggcaacaactttttttttttagataatggattaaaaacccggcctctacaacagggcaacaactacaagcaaccctgcggaaaaagcttccccaaggcagattgctgcttaagtgataatgccttacaacctgcttcatcgcatatttgcagcacaaactactacaagtagcagactttggcatatgaaaagattttttttgtcctttgagaaatgtttcctatgaaagagagaattttcttcttaatacatgtacagcacatataaggctgtactcatgaatcatgatcaaagcattcaagatgccaaaacacgactatggcttttagttcatccctacatgagttaccaagaacactacggcacgataattaaatttacgattacaatctagcaaaggaaagcacaagaaaccacacggattgaaattcaagaaaacactagtgcccaatacttgtaagataacagaaagaaaaatatccatcctctacgtcaaaagattacgcaggcacacaacccaacattaccatcagaatctccttacctcgaaattcagcaagaaaggaccactagttccccacaagctagcaacggaaagaaacgtagatgagattatgagaaaacaagagcacaaccggttgataaccacaaggattaaagtgcatgttattgccagcgattctgagagctggcacgtgaaggttaagggaacttttgaccacgccagccatgcacaggaaagaggagaaagctttaaatagacgttaagaatgtcaatgagcacgagaatgagggaagaacaagtggaaattaactgccggctacaattaataattgctttgccagattaaatcaaatcttgtgcaaaggaaacggagagaaatgtgtagtagtaactaggatcattgctttgagcggttaattaccatcgacttcaattttaaagcaataacgaaattaattatcaaagcacggggtgagaaagaattaaattcccatgaaaacgtttgcttgctgctgaaccatccatgcgtaaagcaagccaaaaatcacggaacaaaactgacgtgaacttgtaaccggtggcaggcaaagcgttcgaaacgaaaaggggataatccaat

SEQ ID NO: 49781 - DNA, 7346 bp, Oryza sativa
ccgaatcctcagacaacatagaacaaggcaagaaagattagtcccaaataatagcctaaaatgtttgctcaaacatacaaataattatttttttaaaaaagcgtagcgattgggcacttcgtccacactaattcatcgggagaaccaatcatcaccgaccgaccgactcgtcgtcgtcgtcatcagcagcaggagagaaaaaaaaaacgaatcaaacatatacaaccgatcgatatattacaggccgggcgtggaggactccgggcgggcaaattacctctccgatccgcgagcgcgcgcgggcggtcggcgaggcgtacgtgcgggactccgtcggccgcctccgcctgcgagacgacagagagataagaagcgcaacgtacgccgtcggcggcgtgtgctccggcgggcgggggtgggggggactacccgtgcgtggaggcggaggcgtggcacgcgtggagaacgcggggcgggagaagcaaagacagggacgggaagggaagggaagggaagcgagacttgtggcgggggaggtggccaacagcgagcggcggaggggagagagagggggagagggagggggacgctttttaccgttggaattgctacggccgcacgaaagccagaccccagaccagaccacctctcgccgatgccgggccggtctttgggccgaatgggcgacatcgataagaatttatttttatttttaaggatataagttcactttaggtctgggaaacgctttataccgcgcgtccgagcgaatcggaaatatcagacgcctcagcagatggattagacgaacttctttcctcttctttttaaatattttttcttctaaactacttatccgatctacaaaccgatcacaccgttgtattcgtttcaattaaatctttacaataatatatcatatgtgttgacgtttgatgtcgcgattccggtatttccatagtgtggggatcgttggtactaggatatatgtgagactgagataaaagagatggagacggggatttttatacaggttcaggcccccgaattatcaggtaatgaccctacatcctgttggccgaaatcggtgttgctctttattcatctggatcacacaagtacaatatttgaggtagcatatctaactgttgtcgacatggcggtctgaaggtctgactcgtagtcgacaacagggtagcatttctcctcgaatccgcatccggcgagatcagagacagtgctatatctctcctgacggtatccgtaggctccgtaggggactagccatgcctgtctctgaagtcgatatctgtcgtcttgtcttggcgtatgttggcttgtatgttgtggcttctgttgttccgtgtcccctctcctcctagggggccttgtatttatacccataggtgtcgccttgtccaaatagaactagaaaaaccaatatggatacaatccgagtagtccttgtcgtttccatgtagaactcagttgtctttccttatccggaactccatccatatccgaaggttgtttccgtataagacattgtatgtggtgggtcctaccgagatttagtcaactgctattaggtatgtggtatccataaccctgacaatatgattatattatatcaaaagaaaaacatatgtttcaaaccgttaaaactaaatgtttcatacatgacagtgatatgtttcaatgtgcgtctgcagtgtgttttacaaaactcctgatactacctgctactactctctcactcctctctctctccacttcatccatgcacacatgcatgtattttagcaagcttcaaaatgatttttctcaaaaattacttatccaatatatgatccgattagaccattgtattcgttttaattaaatctttataacaacatatcgcatgacttgttgtttcatacgtggcagcgacatgtttcaacatgtatcttcaccatgtttcataaaatatttaaatgtttcagttgctgattttttttttcaccatatataacttaatgtttcacttgttggtcaactgcaacatttgaccgtctgattttttgaggagcatcggacgtccgatgggtagctttctccctttaggtctctcactttgtcaccgagtcttagattcgatcctggaccacaatacccagttctcttctccaacaaaattagataaaattttggatacttgtggcagtctttttaaactgctaaacggtgtgtttcgtgcgaaaactttctatacgaaagttgctttaaaatatcgaattaatatatttttttcaagtttgtaatagttataactcaattaatcatacgttaataccacatcgttttgcgtaaaacactaaatcttcatctccaaaagaaaagaacaccacccgtgtaaagatctttatggcgggtccctcaactccccaaaccaatgtaaagatcccaaggtgatttggacgacggtttcggctgacgtggcacctatgtggtgttgacaaagtcagataaaaccgtggggacccacatgtcagtgagggttcaattaaaaataaaaaagttgcagtgggacccacgtacgtagtggagtgatctctacaaggaggtggccggagggaggtgatggggtgcaccgtcgtgtcatgctgcttatcgtttgtcgtggtggagcttgttgtcgttcgcggtgccaccgctaggagaaaggagatggacgagctccacacctaggtcgacatcgtgaggaggggctgaccccctggtcagcaacaaggcggacggaagactggtgtaggtcggtacggcagtatagattaggagacccaagacgaccacggcggctgctagcgtagccggttggagccagtgttggtgagctgggcggcaacccagatctagagcctgttgagggaggcgcggcggaggggatgtgctaggggtccagggcacgccgaccacggtgaagtgactcagggtgcatgcgaagatcgataggtgtgctatttttgttaattcaaatctctcagttcactcgtggccgttgacatgtggagcatcgcatggtggttctcgatgacggaggtgggtgaatccaccgtcgcggccccagcaaccccaccaccaccacttgaggaggcggcggaggaccataggggaacagttgtactgatagagtacttgtggggacccccggttttatacaccggtaatcccatgtgtcatacagtgccactccctggatcagtaggtggtacacacatagcacaatataatatcacaactgacatcgtttacatgtatttctacaataaaaatacaagggtaatctcattgggtcccgaaatagaccaagcatggtcacttacaatacaaaatgccaaagcaatagatagaacagcggaagcgaagcagcggcggtccatcgaactccacaagcaacgactggtgaacctatggtccctaatccatcatcttcaacatgtacttggcagcaacatggcataaatctaatcgacgccaactcctttctaaaagatttaattaagcaagagtgagtacatgcgtactcagcaagccaccactaagaaatgaatctagtgcacacaggggttcaaggatggcttggtttatttgcataaagctagttttcacaatccatttaacaaacctacgacatagcagttttaactgaaaaacaatgttaatgttgaagttgtaattacctagggttcatccacctctccaagcctcgcttggttcggtttaccctcacatttcatcttatatcaactctactatactaacattcccactctttgggcaaggttcacatgtctcttatatttactctaagtaggatcaaaatctatgagtctagtcaagggtattagccgcgagcacggctattcgaatagattggtttactcacactgcagtggatgtacgcttttaatcccacactccgtgacgcacccagcacatgagacttgtcacggctcgatttttcagttacccttgcatggcggcacccgctccaaggactatgaatccccattgcacccccggcgccacattcctccctcgagccggttgtgaggggagtcctggcgctcccaagatcagagattacattatacatatatatagttttgacgtcattaaaccacatacttccacatttccataccaatgtccagaacctaccatgtctggggtgccaccccacgagaataacctagtccaccgggtctaaccccgctcaagaagtgtggtcgtactcggttcgtttcctgcttagcttcttgactcggtccttaactgagcagggtcggcgactagccgttttcagaaccacccatattctatccatgccaccccagtcgaaattattttggttttattaagttttcgggtttcgcaaaggttttcatgttatgggtggcgcttatgtctccacccaattcccaataatcactcccatcgagtgatcagtataaccacatccacatattccacatatggagtgtaaaacgtctatgtaagcagggctaagcagtaagtaaataatcacgtgtaacgtaatagacccaggtaacaaaggtatgtaaatacataaggataacaatatcaaaggtaggcttaaacaattgtaggtaattttataattagcatgcaattttatttgtaatcaacacatttataaaaataggatcaacatgttcaaggagggtgcgtagtgacttgccttgctatcggtcctaatgtcttcgagataattgctccagttagataactagaattcccacgatcgaagaataacccgggtattcgcgctcgataaacggctaaataaaccacacacaatcctaaaagaattaaaataaagcaacattcaatacaactaatggtgccgttaaatagatctcgattttagagagattaccgaagttgaacggagttgatcggaattacagttggaaagatatgaattttcgaagttgggaagggcttataaaccgttgagggaacactcctcggttagggacttgaatcagactttatgagaggctcggagttgaatagaggatgtaacatggactttagtggaaagggaggccgacggttggctatgcccgaatgttagggaagggcattacctagactttgatagcagactcgatcctttgggcttggacagagcatagggaggtgatatagacttccatgggggaagtcaactcagtgaggaaggggctagaacgtgggtcccttcagtgggtcccactcctttcttctctcctatcctctttctctttctctcgatctcatccgctctgctctctcgtttcctcctcgcgagcgccagagggcgagcggccatagcggcggcttggcggcggcctgggggcgacggtggcagggcgacgctcggtggggaggcggcctggctagggcgctaggcgacggggcggcgcggccgtgggcgacggtgtccggcggcgcccggagggaaggcggcatggcggctgggcggctgggaagtggagagggccggcggccaagaggcggcgtgtggcggcggcctagcgcagtgggggaggaggggccggcggctgggtgacggcggcggcctggcacggttggccggtggtgagggagggagggaaggcctgtggtgggaggggcgacggcctggggcgtcgtcttggaggcggcggtggtgaaactggagtggaggttcggcggtgaggagatggagaccggcgatgggaggcagtggagatggaggggagggccggctgtgatggggacggagagggggcggtcgatcggcatggcgccatggtggagggaggcgacaaggcgacggctgattcggtcaaggcgtcgcggctgcggaggtgaccgtacgtcggcgctcggcccggcgccatggcggcttgggtcgggcgaagacggcggtgtaggttaggaggagaaacaatgatgccgcgcgtatggcagggacgatggcgcggccactcggcggcgtcctgggcgaggccaagacgtcggggggcagcggccggacgtgtcggcgcaggcgatggcctagcgacggcgcggcggcagccaggctaggctactaggcggcgcggccgggcgcgtgggagagggttggtgtagtggcaggggagtgacggtgcgcggtccggctaggcgtcggccacgcaaggaggtggcgacggtgcgcacgatggtggcaccgcgccgagacggcgacaagtgagtgggaaaacagagagagggcggtcgacaaaactaggaaagggagagcatggaagggaagggggaagatgctcacattgcggtagccgagtagcggcacaccgtgcgtggtcgacgggcgtcgacaaccggctcgcggatcatcctaggcttgctgttcgtcctcgcacaccatgtgttcgatcgtcgtcaacaaaggaatacataatgctaagggacaacgtcagcgggttagtgcaaggtaagagttagggagttagaagttagcgaaacggaaagtaaaggagtcagcgggttagtgagttaggggttagcgaatccaaaaagaaagagttagagagtcagaggttagcgaaactgaaaatggaagagtcagtgaaacagaaagaaaaaggttagctggttagtgagtcaagggttagatgttaaagttagtcgttctcgggtgatcaatggtgcggcagcctatccgtcctcttgctcaactgaggcccagccggagccggccgcggcggagcaaatggagggatggcagcttgtgcacgggactgaggagtgcagtggcagagctcgagcgtggaggtggagaagaaatggagaggagccgagctgctgctgtctttggtggggtttatataggtttgctggctgcctgtgcatgggaggcgatgtgagggtgggcagggagcagtgccaaaacgtcgacatcgccacactaccaggtacgcatggcccatcgtacttggctttgccacctttcggtgtgatcttggcgttgcccttctcagtgaacttggttctgtggttgcatgtatttggtggagggttttgtggattgggttcatggtgaatgtattgctgctgttggggagggctccagggcatttgatggctgtgaatgtttggtgcaagactctgtgttgtgccggcaaaagtgggtgtgaaaccctgttgtggcttgtgggcaatttatcgaacatgttctgtgcatgctgctgttctgagggaggcaaaatagacttctggtggttggctgagaaagagagcatgagtggctgccaggtcggctggggagggaa

SEQ ID NO: 49782 - DNA, 3147 bp, Oryza sativa
aaatcagaccgtgaagacaagggaaggaaaggacgttggactgagggcgtccctttaagagataagatttaatcgagatctttggcacacaacctaaatacacacaaatgcataataaatcctagcatgcaaaaaggttttaaaaagatttttgattattccgaatttttaatttcgtattttagaatcgaaattttcagggtgttacagtactccaagcccaccaccaccgcgacggaagatgccatggcaagaggaggagagagatcaaaacaccaaactagttgctgttgtggcagccgtccttcaccatcccgcttgaccccatactcgttggggtggcacgccatcataaatttcacgactgacagtgacctggtccttaaatcgcccgacgagagagtgtgcagtggggagagcagtggcagtgagcgaccaggcgcacaagtgtggaaccaacctcgcgagccacgctcggagcccaccgcggttcctcctcgccgcctccacctctgtgtcggttgtgtcccgacgatgatgccagtgacatgttgttctcgtcatcttcccctcacctcgtcatcccgattctcaccttcctttttgtccacctcgccaccgccatcattagagtccgtgggcggggaaggtcttcgtcgatggtcactgtcagtgtccttcctccttcgagctagcttctcctaccagttgccattctcctaaccactcgccgctggccttctcctcaccgctcaccgcctggtgagatgggaacaggggaggaagagagagataggtgaagaggtcttgatgggcccacactgactcggtactattgatttggatgtcacgtcaaacaaaaccacccgctatactatcatgggacctacattgcatcagttttgacaattgagggactcggtgtatatggtatttctgttgaaggatgaaaatcgaacttgctgtcaagttaagggactaaaatgaacttattccttatttttatagtttgtgtaaatttcacaaaactatagatattttaaccaaattattgcaaaactatttaaggtattgtgttacaaagcagcacattagggctaattttatcataaaaggctaatgccataaaactacatatttaatagagtaaattgcgtgttgggccacaaattcttaccaaagtttcacttttgaccaccctttgttttttttaaaaaaaataggctaggtttttttgccaaatgtatcactttggaccggttggctcatatatcgatgagactataacaatctctattgtccatgtgtcagttacatgtgggccactcgatccaaagtgcaatttggccataatacttagtccaaagtaaaaaaagaacacagtaagagtgatccaaaataaaactttggtaaaaatatgtgactcaaagtgcaatctactcaatttaatattgaagttatcacagaacaatgatcttagagttcaaatccctaacaccaccattatgttgaggttataaacgttctagttttgtgattaaattggcaccaaccttgtagttttgtgataaaatttgctacttaatatatagttttgtgatacttcattttaaatctgtagttttaaatttgacgctaatatatatttttgtgttaaaataccttaaatatatagtttttgtcaaagtatatgtagctttatgaaatttactcttaaagtttttttaacactatttaatatataaaactatatatactcctctcatcatctagaagggttaattttcccatcatatactgtagtcttgtgaacacagcacacctatcacttgtcccgtaataagttcattttttataatcattacattaaaatttgtaaaaatagaaaataactatatgagagtagataaaatgaggaataattatcttgagatttaataaaataggggtattcaagtcattttgattttgtattggtatgatatgtgaaaaataaactttttcttaagaaacacagtagccttgtgaacacatgcacacctttcacttgtcccataataagttcatttttgtaatcattgcattgagatttataaaagtagaaaataattgtatttgggatagataatatgaggaataattatcttgggatttaataaagtagggtagggatttaataaagtagggtattcgagtctttttgattttgtattggtgtatgcgggataggtgaaaaatgaacattttttttagaaacatagtagccttttgaaggcacacacgttgacaagcacaccttatgagctgactatgggtacatcacctattattttagaattagctgtaaataaaaaacgttatgtctaagacttaaatctgggtaaattgatttcaccataagtatcctaccaagttgagatactttaacctaccgaaggaaacagaaaagccggagcttacggcgtccacatacggtgtactaaggaataagttcactggaggtccctcaacttaacagcgagattttttgacgtcccttaaccgtaaaaccagaaatcttcatccctaaactatacaaaaccatccaattcaggtcccatggcagtagagatgcctggtttcactgacgtggcaccctagtaagcaaataataataataataataataataataataataataataataataataataataataataatgtggggcccacatgtaagtgagaggaaatgatgtgggccccatatctcctctttcttttccttctcttatcttttctccttccctcacttctcttgagctggtgcgacagtggagcgggcaaggggagagagacggccacgcgacggcaccggcaggacggggggagagaagcggccagcgcaaccgcacgcgacggcgagagaggcgggtagcgtgggcatggagcgggcacgccgacccatctgctgggcggcgtgggcagcgcagagagggggagagaggcggccggcgcgaccactcctgacgacgagagaggcgggcggcacggagcgagtgcgctgtcccatccgccaggcggcgcggagagggggagagaggcggccggcgcccggcgctaccgctcgctccggcgggagacggggagaaaggcgctaccg

SEQ ID NO: 49783 - DNA, 21316 bp, Oryza sativa
  unsure (1)..(21316): unsure at all n locations
aggcaggcggcgcgggcgcggcctcctttctccccctctcctgccggcaccattgcgtcgtccgcctcctctcctccttcttcccctgcgggctcgctgcgccatccgccgcgcctacccctctcttgccggcgccatcaccgtccgcctcatctctcccttctccgccgtgggctcgctgtgccatccgccgcgcctgcccctctcccgccggcgccatcgccttccatctcctctcccctttctcccccgcggtctcgctgcgccgtccgccgcgcctgcccctctcccgccggcgccatcgcgttgtctgccttctctcccccttcttccgcgcgtgcttgatgcgccggccgccgcgcctgctcgagagaagcaaggaaaggagaggagagaagtgaagagaaaaataaaagaaagatgagatatggggcccacatcattttgtctcacttacatgtgggctccacatgtttatttattttattttgctgactcgaacgtcacgtcagcgaaaccaggcatctatactgtaatgggatctaaattggacggttttgtacagtttaagagtgaagatttctggttttgcggttaagggacgtcgaaaaaaaatctcgctgttaagtttgagggatctccggtggacttattccgcgtactgaaccttccgactcaacggggctcgaaggcccaaaacgccgctcaaaacggggctccaaggccaaaaattccgcggagagcagctggcggccgtccccgttcgcgtcgcatcgcagcgcagcgtacgcgtgcgtggtgtgtgccgtgccctggtggtggtggagccagccagaattcaagctcgagggcgaggggcgaatcaatccgccacaccgcaccgcatagtgccgcgtcgcgccgcggccgcggggctccagatccggagccgtacgtataacccccctcactcacaacacaacacaccctctcctctctactgttccgccacaagaccccagggcgccgccgccaccgccaccaactcactgggtgagccgccgcggccctaaaccctagcccagcgcgcgcctctcctcctcctcctactccccccatggccgcgccgcaggcttccccgtcgccctccgcgcaagtggtaagctgcttcggtcccctgtctctctgtggttgcgagatttggaggggggtttttctcgccgtggttccgtgctgatctgcaatggcgggggggactgggtgctctctctgcaggtgggcaacgcgttcgtgcagcagtactaccagatcctgcaccagtcgccggatctggtgtaccggttctaccaggacgccagccgcctcggccgcccgcccgccgaccgctacggcgacatggtctccgtcaccaccatggaggtcagcccccgccgcctccagatctggcgccgccgcgaggcggaggcctccatttctgacgatttttttttaattttctggttgggatggtgacacgaagatgggggggtttttggtgtggttccgcaggcgatcaacgagaagatcatggccatggacatgtcgcgggcggagatcaagacggtggattcgcaggagtcgctcggcggcggcgtcaccgtgcttgtcaccggccacctcaccgtccgcgacggcgtgtgccgtgaattctcccagtccttcttcctggcgccgcaggagaagggctactttgtgctcaacgacatgttccgctacgtcggggacggccctacccctgctgctgctgctgctgcggaggtgcagcccgaggcagatgccgtggctccacccctggctaatggtacagctactgctcctctgcagcctgctgctcctgactatggtgtgtttggtgaaacccttaaactctatatagctttttgggggaattagattgtgatatcgatttgttttcccccgttttgtagatgctatgccgcacgaggagccggatgttgtggagaatgtggcggtgcctcctgaggaggaggaggaggtttataatccgcctctggaggaggtggagggtggggctgtggaagaggaacaatcagttcctgaggtgattaatgaagtcccaaataatgtggtgcccgttgtagctcctgcagatgctccggtgtcacacgaggaggcgccaaagaagtcatatgcctcaattgtaggtttcacaaaagcaactttctcaaatttcgagctgtattttgcttataaatttatatctaatcatgaatggtgttttaactgttttattccatatgatttgcaattgtgaaatgcacactgctactctgtaagctactccactccaaatgtgtagttatgcacaaacttttactccctccgggctgataatacttgtcgttttggacaagggtgaagtcaaactttagaatatttgattatgaatcatttttaaaatatttatctttcaaatatggtgactacatgtatagattagtcttaaaaagtactttaataagatcatatatttgctaacaattttatacatattataatgaaaaataattgtcaaagttgttttttgaagaccgtgcccttgtccnaaacgacaagtattatcaacccggagggagtagtagcttagcgtaccactgcactaaatattctgtagtcttatgaggtgcttcttattgacaagtttttatgtgatgtcatccatacactagatctagactgattttgtgcattataatgttttgtcttgatgtcgcacaatctgggagcattaatctattgatggttgaccaggaagaggcagtgctaaagttgaaaaattattgtgcttttttaagtgtagtgcttcaaataaatattagtgacagctttcaaataatttgagtagctttttactgttggccatgatggttgtcatcttgtttggtagcaggtgattggattgaaccattgctcaaatcaaatttttgttctgcattctttgttaatggtatcgtattttttcctgtgctgcaggtcaaagtcatgaaagaagctccagtgccagcccctattcctgctactaggcctgcacctgctgctagacctgcacctcccaaacccgagaagcaatctcctgcccctccggctcctgctccagttgcagatgctactccttttagttctaatgctgagagcagcaatacgcatgagccagaaggtattttctacaatcctatgctttgatcaatactctagatatgtcaattctgttagcttctctgaactttggtctttattttgaagttgatgcacatgcgatatacgtgaggagtctaccattaaatgccactacgacacaactggaggatgagttcaagaagtttggcaccataaaacctgatgggattcaagtcagaagccataaggtacttgtttttttccccttcctctggactttggaaaactatctatgttattctgtctctgaaagtgttgtcaatattttccaatgtaaatgcagattcaagggttctgttatggctttgttgaattcgaggaagctactgcagtccaaagtgctatagaggtagtctttcttagttttgatcattccattttgtcaggttgtttggtgatagtatcaatttgttcatcacacactaattttgatccaatactgtgagcattgttagttcattatcactgcgtgcttttctttagctaccaacagctcttgttgcttgacattatctggtgatgactgcattacatatcatatcttctctaattttgagtaacttgtttttttgttgttgagtggacaccatttatctttacgctgttctgaaaaaaaccattcttttttttttgttccacaactggtctgaaccatgaagcactggtcattgaagagcttagatatgggcaaatttttgtatatgcctgcatgacaacgtaaaatattggatctttccctgagaaactataggtctggctatcactacaacacattgggctgtttaagtattaaacataatattaactcagcaggtaggagagtgcgtgtgaaatggctacctttcacatacacatgtaaaaaaactctccatctgttgctcccattgtaaccaaggttccaaatactgctttgtctggaattatcggtccctggtgaaatctgtactgtatataccagacaaaagttcaagtgctggccagaaaatttctaaatttaaaattttatgtatgagtttgaatcacagccatccagccagtaaccaatcaccccctggttctggaccagtttctggccagcttttggaaccttgggaacaactggaaaatattgctgtggctaaaactattttagaatcccatctgctaactttttgagaaattgctggaattattctgaatatccaattaaggagataaaattgcttattttggctaatgaatggttaattgtgatttgtgggataacagttatttttaacttaaaatcatttatttggaacccttaatttatatttttattggagtttttttcatatttctttactagattaataatccaggtgtaattagggatgtgtgggatcttctctttccaaagaactggtgagcattttttttaaaaaaaatgttttcatgtgttgtggcaaatgaattccatttttggagagctgaaccaaagttttggtgtattgtcaatcccaacattatagttattgtcattgttagcttcgtagatattgctctacgttacataatgtttccactgcattccacccaatggatcagaattatttgttgtgaattctgtaattttgttctcagttcccgatgttgtctggatcctactctgagtttgtattgttcaggttgagctaatcatatcaattcaattgcttccatgatttgctttcaagtttccttaacccttcaacaaaggatatcacttgttatgtgcagtcatgctctgttgccagtatcattgtgtggtgactttgatgtggtttacctttttttacttggtcactgagtattatatacatgcatcaaattctaattgtttttaacttcacacaggcttctcctgtaatgattggtggacgccaatgttttgtcgaggagaagagaacacctggttcacgaggtcagtgtaacagaacactacatgtttatttcttttttcgagttattgtaagtgtagcattggagcatacttaaatgtctgactagtctaaacaccagtagtaatggaataatggtctgcagtagtaattgaaagaaaaagaaaataaaatgaataaatagaaaaaggagaaagtcatcatagttggaaattatcattggaatgtcttcttaatcataggacatgttggatgggctaatttatgttgtcatgagaagcgtgactgcacattttgtgagttcttcaaatggactgcaaagtcatttttgagggatctcaacactctatatctagctgtctagcaaacctcatataatggtagttagaatgttggcacctgaagaattatttccactatatatgagctcaacttgttccaagttctcatcttactgatacgttgcctcaggatccagcagaggaggaaggtttgcaccaggaagaggtaataacaacttcagagctgacgggatgagaggccgtggcaattatagtggaggaaggagctacggaaggggtgatttcagttacagatctgattatggtggcagaggtggtggcagaggtggctctgcgcgtggacctgatgttggctaccagagggttgacggtggtcgtggtggccgtacatcagcaggccctggtgcccctgcaaaatgaggggcgaagtagcttgtgtctctagtattatcattccatggtccttggaatgtccagattcaacataggcttcatcaattgattgcatgctggaattgtcaagcccaatttacaaattatgaggttctatttttgaaggcggcaaaaggggttaaattggttgctaattgtagaatatacacctattcacatgtagtcttagcttggtctttgatgatcagctgatgtgttattttttttctttttgtgttaattttgtcccgtttaagtttggagcattcatttgttgtgtccatttgattttatagttactacgaactgctgaaaatttgattttatagttactacgaactgctgaaataattgatagtttagactctagagtagctggtaaagtagtaattaggagagattttgtcttgttcttgtgatgtcttgaggcgaaggacactcttattgatactagtttgatactggtttatttaattttcgaggaatttaccctgtgcgctttggtcttgttggcactgctattccctcgattgcaattttgctggaggactggtagcgaaccaagtaaatatgcagtcgttgacagtctatcgagttgattagaagatattggttctctgtttggagggtgcaagctatctaaatgaaatggtcgattagaagatactggttcgaggtctgatttgaaggtgccaaggtagtaattccgatcatagcttttgttttatgaattactactgtctaaatgagatctctttggcaggtgccaaggtagatactaggaattttgggatctaagcaaagcccagcggatgaatgattggacaccatgtcaccatgtaatgtcttcactctgcacctccgttcatctcatcaactttgcctaccatttaacttgctacctcgtctcctctaagtcaggcttcctaatcctaggttccatgaggtcataagcatggttttctgtaaaagggaaatattttaagacaggtgttctattgttttcttaaaaaaaagactcatggatggtttagtacaaagtaggtttatctactcattagtttggtgaaaaaacctactcacataaaagaacgagcatcaatgggctctaaggaggagttgaagataaggttatcaaaatcttgtatctattatacgactttataatcctgattaaggtgcttgtttttataattttatataagtagaattacgattctatgtttctaatcctaactacaacctcggattcggattcaggtcgcgattttaatgaccatggttggagaaaaagaaatcatatacctccatgctattagaaaagtgatggaagatactaaggtaacaaataaattaacctaagtatcattattgtgaaccattatttcaaaaaaatagcatgcattggtgaacattaaaaaaaaatcaaatcctatatgatgctgtcttattagttttgtttaatttttctttcacaaaacatgctcctttgaccaatattgatactaatgttgcgttcggcagctgaagaaagtgagtgagtttgtttcgatttctgagcgcacgcttcccaaactactaaacggtgtattttttgtaaaaattttctataggaaagttgctttaaaaaatcatattaatctatttttaaatttaaaatagttaatacttaattaatcatgcgctaatggctcaccttgttttgcgcatcttcccaatcttctcaatctcctcctcctcaaactcaccctaagtgcattcacaatgcaggctacgtattcgagagacccaagacagtagtttgatctagaaccattgtagaaaataggctccacactgcatgtggtcttaaataggacccaaacaaatatcaaaatcctcttaaaatgaacttaaatagaacccaaacaaatatcaaaatactctcaaaaggaacttagcctacaacggtggtgtcccagtcaaagggtcaacaacaaattggatcaaattcccccaactaccccgcttctcattaagtcttttccgcttcctaccacgcttctcatcaagttttctccacttcctccgcccacatcgctcatcgccgttggggcaggagccgctgtgctagttgctagtcaccgcggcagtaagactaagggagtggatagagttggagtccaagaggcgcgggtacggcacgagagccatgacctgcttccccttctctctcttttcctctacgccatcatcgccattccctctggatcctcctcttatccttctcgattgctccacctccatagtaggcggcaacatcacgacggtggaggggaagctatcggagctctccaccaataacagcatcgataaggttatccacaggaaggtcaagataagctgtattcagttccctcccctcatgtgccacttcatgcatttttcccatggctacaccattgcttgtgatttgtggaatggttgtgattgagcgacggtgaatctccgtacaagcaatctccccctccctgatggtgacgagcaaagcggcgcaggaggggggaaacctggtgcacgggaggggctattggggaaacgcttgctttgcatgggcaaaaccacgattcgacgaagctccgacctccacaacgtggtgccacgctcctcttcttgctctgcacatccttgttcagcttgaacaatatgtgaccaatttcggttacgcggtcttcatggggctccgcggcttgaagagatggcgacaaatacctggttcctagcacttgggccaaacgacaatcggcgcatcatgagcaccctaatacaaccatgtttctagtagtgagtgaaaaatatgttagggtgttagtattgtgttgggacttaaatgaaggtggggtgctaaaagcaatcattttctagttttttcgtgttttagcttccaaatttaacaccgctacattcgtttaaaaaaaaattctaaaaaaaaagagagatggaagtgtaaaaccctaaacccaaaaccagaggaagcgacgccactctttccaccttttccgtcccttctccccaacgtttcctcctccgcccctctcccattccatccatggcggagcaagagcaagagcaacagatggattgggaatagaatcaatcgctcgcagcaacaacgcgatcgccgattccaagtttccactcccggaggaggaggaggaggaggaggcggcgattccaatctagattgcgagggggctggtcagcagcaggaggagtagggggagggcaagatgagcacggtggacaagatgctgatcaaggggatccggagcttcgatccggagaacaagaacgtcatcaccttcttcaagcccctcaccctcatcgttggccccaacggcgccggcaaaaccgtgagcgccccaatccaatctctttcccctagcatctgtagtgtgcgcgtgtactgatttttattttttgggtttttttgcttggtttctgtcctccctgcagacgatcatcgagtgcctgaagctctcctgcaccggcgagctgcccccgaactcccgctccggccacaccttcgtgcacgaccccaaggtgagacacacgcgcggcttcagtgttcgtcctcaccatgggctcggggttgagtcgtaggggttttgctgcatttcgggaacaatggtgtgattaatcttgttagtaaggtctattgggggtacccagttcacggtggtttgatagcagtcgtatcgaacaggggttgatgcttttatgatttgtatcttggtggagcgatggattgatgcaattgagggatctcgaatgcctatggaggtgcagtgtgctgtgctattgtgccagggaatgggcttgaaatgaatgatggttattgtggactgaagctgcttcaaggttgttggcataattttctgccaggagttcttttacattacttgtttctgtgggatgtgcaggtggcaggtgagacggaaacaaaagggcagattaagctgcggtttaagacagcagcaggaaaggatgtggtgtgcatccgctccttccagcttacccagaaggcatcaaaaatggagtttaaagcaattgagagcgtcctccagactataaatccacacacgggcgaggtcctcagacttattgtttccccttttgcttccaagttgtttaatatggggccatgcctttgagatttatttatttgattatattgaggcatgggtgtgtttgtttagttacaaaagattcttgaaactccaactgggaaaaataactttgccagcatgtcattggatgatcttgatttggttcagaacacctgtaacccgaaaatgatttctcatgtctattgttgtttgtaactcaaggttcattacaaagctaatattattacatatatcaatcatatgctgtagtttctgttgctatacatgtctctgcctgtaggactttcttgtagtaaatactgtccccatggttgcatacaaagacgtccattattttccttgcactttgtattgtccgtgtcaggtaaacccttgtctcaaatttgagttaagtagatcttagctatgagtctgtggtggttataaatgttttcataaactagaatagccggaagtgcatagttatgtgggaaattttctctcaatttccctttgtattgcataccgattgatattttaattaatagaacaatcagattgcccttatgaaccatgcaacacttctcaaatacatttgatttctttcatttttgatctatttttgtggtcgtagaaaattttcttaggacaccttgtactttctgtgaccacaggtacttagtgtgacattgttgcacataaaaatttgatccatgtgaatctagatgatgggaatttcacacttgtttggttggttctaaataataaatttaaacaaggcaacgggtttgtatcactatggcttcatttggggttgaggtggattatgataaatctcgtttggtaaactgttcttattcaatctaagttggaagcgataatattattgtgttctataaaaatgaaacaattgtgagagatacgatgattgcataacatatttttctaaccattatttgattttttttaaaatagaatgattcttacatttctactacaaatttaaaataagcacagtataatacagcacagccaccacaaattgcgcctaaaggagtactgtatctgttgaacattttaggttacaatgtatattcacagcctaatttgtttttgttattgctgaattcagaaagtctgcctcagctacagatgtgctgatatggatagggagattccagctttaatgggtgtatcaaaggctatactggagaatgttatattcgtgcaccaagatgagtccaattggcctttgcaggatccatcgacacttaagaagaagtttgacgatatcttttctgcgacccggtacttgaatgttttactatttcgtgtttgcttcggaagctctggtcaagagcataaccgttattagttgaaacatgacaatattttgagataaattattctctagagtaatcatcgttattccttgaaatgtcgttatgactagcattggactaccttaatttctgtattgcatgtgcagctataccaaagctctcgaagtcataaaaaaacttcacaaggatcaagcacaggaaatcaagacttttaggttaaagttggagaaccttcagactctaaaagaccaagcatatagggtactctaatcttctgttcaatcattcctgctagactgccattgtatgaaacttttgagttatggtatcgagagttgagttcaacttgtcattgcggaagcacctttgttatttgcttatttgccatgggttgggctatcattttgttctggatctttgaaatgctacaatgtttttctttttttttaaatgattactgatcaactaaaagaaattgaagggattgtatcgttctgtcctgcatttgtgccagaatatatggctaatcagcatattttacctttaattatttgtcataagatgtctgatttatcaacatggtgtcctgctgactttaatgatgttattggtgaagaatgcagaaacaatgtaaatatttggcaattaatgaagtaatttgacagcagacaccattgtaacacatttggtattacttttcacatcaatcacctcccattcaaacttctccccatcttactacgaaccactcccccactccatacatatccttatttaatgggaggcattttgtcttttttctctataattaatttacctcaaataacctagaatcccttgtatttggggatggagggagtatatacatcaagttagatactagttattgtttctatgtgccattcaaagttgtgagaaccagcttttgcatgttcacctgacatccgtagaccctgaaattatttcttaatctattattatatgctacttatgtctcactaacaattgtgtccttgacccacatgtcagcgagacaatgagtgctatataagggatagagtaattgtccatgacccacatgtctcactaacgtaccttttatttttactttaactctcactaattttgacagctccgtgacaatattgctcaagatcaagagaagtcagatgccttaaaaattcaaatggaggaactgagaacaaacgttcaaggtgttgaagacaaaattcgtcgtactgaaaaaagtttagctgacttgaggaggcttcaacaggaaattaactccagtacatctgctagaactacatattttacacttcagcagcaacagtatgctgctctttctgaggaaaacgaaggtaagtgactccttggtgtgtcactgtgccttcaggcttcagcccattagttctcaccattacaacaattgactctgtctttgtttagataccgatgatgaactaaaggagtggcaaacgaaatttgaagaaagaatggcattgctgcaaaataagatcagtaaactagaaagagatgtggatgatgaaaatacaacaagctccttcctttccaaggccataaatgatttgatgcgagaaacaggaaggctccaggcagaagctgacgtaatgttatcatcttttatatcttctttttatgattttatcagtcattattaactatagtggacattgttttatggcgttaaaagtttaaagtaacatccaaatatgtggttttcaggctcacatgtcagtgaaacacgaacgggattcagcaatcagaaagatcttcaccaaacataatcttgggccaatacctgatgctcctttaactgatgctgctgccatgcaccttacaaacataactaaagcaaaactgtcaaatcttaatgatgatttgcaggataagaaggtgagaatactgattctatgtattctggaatttaattgctaagtatacacttttatttttaacttccgctgattataagcttcaaaatcatttccaaaatcaatatgcgtatggagtttagtcatatagcaaatgtgctctattctgcatccacctcataattgtcctgttttggtgtggcatctcagtggacgtatgagttatgtattaaacagtttttgttggaggaagaatgttactgaatctactcaaatcatttgctcaagtaggcagtgaattttatctagttaatattgaacccacctgttcttaaaaagtatgtgctctgacaatgaaaattccgctttatgaccagaaatctaatgaggcacagaaacagtttctgtggggacgctatcttgaagtaaatactcgctactctgaagttgttggccagatagaatctaaggttgcctccaaggttagtcatggaaagaacattggacaagcacaaatatgatcttctgcaactatctcagaagaaattgtatttcttcacatatcaataacttttcagaaaggtatttcaaggcgcatgaaagataaagagagtgaacgcgatgccgcggaaatggacctttcaaagtacaatcttccccgtattgatgaaaaggagagacatctggtactttcctgatccaattatctttagttcttggaaacatccatatatgtggctgcacttttcttgttacatttttatcagaagtagaaataaatgtcacaggctcacagcattagacagtttgagcattgcacccttaggcgttggctcatatttttctccacatgctttgatgtcttaaagtatgccatcattcttaattctgatgaaagtattttttttgagaataataactgattcatcccatcttaattttggatagcaaattgaagttgaaaggaaagcacttgcgctgggagaaaggaactatgattcaattgtaaatcagaagcgcacagagatatttagcttggaccagaagataaaaacacttcagtgggaaaaagacagcattattagtgattccaatgacagggtactactagacgtgaagaaggatgaattggaagaaagcaagaagaaacttaaaaagatgcatgtttcttcctctctccttttataaccctacttattttatgattcacttttttatatttcccaatcttaaatcttgctgtgtgagaagttcaagtagcacatactgtgtaaaatgcagatttgatgagcataaggacaaaatcagaattgtgtttaaagggaggactccttctgagaaggaagtcaagaaggaacttagtcaagcctttgggtatgtgctactctgtttttcttatatttgtttcaaccagcgatcagtgattcctttgttggttgctgtgatcagttcagttcacctgtgtcatttgtcaagctgtagtttgaaaaagttatctcttccatcaattgacctcatttctgcatttttatcagtgggctactgatagctagtagtagtaatagcagtatctgactatctgtagtcatgcatattttgatcaatcatgcacaccatgagctgatgtacattcaatgcaagtgcagtagcgtacatgataattttaaacataaccgtgtagttgtatgtatatggctgttcattaatgctgggatgattagtcctgtgcacacgaactatcatgtttatgccaattcatcctaatagtagatgtgagaataatacatatgaagtcctctagttgttatttatgcatttagtaatggtacaaaactctgcttggctcaggtctgtagacagagaatacaatgatttgaactcaaaatcccaggaagcagcgcaagagctgaaactggtacagatgaaaatacttgatgctaggagccacttgtcaaagcttcaaaaggaattggatggtaaattcagatattactaccgtacatttatacttacgtaatggcgtgattttatgtgaaatattttgatatctaaaagatccactatggtgtgggatttgaacaaataactttggagaggagtcggttatacgtctccttgaattttcaagtgcaaatgtaccatatttttctcattgctatttttaaacaatggcggatttcctacgaactatgtatattgcatgcatttgatatttatttttttatctttaggctaacctagcacattcctatccaaataaaggaaaatatgtgaaaaatactgataaatttaattagtggaacttaggatgttacaatcataaactaacggagttagattacttttgatcagattggcctgttgttatgggcagaactcagcccctctcattattagataaggttgttaggctttattagataaggctgtaggaggtttgttaggttttattagataaggttgttaggatgtttgttaggagccggctctatataaggagaggcaccagtcatgtggaattaatcaagaaagaagttaaacctatctctagtctcccctcttctctgttcgacctcacccaaactctggggcggcaaggctgcaggcctcgccttcccgttgagcaccccaattcattcctccacataacatccaccccaccacgccattcaccatgcctgccatccatgacctccacatgctgcgccaatcctccagggccatgcagacctccatcacggagatcacagctgggctcgacaaggtgacagaattggtgttggcactccgtgcgggttttgaggccaagggggtggcgttggaaactacgacgacgacgccctctccgccactcgcgacggcaccgccttctctgccatcgtccctgttcgcggctgcggtggaggaaccggtgatgacgatgccctcttcaccgccatcggtccaatcggcggaggtgctgcagcccctggctgtagtgccattttctcagttgtcgttcgcatccgaggctgcggcagtgctgtcacacctcacaacagtccggtcggcgctcgctggggcaccatcaactcagccatcgccatggaagaccatcgtgtcgcgtcgtcaccgttcccttctgcgaccacagcagcagcgagggatcttccagcagcttcctcgagcggcggctgcgattacgctgagcgttgctcgacgacggggagcatcacgtgcggcgccaacggcgtgggatccaggcgggccacgcgcgccgggaaagggggcgcagctgctgcagcacagcgtgagcaacacgcgtgtcaacctcctgggggtggcgccgtctacatgagcagcaggtgtgccacgagagtcggcgcaggaggcagctggttcctcgcgaccccacggcgtcagcccttctcacatgcggctggtgcgcatagccggtacggcgcgtcctcatgcagtgattgcggcatgcacggcgcaagagatgtgacttctggtggcggcgtgagatatgggaacggttcctcgttcgtccctgctgttcggtgggtcaactggaccgtgtctttttggctggtcacgtgatcctctgttgagaagacaagatccatacaacatgtcttgggccaggggctattggagtgggctgcagttgtctaggcaccacacagctttggtctcctttggcaaacatgacagcaagcaggacatttgtggtttttggaacacacagtcacattggtatggcgtccttcctctatgttcttctggatggggcccacctgagcttggcagcagaagaatggcatggaacaccaaaataattttagatttattctttccaaataatgttaggagccgagatgtaaaaggcttaataataggacatcatgtgaagacaagcttgcagctcgcgggcgagctgcttccgaaggaggagggaaaggggactaggatgacatgggtgatcggcacccctcaacctttaggcatggcttccaccgcagctcgaggacgagctgtctcgaaggagggatggagatgttatgggcagaactcagcccctctcattattagataaggttgtaggaggtttgttaggccttttgttaggatgtttgttaggagctggctctatgtaaggagaggcaccacagtcatgtggaattaattaagaaagaagttaaacctatctctagtctcccctcttctctgtttgaccttacccaagctctggggcggcgaggcctgcagcctcgccttcccgttgagcaccccaattcatccctccacataacacctgtgaccatgcaaacatgtgaaatgcaatcgctgttaggattcacatcatttttgcagctcttggcctccattgaggtgagatagtatcagattcttctctcccttggtctctcctcttaacacttggcatagctagctgtggcagtatagctgcagtactgtagttgcagctgcagctagtactagcgagctaggccatggtgtccccattgtgcatgattgctccctgattatgtggtctgcttccttgctgctaccatgatgccagacaaggcaatactggtctatgcagcacttagctcgctctaatcgtctaattaattgcatgtcggatcaaactgggtgtctaggtgttccttccacagatcggtggatgcagttcatgctatgtactcgctctctcttctttagctgtttgtgctcactgaatgtttctttaagtaactgcctttgaccccaaatgagattgatttgtttggttgcatttttgattggatagccaaattggcaggtagttcatgtgattagccttgctgggacattgccttgtactccctccgtttcacaatgtaggactttctagcattgcccacatacatatagatgttaatgaatctaaacacatgcatatgtctagattcattaacatctaaatgaatataggcaatgctagaaagttttacattgtgaaacgaaggaagtaggagataactcatgcattgaggaaatattgttgttgtacatagcgcctttgtggaaggtgtccaagcatctggtagctgccgtgcctcattctttagtactcctatgttagtgcggcggaatttggttggtcatacctgtctaatttactcttttaattgccatcatgttcaaagccaaattgtcctttagactcatcatagttcgttgaataaagctgggactagttctgatctatgcttcacctgaatcatgggtaaatttcttctcaatttgatgacaagaactaatttgattgttttgtctgggcagaaatttagcacactgtacctatatcatcttccaaggttctctcagagatgataataaattaatgttttctcatactgtaaagagaatacaaatattgtcatggaaattaataaagtttttctatggaactaatgaaaggactgctcattcgttttatcttttaagactgtgataagatccattgacacatgtttttctacagcaaagagaagctatgtggagtccaaacttcaatccattacgaagatgtctgctgacattaacatgtttcccaaacatctgaaagatgccatggatgaaagagagaaacaaaaaaagttgatatccataattttagccatttaatttggtctatatatctccttgtgatgtgctaaattcaatgcttcctgcttatatgcagcaatttaagttacgcgaagggaatgcggcaaatgtatgagccttttgaaaatttggctcgtgagctccacatgtgcccttgctgtcaacgtgctttcacacctgatgaagaggatgaatttgtaaagaaggtgcctgatctaataattgatataacatgctgccttttactttgttagagttactttattcatatgagtttttcctaatgtgtctgttgtacctttcagcaaaggacaacgtgtgaaagtactgcagatcgcatgaacaagatctcattggaatgctcaaatgctgaagactttttccagcaattgaataaactcaatgcaacttatgaggaatttgtgaagctgggaaaagaggctatacctctagcagagaagaacttgaaacaacttttggcggatgaaagtgagaaggcacaaacatttgatgatgttagtttcctgttattaacacacaactctgttttagttcccagacataaaagaaatagcagacagtataacctcatgacttaaatgaacttgacttctctggttcaatccaaactgaatatccttgagcttgtatttcgttcctcgtgcccaactcgggcacaattatatcatcccttgccacctcgtgcagtactaaatcagtatatttaatttctttaaaacaaggagttgatctcatactaattgcgactagcctacagcatgctactccctctgtccacaaatataaatgatttggttatatacctggacaagcactcgttcagttacgtagccaaaatcctttatatttgtggacggagagagcatatcttgtttagatggtctgtagttatgtgttgccacctcttctaggccacattggcataaggcttgttttggtgttcttaagctcttcttgattgggcactgtaggatggagtctctcaatgaaatctataaaacacatgtagtttgtggttagctcatgtcatagtcttgtatttaaataagtacttacctttgagaaaatattttaatcatagtatatctgtggtctcatgtgaaatcataactttctttcaattagttacctatgcagataatattgttattgacgaagataatttattatgtataacctatttcgctttgtcttgttgcattttgatggctttgatctttggagagatgtagttttgtttacagtttccatatgtgatccttcattgcagtttgtcagtgttcttgctcaagttaaaatggacaaggatgcagtgcaggtattgctacagccagttgaaacgattgataggcacgtacaagaaatacagcagttaggaccacaagttgaaaatcttgaatataagcttgatgttcgtggccaaggtgttaaatctttggagcaaatccagttggagttgaactctgtgcagaggacaaggtatttaattctcagaacggagcaaatttgttaagggtaatttggaaccatggaacaaatggcctaaaaaatttatactctgttgatctgttcggaaatttagaaaagagttctcgaaggaattaatcaacaggatattttatgcatgatcagttattggggtcttgaaaaattctagtgcttaagcttttcagggtcgatatgtcacatacactgctctagctatggcaatcaaattaaatgcttacagagctaactgatgcccttaatttgtgggagtaccaaataatgctttagtgaaggatgcacccatccagacttttctgctcatagacagcgcttttctgctctgagacagctatctgtcacatactagttgtagagttccctttttcacttggtactgatagaaataagcgcacaaactggttattggagatctttaggtgctttggctttcaatatgctgtaactatgttgagatactactatatataatatattttctattaccatcttttaagcagtttatttgacctctttattttcttcacgactccacttggaagctggaagcttcactttgtttgatactcttatctattgaacagggacacattgaacaatgaagtggatgatctaagggatcaacaaagaacacttaccgatggtctgactaatgctcagatgcgatggcatgatattagggaagagaagctaaaagcttcaggtgcagtgcacaaatttcaaaaagctgaagaggatttgggacatctagctgaggagaaagaaaaactaacattagaagagaaggtactcctgcttgccttctgtgcacaattttttcttgagtaaatttcataaaaccccacctattatggtccaagttacacaaaaccacagatattttgacatgtggcaagtaaccctggatattatggt

SEQ ID NO: 49784 - DNA, 1221 bp, Oryza sativa
cttggaccataataataatagggagagtttaataaaatatactcctatttatttgttgtaatacctcaattccaaggttcatgcttttcagatatatgcccattttggttggatgatataacatatttacatatagtttactggagttatatgttatctgggcaagccacaaagttgctgctatgatgcagtccttctagtttatagccttaagagcatttgatcaatttgataaactcgtatgtaaatactacagtgattttggatgaaatgtaactgagaattttactggctggttatcattgtaccacaatttagtcagcacttgcatcagcctctttccaggaaacgcttgtggttcacttggcttgctattgtttcgagtcccggaaatgttgggggtgctttttttatcaatgacatgcttacacttgggcttatgcactatgatgcaacatgtgtataatcggttattgctcaattatgcagcatttagaggagtctcttggtccgttgtcaaaagagagagaaagcttgttgcaagagcatgaagctttgaaggaaaagcttgatcaggagtatcatcagctggcagaaagaaaaagggaattccagcaggaaattgatgcactcgagacacacaatgagcgtatcaaagggtataaaactcatattgctcctgaattttagtttgtccaacttctactatctatgtttactcctgaatccttttaggtacctgaattcaaagaagggcgagaagcttaatgaactacaggaaaaacatactcagttgcagtctgatctacagaaaagtaaggaaagaaaagaagaaaaatcggcggagttaagcaagaacaaagagctattgaagagccaagatcagttgaaaagaaacattgatgacaaccttaactacaggagaacaaaggatgaagtggaacgacttactcatgaaatagaattacttgaggacaaaatactttccattggcagcctgtctactatagaagcggatcttaagcaacattcacaagaaaaagataggcttctttcagaggtattttatatctcatttgaaacaactgacagttgcatctaataagatggcgttcttttatgctctgtttctgtaatcattaacatacaatacgtatggcaatgtatgtatttcttaatgtcatgttcacatgttccagtaatgaatttaaaaggaaattt

SEQ ID NO: 49785 - DNA, 1429 bp, Oryza sativa
  unsure (1)..(1429): unsure at all n locations
ctagtaaaagaaaggatatcataaaagagtactccctccatcccataatataaggcacccacgcatttcaagattccacattcaaaacattttgaccaacatttagtacaatatgaatcgaattttacttgctaaaaattgtataatcggattgacatttgaatttactttcatatggctataattttgttactacaaaccttataatatttgagaaattataagacaaagattagttttggggaccgtgtcaagtttgaccatgccttatatcatgggatagagggagtacctacctaatctattaggattagcagttttacttcctttctgaataagatttgcattaagggtataaatacccaataggaggtcataaaaagtttagccaaaccaagtgagaagcatttgcagtcgagtggcttccttccattcggtgctggtcgctaagaagcatttgcagtgttcacccatctgtagaatctagatcaactgtggttattttcactgctagttggtccgatggtgccgtcgacactgttgacccgtcatgcttctacttctctaccacatagtgttgcacactagttggcatgggtccaaggactgagggttgggcgtgccttgattgatcagctatgctgccactaacgttctgagctctggttgataggcgaggagaatagagaacctttgtttattctttgcttcaataattctgagagatgtgttcccttctaaaagagcagcttacaaccaccgagcaaaccagatgagacacgagtatcttcttcaagagagagctagcaaagtatctcgtttcctaaataatggactttgtacttccttggtgcaaagggtcaggggtcagccagcattaccagttcactcctgctgcggcagcaaatgcatgcatcttgtccctttcttttgcttcttccttggtccaagactgttgcccacatggtgcacaaagcccatagcatgtacctacagcttgttgtatgaattattttgaattgcatcctttattttttgtgtaggccttgtatgttgacacatgattagtggagtaggggcttacatcttgggatgactgtgataatagaatatgctcagatgtttgtttttctgctaggaagtttcacccaacttgcattttacaattttgtgtttatattttctgctagggctcttatgcggttccacaccatgaaaatggaggagataaacaaaataatcaaggaactgtggcaacagacatataggggccaagatatcgactatataagcattaattctgactctgagggtgctggcactcgatcatacagctatcgtgtaagttaaattagctaacccttgattaactntcttggattgttcgtcagggttcacttgttttcaacttccttttaggttgtcatgc

SEQ ID NO: 49786 - DNA, 1170 bp, Oryza sativa
gatccatgtccttatcttctagttgttatttcttgttctgatgaacacacagtgaaaggcacaattctggtgagcaaccacttgtttggaacataactgtaaggtgcagtgtaaaagataatattgtgctctcgattctcaagtaacatgggctcattattaaacagagtcaaaactcagattcagaattttggggatatgcatatctatataaaacaatgttgatatttgtaccaaaagttaccgaaattgaagttaatatcaaaattaacaaaattttcatttgaacttatgagaccatatcacattgttgaacttacagaaattcaattgtagatatttcttacaaggtagaatgagaggtttttcaactgtaaattctgtcataaacatcttatgcaaattcaaaatcataagaaacaagtgatagtttcttatcttctgtgttctcagtttggaggaaattagtacgagttgatccacaaccctcactattctaaggacaatattttttgtttctatatgtaaccttaaattagttttcacttaataaagattataatatgagtaatttttttctcctttttgattagtttttgcactcactattgaacagataccctgtcggacagcaaccagaggaaactttccattgaatggtacctactttcaggatcatgaggtttgcagcatttggtcctcttcactccaatttcatcttatgtacatttactagttataaataagatgaagaccatattggctagacattgatctgttatatatattatcctttacaggtttttgcagatcattcatctagccgttccccgattaccatccctagagaatgcatctggaacctagatagatgcattgtatattttggctcgtcgatacaatcgatcatgaaaggtattgtttgctgaaaggcgaccctgagattcatgaaataattgctttgactgatactaagttgaagtaatcatcaattccaggtcaaacaaggcaagacattgaggactgctacaagaaaggtaccaagtggttgtaagatttatttcctctttgatgtttctgtcttcgacagtccgacagaatttagatactgaataagctaggtatcttacaattaaaaataaacatagctagaacataagggcctgtttg

SEQ ID NO: 49787 - DNA, 7572 bp, Oryza sativa
ctacaaatataccactacactacaaatatgattccctctatgaaattgtatatgattcattttcttgtatcacttatacacaattatgttgcaattttttcttttgcaggatatatttgtgttagaggatttgatcggaatacaagatacccaaagccaatatgtgcaaaattacacgccaccaatgaaaggaacggaacaggtgaaaatagccggaagaagaaaaagacatcacaagaggggaagaagattgatgacaaatcttcctttggcaaattagaaattaactgatatatatatatcaccattaacaaagttgtgtacaaattgtagttggaaggatgctgatagcctctgctagctctagtgtatcatgtagatcagtagatttgcttagggcggctgcatgagtaaatatttggttgagatctcttccacaatgcgccttgtatattagtcaaattccttttttattatgtgtaaacaaaacatcccatcttttatgaggcaaaatcgcactatttagtcttaacgggcgacacatacgcatgagaaaagtgccacttaactaggtttggatgaaaagctcgtggctagttatcttgctcgactcgtgtctggctcggtttgtttgaatttgttaacgagctgagccacggttttagctcgttagctatagagccaactcgagctgcttaagagccaaacgagcccagcccagcagttaacagcctaatctcaaaagcccaagtgcaaagccccacaaagaaagagcaaccctagatggatcgatccctcttttccccttcttctctatactgtatgtgcgtatgccgatatgtgggcccaatgatttctgggtccacatgttagtgataaaggcgcggtgcagtcaactacagcatatcctaatcccatctccattccctgtctccctctctcggctaatcgtctctctctctcacacgacatcagcagggtagcccttcggccatcgccgcatctgtcgccccactccacgcttgatgactcttgcctcgccatcccctcatccagctgccgctttgctcagtaatggagcaaacaccgccgccgttgtgaagttctgaatctcgaggattcgaggattagtaatcgttgtctcacaagtgaatcactagtgaagtgttagttgcatgtgtccattttcttgtgtggaattctgatgacggacttttggttcatcagtatgggtgaatgaacggatgatgggtcatgtatttgctgttttacttgcccggaagtatggattacagacttttggttgatttgcaaaataattcctgaggaaacaagcatcgacaatcctccagcaacattgttgttcccatctatagcattcatacaagaaattggctttacaaaaggaatatcagtgtccacagcctccttttgcaagtttgcaccatcactacggatttcagaattcgcagaagccaattgcacggcacattggcatacctcattcatcagcttggtaacaaaaaaggcaggaggttggatctggtatgaatggatacatttatcctcaaccattttggaaaccttgtctaaattaatggagaacctcaaagggtcgaaattgcatttcagtggcatatatcttcacctcacccatagtggatgaagctacatcaagttccacaaagtgtcccacttgagtatcttgagaagaggaagatccaaactcattcttgcaacctccgactctgagtgcatggaggctgctgtgagcctgtgatgaccatgttctcggttagctgcccacctgaaggatcccaacaataaatcatacaatcagaacaagcagagaggtaacatgcacattttaatgaggtaactgatagtttcgacttttgttacatacgcacgcaatggtatgttcatctaggaacaaacacacggtatatacgaaaagaaaatattgatggaatcgaatacctgaagaagcaacgatgacttgttaagactcagccatgtgctgctgcttctgctttcctcttgtaatgtgacctgcaatatatattatatatgtatgtatagatagatacatagcactactcaacaagagtaaggagtattagcataagaacacacaaccactactacaataaggattttcccgtgcagagcattcgaccgtctggaagaaagtgtctgcgaaaatcacgattttttcgtgcgggcgacgcgggcgcttaagccgccagcacgggaaaatgaaaaatcaaaaaaaaaagaaaaaccaaaccctaaccctaatccagccgccaccgccaccctagtcgaggcccgccaccgtcgcccccgcggtcgccggtgccggatccgctgcccgctcccatcgctaccggggaggggagagggaggggagaagccacgggccgccgtcgtcgccgccacctgcacccgccgccgccgccgccgcccccatgcctcctctccgctggatctgcaagaggagggaggggaggggaggggacccgaggggagtagaggggaggggccgtgtcatgacccaaatattttttttccgtgacagtctaccgtatccttatacgcatatatactaatatttatatatgtccataaggatacaaggcaaaatgcaatgtctaaccatcataactggagcttagacacctacagtggttccatttattattattacttttttttcaccagctatattgcatattacatcggttggttcacttaccaacttattgtcactaggacgataccctatacctagcatgcaagtatgtcctctgggatacctctaaagtctaagtagaccacactctccactaggtctgcatgtcaccatttccctctgacatctcatcttgactagtttctgcgcacatcaaatagtaatatactcaataagagtaaatttcacaaaactacaggtattttgcacaatttatcacaaaactatagatttaagagcttgtttcacaaaactacagatttagtgccttcatttatcataaaactacaggtactttgtacaatctatcacaaaactacagatttaagaacttatttcacaaaaatatagttttagtgtattcgtttatcacagtgctacacatttagtgtcttcatttatcacaaaactacatatctagtatctccattctcacattgctaaaacgtgtagttttgtgagaatggagacactagatatgtagttttgtgataaataaagatattaaacctgtagttttgtgaaacaagttcttaaatatgtagttttgtgatatattattcaaagtacctgtagttttgttataaacaaagacattaaatctatagttttgtgaaactagttctaaaatctgtagttttgtgatagattgtgtaaagtatctgtagttttataaaatttactctaataataatatatgagtatgttatacatacttagtaagattagtacatatagctatatatatgttttaaagacaaaagaaaatactactacctatagatattaacaaccaataaataataaaggacattgaacatagtaaatgagttaaatccacactgcagaggtattaaaataatcgtagtaatctcgttcctttaacccatttttctcttcaactagtgataccctcatctgagaatcacgccgccgggttccctacttgtgtgaggcattccttatctcacattgatatcagccgacccgatatcgttatttcaggtatcggctgtctcaggctaagtatcacaatcacgttattattctcactgataaaatcatcaatacattattcgggtgttcataatactttctattagattcttagtatcaccatttcaatataatattggtaaacaaatttagtcatagtaaaatagttaatgggtgcggtcttgctttgtcttccgttgttctttctctgcgtcccacctaatcaaatatatagatcttcgatattaatttatatctatatttttcatgcagaacattagccactgacataagctactagcaccatagacagaaagaaaaccaacatggagtacagctgcttgctagtaactactagtctctgtactagccactacaagtactaacctttcgcactaatatatctacctcctactacatttagtacacaggatcataaaaagcaccctaaaaaaatatggtaagtgtagcagcctactagtaccacaagaaattttggctaatctagctagcttattactagctacttgctagatctgaatactattaaaatgtaacaatacacttgccctgtgctcacgctggcttctatggtgcgagtagtattcctaggtttttgggaggcttttataggagaagcttcattcgggtctaaggagacacatgcccagtttataagaggaatggatagctttcacctcctggacatttatttgtccatttttttaactagtccctacgatcctattcacaggtgcatgtctatcatatcccctttggtcagtaaaatatactaccctctccattctttctgtttctatctttttcacactttaagttcacaaaataaaataataataataataataataataataataataataattattattattattattattattattattattattattattattattattagtagtagtagtagtactactatactactactactacagcaggccacacgtggtccgccaccgccacccccatgcctcccctccgccggatctgcaaggggagggaggggaggggaggggccgctgcgcaccgccgtccgcctccgccgctgtcgccgtcgcctgcgcccaccgccgggaggagatcgaggagagaggagtgagagagagatcgagagaggatagagaggggtgagagagagatcgagagaggatagagaggagtgagagagagggaggatagagagagatagatcaaccggataaataagagagagagggggaacttaggcccacgcggatgggggagaggagagaaaaaggaaaaattttgaagtgggtaggagggaaactattttcccatgcggttctcttgatagatccgcacgggaaaatcggcgcatttttgcgtgccgattttcctgtgcggtgcgagttaccgcccgccgcaatctaaaagggtccatgtccaggaaaatcttttcagtagtagtgcacagaagtagaaaaaagtttttttttcttcccatcttttctggacaacgactgatagagcaacatcattgagcgcaaccaaatcaaaccaaactcctcccaacacacaagaaaggttttgcgatggattagggggagggggcgagagagagggagataaaaaaagcaaatgtgcatgcaattagaagggagcaatgtggagtagggttccttctccctctactctcactcgcagcacaagcgctgccttgccccgccacgaggaggaggatgaggaaacccattaatctttatctattataaaaattgaagatggttctgtacttatatcttcatcttttttttcgttcgtcatgatgtctccgatacaaagtagtttacttttattcggtcgtatgtatgaaaaccgcactttattgttacaggcagtcgggctgctactgctgcctgctgctatgcatgccgttctgttggcttgcctatccaagtacaggcccatatggccctcagcgatagtccatcagggcgtttggtaagacccacaacccacctggccacctgagagcgatgcgtctctggctgtgctcatatgtcaaggttaccaactctccctccccattttcggcacgcacgcttttcaaacggctaaacggtgcattttttataaaaagtttatatatgaaagttgcttaaaaaaatcatattgatccatttttaaaaaaaaattaagagtaaattgcatattgggccaccttttttaccattgtttcaacttggaccaagtacagagtaaccttttcactttggaccacctatatatgttgtttcattttggggcactcttccacctttaactccatcgatcttctctctggcctacctgaattacatgtcgcactcattctcaagctctgtgatgcctcgctatctcaagtcccgttgttatactctacctcgagctggagtttgacctcccaacaaccagggagatcgatcttctttccaagcgcgtggaggtgacgctgatggagcttcggtacgagcactgatgatcacttgttggtttgctcatggtggttcctctagccctttgcagtcaagaaagagagaagaaacaaagataagagagagggagctggatgtggaagaagaggcccaaaataaaacaaacatgtaaatttaggtggtccaaagtgaaaagattgttctatccccagtccaaattgacacaatggtaaagaaaggtggcccaatatgcaatttactcaaaaattaactaataattaattaatcatgcactaatgaactgcttcgttttctgtgctagagggatggttcctaacccaggcaaaagaacagagcccaatatattggttgcaacaactcaatttggatatctatcatcttcctcctatgtcctatggattcatggaatgattttcgactgtacgtgcatgataatacagatgcattacgttaatttgttgccctgaattgattaatttgccatgtgtctcaacacaagacaacaaagtggcattgtcgcataagagagaacctgcatattctgaagtgtttaaaagctgggtggatttattgttggctcatcgtggggtggtgccgtggtggcggcagatccgtccgttgtagagtcaacggcgttggcaactctcgccgcccgcaagcttcttccttcagccaccagttgcttcttccccaccacttcatgggggcgggggcggcggatccacccgccgcagagcccacggcgacagatccgcctgccacgacgccagcggcatcggcagctcccatcgcccactagctactccctcgtggcattttttggggccgacgatggcagatccacatgttgtggtgccggtgacatcggttgctcccaccaccagctgctcccgccccaccacttcgcgggggtcggcggcggcggcggatccgcccgccacagggtcggcaacatcggctgctcccaccgcccgccaaacagctaccaagctctgtcccgccgccccgagaagatgagcagatacggagggagagggaaagaggggtggaaggtagagatggcaacggggaattcaccacctggggttacatccgcgtccacgtccccgtcaccgtggtgttaaaaatttcacccaccccgtcaccacgcggtgaattaatccccgtggttactcccgtagagagaatcaaagaagggacggcgtgctggcgagtggcgagttggcgacggcgtgtgtggcgcgaggacagccggaggcggcacaagctgcaagagacggctcaagccatgtccccatcgatcgatctatctcgcagtgaggc

SEQ ID NO: 49788 - DNA, 15237 bp, Oryza sativa
tatataaaaaatatagtaataatatatgtcatacaaatatagatatttatcaagagaaaccacgttggctttaatatatttaactgatttctatataaacttgagcatatttatttacattttttcaaaccatcttattttaaataatatttgtagtatcgtagagatcgtagaatcaggataccacctaagatttcgtaggatggtgtagtaataaatagtaggatcgagctactatgaaaattttgatactagataggatcggtatcattttggtttagtaggatcgtagtatcgtaagatactatgatacgaatcattgtgtggaagtactatcttttgcatgcaggtctcctagctatccatcggcgaaaataaaaatattttataggcaggccacgatttttgcattcgggtcttgtctccctcgggaccgatagtattggatatgttactgtccgtctgtgaaaaccatttctatagcagtgattgcctgttggcgtaaacctctagggatgtacggagtacatagcaaaagggaaaaacaaacaatgaataagaataataattatatgtaacatgaataagaatagtgattatatataagaatataaaatactatttggatatcccattccaacgccattgccctctgttctaaaatataagtattttttgttgacatcgatacagtcttcaagatactactttgaccaacaatatctataagaataaaatattttaaataaaaatagttgcatattataatattttgattaatgataaatcgagtaacatcaattttacatgatatatatatttttatttttttactattaatagttaaagttaaaaattgttaacttaccattatgctaaaaatgcttatattttgggacggattgagtagttaataggagtaattaaattgagaaattatgatggaggacgaatatgggctgtcataggccttctttctgcgcgctaaggcccacacggcccacctagaatcggaaaataagaaggcaggccaaggcctccaccctccatcggatcggaaaggaaaccctaagcgaagcggaggagagaaagcaatggcatccctgagcaagcgcggcggcggcggcggcgagggggagggcatcctggcctccttctcccggtcttcggtggcggcgcatgggcgcgaggcggcgaccatggcgaagaagctgctgcggagcacggggaaggcggcctggatcgcggggaccaccttcctcgtcctcgtcgtcccgctcatcatcgagatggaccgcgagcagcagctcaacgacctcgagctccagcagcaggcgctcctcggcgggccgccaccgcccgcgcctctcaaatgatccatccgtccatccttagcttctactgctgcctacctatgtcgtcgtcgtcgtcgtcttagtctttttcttcttttcttcttctcttagtgtacactgctgctactagtgtttttgcctgtctagtcggacaaatcaaaactttcttgttttcatcatcgatctatgctatgctgctctgatgagatgtcgctttttctttcctgctgctactttattttcacgctcatcttatcatgccgaataaatcgatcggttactatatttcattctgtgcgattcctgtgccgtttattctttctcgtcatatgctgttgtgatgagatttcaatttgcatcaccagggttactctttttcttttatggattgacatctccatgttcatgaacaacagttagtataataattaaggtttttttaaaaaagaaaaaacattatagtctgtaataaaaaagagaacattgtactccagtttctaatgttggatcacaaatgggaacttaagaggatgatttcttattcataagagtaagactcgagcaatgcatatgttggtttgttacgcccccaaaactttgggaaacagtcatgtgtgtgaaggtaaccaaacattttgatacaaacagcactactttattgcattttgatacaatcaacactggagtactttttattgggtactcctacttcctccaaataagtgtactagggtttatatgaagtaaaaccataataattcgtccataataattgtattccttctgtcacatcagaagaatgggagagcaactgagcagagcactagcagagcaagtaagctattctctcaactctcatccttattcatcctttttttttctgaagtaaagcagtttctaacttgtatatggccataaattagagatttggtgtttgttgttattggatgcacaactatttactataatattttttagaactatacatggcgctatactcaaaacaaagttgggaacccctctcattttactctagctctgcccctggctcctgtggtgcaccgccgttgcagtcaacatgtttcgggggctcatggccgaggccttctgagtgcttcgcaagctcaagctgcccggctcatggccgaggccttctgagtgcttcgcaagctcaagctgcccgtctctgggtatgggatgaatattacgttggtcgaggtaggaccggtggtgactggtgagggaggttgtgccgtggcagcggcaatgctggggctgactgaggtaagtttctgtttgtccctatctccaacttggtgttgaaaaagaaaaggatttggatggtgagatttggacgattgattcagtgatttaccttgctccctgttgtttgtataaagtttgtaatctgcgaatctgaatcattagacagcaagatactaagttgtataccattaaatagtgttgaaacagaagcacttccctcataagtcttaacaataaccatatttctccattgttgctctgctaacagtattaattaagattgtaaaactgtatttattttatgtgccttagttctaatcttatggagggggaaaaccataatgtttacattttaagtttggcaggaaagttggccgaaattgcagcctacagattttatttctagattctatagtcattgttctcaacttgataagagcaaaccctgctctatttgatagctttctttggaaatgcttctttctaacatagaattgttcagctgacatcagtgttaaatgggaataggatatgcacaaaagcagaggttgaatccatacactcaaacgatgtagatttatacagaaatgttttttctctcaagctttgcaggtcggtttttgccatttgttactaattattctgatgcataactgcatttgattctcatttttataacaaatgctgccctgctttcttcaagtacagaggccaggatcatttttgtcggccatgattgtggatataatttctagaaagctgccaatggcatcaatgctcttcacaagctatgttttcttaatcctgctaattttctctcaaatggacattctaacaagaatctccctgtttggagcctggttttgtatatctgctagcttcacaattgtatacatatatgctggagtgcgttcagttctctctcacatacttcactgttacttgcacatagtagtattttttgtgccactgttctgacaatgatcatttattggtttcactatacttacatgactgctgcccatctcttcagacttcactccctgaggagattcaccataacaatacagtgagtttccatatatttttggcattgattttgttacttaattatgggtttaggattgattggacaacctaccttgcattgcttaattgaagtgttactacattgttggttacatgattacttgtatgccattgtagctttgatttggggcctaggaccctatttcaccctctgtgccacggtgcaatttctgatatttaattgtgtttgcacttgtttaccagaatggcatcttaagtgcaggtttcgtcttgttgaagaattcctataagctttgtcattaggattacagcttggctaagctattgtgctattgaccatatcaaggaacatgtttcttacctctcccacggattagctgcagttgtaccgtgttgatgatgtgagattgggtagcctcttccctgtcagtcgaaggcctctcccgtgccttgtcgggttggtcctctggattaccaacctgcggtaatgtgtcgatgtcgttgcccagccaaggcggtgagggtggatcttgtagagcatcgacaaccctgcgcggtggtattataagtgtcaaaacggtcgagtaaatgatggattttggctgattttgagatgaagttgcatatacgcagtcggtgttcttcggggttgaatgtagggtctcttgttgctttggggggggggggggtgatttctaggttcgggtgacttgcgagacgctgtgacttcgttgaggagggaaaacgaagtgctgtggaaggaggttcaacagagtagggcatagggggaagaacagaggaaagcggtagatgatgtaaggagtgtggttgctctgaacaaagaagaaattagaagtttgaaggccaggaaccaaaagctagataatgagagaaatgtgcttgtaatttgtgttttgtcatgtctgtttgtggtgtttgtgttgttgtttgggaagaactgagattatttgatgtgtggtctataatttgtgaacaagatcgtgtgtttggtatgcattggaaacaacatgtttttcatgaactatatgtatcctgagttgtggtaaccatttggaatgaatgttgtgaatgaatggtttatatgtgcaatttgtgcagcaaacctaaataatacaccaaatgttcaatttttgaacatgacaatggcatatgtttcagctagttgcaaacaaggcacttttggtatttgcaaacaagcagaaagattggatgatattgcataatggaactgaaatatttttctccatcattcatacaaaagcaactgaaattgtctgacattacatctcagataggtggcatagttagccaaattgtctggcatcacaacaaacatagcagaagttctaggctaataggtctgacattacatcacacatagttggaatattaacccaaatagtctggcctcactacgaagaaagctgaaatactgggctaatttgcttgccattacatcataaaacaagtacttccattactctaacagtagtaaacgtgccatattcagagcttgttagtttcccatgggggcagaagaagaagtgccccaccagatttcttctttttcttggtttgtgtaggttcttgagttgagacacaaacagatgctttgccaaatgtgagtctcacatatgaagttgtagagctctaggaatggggaactatggcttgcatatcaactctagctgaaccaccatgttctatagaaactttagccttggcatttaaccctgaccagctcctgggtctccattggtgcctgcagtcaaatatatttgcatatgttgaacttgtagtgattacaagtaaactttgcaagggagaaagatttgcacataccttgttcttggtttttttttgggccatggattgttgggttgtacttgttgtacacagggtgactgtcttcgtcttcgtgctttgagcagaactccctgctgtgcttgacaacaccatttgctgaccttgagatagagctgggacttgggccgtgccgggctagcacggcccggcccgacccatcgtgcttcgtgctagaatgggccgtgctggcccagcacggcctgctaatcgtgccgggccatgctaggccgaggtggagaagacaaggcccaagcacggcccaaagacatgtcgggcctcttcgagccgtgccggcccaagcacggcccagaattacctgaggagtcgtgtcgtgcctagggttttcgccggggcccgcgcggccgcgccgacccgccgccgccgccgcgtgctccctgcggcgctgcccgtgccagccgccgacgccgagagccgccgcaaaggaccgacgtcgtgcggccgcacatagccgctgtcgtcgcgccgcgcggcccgcgccgagggcttcctacgccgagagccgccgccgccgccgaggaccgacatcgcgcagccgcgcatagccgctgtcgccacgccgtgcggcccgcaccgagggctgccgacgctgagagccgctgccgccgaggaccgactcccgacgccccgggtgcctagggtttttgcctctgaccatgtgctttgcccgatgctgattgataaatgaaataataacaggggaaaaatcagggtaaatgagagaggaaactgaaataagggagggaaaaaataagagaggggaaatgaaaaaacaatgagataataatgtacatggcttaatgaacacaattagaattgacataatatcgtaaataacttgagacaataaaattgggggaaaatatatatgttaataatttgaatatatagttgttgcctcgttaaaaaccttacgccctaaagtagggttccccgtaaggaaaaaagagtacaacaactattttacattataccatcaattactccagatcaacaccaccatcatctttggtaaggcaaatttccgccaatgcgtcttccattgcatcggcaaactcttgatcatgtagacagtgttgcgttagttcgtctgcttccatccagtctttaagacaaaatattgacttaaccgtctcgggtgtcaggcatgaccattgttcttcaataattcttccagtaacgttgaatgcttgctcggaagagacggaggagctggaaccagaagaatatctcgagcaaagtgagctaacacaggaagagttcgctctttctctttccaccacccaaggagatcgacatcgtggccatcaagcgtcggatcatgctcagtatgattggtggcgaggtagtggttaagctctgaatccgggttccatgttgatttgttctctgaggatggagaggcttggtcgttgcctatatactgcatccacaaatttactgcacttgacttgcttgctttcttttgtgaggtctgctcaggaactcggggagtaccaccaagcttggttcggtatagacggaaaaccctatagagctcatcattgacatgttgaaaagcttcagaataatcaagccccactgcatcacctattgagttcatggcaaccttggcggtttccaacttttgcgaggatcaagtatcaaagcaaagcaataaaggtgaggtatagcggtgaagtatttgagaaatttttcttccatgggtttaacaatggaagacaatacgatcagaacggttttcatcaaaaacaagtgccagcttccaaatccactcaagcaccaaacaagatgtaggatagtaaattcctgataattgagctatagcattataaaagggcttcagaaatttatgcacacgtgtagcgatctcccactcatgattggtgagaatcacaatctcaccatcgccgttgtcatcggtatccttcattcatatttttgaaacagtagacggtaggagatctaccggatatattagaagaagagagttgaccctgtttataaggaaaaccgggccttacaactgcatggtttgctaaggggaaactggcaaacccttacacagaagacacaaaaaagcctgtaacaaaactacgaaccactaaagagaccgagggaagagcatgacctttaaggcgaagcctccaaggaggtgaacaacgaccaaagccattgttgacgcccgcccaaaagttggactgggttttcacccaaaggtgggagagagtccacaaggaaacacctccaaggagggaatggcacccgtaggagtcgatgttgctgatcctgaaagaccaggcaaggcttacacccaacactctcacaaaaggtgcaggacctccaagaagccaaagtaagagtgttgagtgttatcgttgcccagctcatcagctgacccgatgcagcagctccgactccgccttaacacaagaactctcgcaccctagaggtaagcactccggtccaaactcggaaatacagcaggttcacacggtcacagggcacaagaagcaccggcgaggcccaaaagccctgattacagtcagactggaccaaccccacggacaaacaaactcctcaaccactgagagactccacggccggatctggaagcagactaccaaaagaagggaggagcaacaaggaggaaaggaggcaggcaggcctggggaagaactgagagctggaagcagggcaaatgggcatcggtgtcaaccatgtaaccggtgaggagctccaggcttcgcgggatgaacctttcgactgcagcaaccacctccaacttcaccaccagcacagagagaggggcactggggtgatcagcaaggctcctagacaactaagaggaggggggcggcctccccaatagcttgtgccaagaggcggcaaatagagaagagagaaagaaggaggaaggaaagggagacgcatgcctcccccaactgctagtgccgagagacagcagcgagaggaagagagataggagggaaggaaggagagaagagggtggtttcaggggaatgggggtggccggagacgctagcacaccccccagtatgacccgatgtgccgcgaccgcaagagccagctgccgccgcagccccacaagagacggcctctgccgcccacatgccggccaccacccacatgcaagcaacaccgccgccgcacaagccctcacgctgcaatagccacgccgcctcaccccgacgcgccgccgaccaccggagctggcagccgctgcaacggcaccgcgagcgccggcaactgaccacacgcgtgaacaccgccgcctcaccacccatcgtgctgccccgtgagccgccacgggccgcagcggccaccgctgcatcgcgccaccccacgatgctgccaccagagctttcccagatccgatgacagcggtgccggatctgccgctgcctaaccgggaggcctccctgactgcactccttgacaccagcgaacgccaactcccccacgtagagagggggcgccgccgcggaagaggccctgccgccgccatcctagcttgccagtcggctttgccggcggtgagctccggcggtggtgaggtagagggagggggagaggggagcggcggtggcggcggtagggtttgccccccgtgtcgcctgcgcgtgggcgatgcgggggggggggagggggagggggacagactctcggataattgtctagttgtatccttcattctgacatgcatctaattgatgaaaacagaaattaactcctcctacccttttaactgtcgcagcaataggtatgttttgttccacctatgtttgacatcaatgccaaacatccgtccaggtttcttcttcgctttacagtagtcctggaacctcgctttgaccactgtgttacctcctatgatacgaacagaatgacgaattttgtttaacaatttatccggaacaattatgcctgcaaaacaaataggtcgcatacattaaaataaataagcaatatgccgcatacactaaaatcaataaattattaataacattactacctggttgaacgatgagattgatgatgtgacaaatgaatctctgatgaataacgaagcctccaacataacttcgcagatccgactccaaaatcgatatggccgttgtgtttgctgatgcattgtcaagagtaatagaaacaaccctagattgtaaattgaattctctcaatacctctaggattgtcgtggctatggcatctcccgtgtgtgacgtcatgagttggaaccctatgactctcttatttaatgaccgattgttgtcaagataatgaagaacaacactaaggtaagatgttctttggtgttgggatgtccagatatccgatgtcacagcaaatgaaaaactagtagtactgaaagtttgcttcaacacactcaacttagaatgatatatagctgtaatatcgttcttggtggttttcctagaaacctttttgtactgtgggcaaaaagctttttggatcattctctcaaaatgtttgctttcccccattctaattggtagatcctcagcaataataaacttagcaatctcttctctagctatttttggatcatagatccatgtacttacagaaccgtcagagccgaaggacaattgtgtctgtcttgctcctgccggtgccttgttcttgagatgcgccaagtaatgccggttgagatggcctgtccctgaagaagtagctgcagacaaaattttgtcgcaatatttgcattgagcacgaggtatacttttaccgtcaaccatctcggtgaatacttcgaagtgctgccaacactccgctcttctggcagatggctggttattggaatttggtgtgggcaacgtcatggcgttggtgtcgaaggagaagttggcctcgctaggagatggctgatcatcgtcgtcgccctccagaccatccatgtggcgatcatgcatcccgtagtcatcgatgcccagggatagctgtcgggcatcgaccgacctctgggatggaccggttgttgactcgtgttgacgctttttggacctccgcatattttctatgaaaaatagatacggtggggagatgtgttgaaagaagaagaagtgtgttgaaatcaaaaaaaatgggtatggtttatatagggtatgctagggctgggcgccaggctcttcacctctcccttgcctcctcggttatcagccggcgatgcgtctgaactctgaacgactcctcggcggctcgacgccttgactgatgacagatcgaccaatggccatgccgtgccatgagcccatgacacgtgactaaacgactcctccgtgctgaatactgatcgaccaatgatcagtcatcagtcgacacctcgaccgttcgatgcgtctgaactctgaacttccacgcaaatgaacatgctttccataattccatgcatgcaccattgcagtaaacaaggacacaggtaattagccatttaaaaagttgaaaaaacacaaacaaaaatttaattgactagacagtggatatacacgatactaatcgccaatggtaagtgatcccagaattaattagccaaaaaaatcatgctttccatgcatgcacggctctctgaattctgaaagactgaaagcactgctcataagttactgatcagtattcagcgcagccgccggctgacctcatcagttactgaacgcatcactgaagtctcaccacgcacgcacgcgctcggcggctcggcgctcctgcctcctgatctcctcccggccggcccgaattgcacgcactcctaactcctcgcgcgctcggctaggctagagctcgggccagcctttgggcctttttcgtgctgggccggccttcgggcctacgagcctttttcgtgctgggctagcccaagcatggcccaactacgggccgtgctagcccggcccattgccgtgtcgtgctgggccgtgctttccctcgtgctaggccattgtgccttggaccggcccgagaaagcagggcccaagtcccagctctacctggagatactactggttaagaaccaactatgcctaaaccggctataagttcaagtgccttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtgtgagcttcctatttgatctttattgattatgtgcatatgtgttccttcatatccatatgtatgcacatcttgagggggagcttattctatattttgtttattataagatttctatcttgatttgaaatcatttttcatctcatctctctgtattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtataagttttatgttggtctacatcattactacatatgccttctctatatgtataggataaacccccattggtcattctctaattatgcatacacttgcatctcttgtatatttatttgtatgcatatatttagggggagcaaatcctatacatttattgtgcatgttctagatccatgttgttcacctattatttatatcggatctttgcacttgagcttgcatacgagtatatgacacttgtgaagttaatgaatactcaacaaacatatccatatctttcatatgcaaccggttggtcttcaagtgaaggatgacaaccgatttgttgagactaatgttctcctttgaggtgtgaaaaggaataggtcccactatgatgaggctaatgaatgacaccatgggttagtggtcatcaagccaaggacatcgtcatgttaacaagaatgaagtcaagcttgtgatgagaataaagtcttgacaaaggatggacaagacctcagcataaacatggttcaaccggatggtcacaagtgttgatctcggctcaagcttgaccccaagatggatggcgcaaggcaaaggtataatgtagctaagaatgttttcttagtcttttcccggtcttggtgtttggtgtagaccggatttgctagatagacgtcgtactatcaagaggggtctatgaagcgagcttgtggatgatcttgtgccatattagttcatatgcatgtaggtgcattttgtgggcttgtctaaccaagtgtgatgagttttctcaagtcctaaaccaagagagaagtgggcatgtccaataggagtgagtgacatcttgtgggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcgccgttttactaacggtcggttgagctgaaaagtgacctgcggtctgaccgtgggcattaggccggtctgaccgggtctgttagccggtctgaccggcgtggtaaggccggtctgaccggccccactggtttgttgcactggtctggtttttggtggcgatacagagctgccagagccgcaaccggtcagaccgagccgacggcggtctgaccgagccgtggacggtctgaccggccactacactgcggtcagaccggccaggttgagtgggctcaatgattgccctgtaacggctagttttctagccgttacaaagtagtccggtctgaccggcctcacaacggcggtctgaccggcagagcacaaagttggggatttcggttccaacggctagttttggtggttgggggtatatatacccactccccagcagcaagggtaaggttttggcactccattgcattatcttgaaccccccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgccgcctcctagacggcttgtggaggtgttgcccggtgacctctccgaggagattgtggaggaggcccggcaccgtttgtgagtggtttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgcctcaacggggattaggaaaccggcgagtttccgaacctcggtgaaaaattccttgtctcttgtctcatttatttgttgcatttacatttgtgctatttacattcatagagatatatttgagcccatatcacttaggtttgcaaaacttaacttagtttcttagttaaccttgcacctcaccttgcctagcaacttatgttagttttgtttaagtgccattaagttttaaaaccgcctattcaccccctctctagtcggcctccttgatcctacaccggcaacattatgctttgcataccaagatttttggtgcccaacctgcttgcaccttgtgcatctggtcactgtcccaaacttggacatttttgttggcttgggtggtttatgcatttttctgctccttccagtccttggtatgcctggcatctttatgtatctaggagtattgagtggctctctatcatcctggggccaagaacatatgtacttctgaaggcttccacagagtaacaaggtacaatgtagtcatctagctcgttggttctataaaagatgcatgatattacatagggcatggctaccagtaactataggagcattctttcttgtccatgtgtactgtaaatctatgttcatggtgcttaacctcaaaacgatcacctccattgcaaatggcatggcagaaagctgactcactgatgtatacattaagtttttttcagaatacctaggcatacaacagttgtccatctagcaccatttgttttctgatcactgatcctaaccatcatttttctcctaattttcttaagcattgtgattattagataaaacttagattctagtttccatttgttgaaagattcacacatgttgttgtccactaagtcacagttagaatctaacctgaaccatgctttgcttaggatgtgtgttgaggatgggttgtgctccagcctgaatcagctgaacaagttttgccctagcaaggttaaataacatcccg

SEQ ID NO: 49789 - DNA, 5019 bp, Oryza sativa
agtgcccatttctgcacagcattaaggataccctgcatagcaagtaaaaaattgagtcaggaacatgttatggaaaatgagaggggactgaattagttatggaaaatgagaggggactgaattagtgtgtgatcatattacctcttgttggtctgaaatgaagacccaaccagctccagtgtcaatttttaggtcactgcaaagcaaatccataaaccaatcccattactcattgttctccttggtaaccactacccatgcaataggatacatctgattgttagcatttctccctgtagcacatagaagctctccattggttgctcccttgaaaaagcagtcatctagtccaataactctcctgcatccagctgagaatccttttttgcatgcatctaagtagatctaaattctcttgaaaacttgtggattcaagccaatttccctgttcacaaccacaatgctaccagggttacttctgagaagctcaagttgataattgaacaacttttggtactgccccctagtagcatctaagtgtttcttcataaaaagccactttactctcttcagctttgaaacagaagcttatgcaaagattgatttgagaatccaaaatagagccctacttatgacacatttgcacaaattttacagcaaagctcatgtaccttgggtaaatcttatttggtcctcttattacaaggacacagttcctcagattgtgagaagttgtggttcgttttggtggagggacatctttcagtatgatatattgtttagaggcattgcaaaacaaattataggctctgggatagctattcttttttgggatgatttatgggagggagttatacgttccgtcaaatatccccgtttatactccttcgcaaagcacgggaatgattctattgcacaacacttggccagaggcccccaagatcaattcttcctacccctctcgcaacaagcgtttgatgaatatatggacatgcaagaaaatctccaatctcttaccttacggaggttgatgattcatgtacattcatttggggatcagggaaattcacttcgcagctctgttacaagctcagttttctagctctgactcccccacctactatcaaatggatatggcagtccaaagtcaatatgaaaataaaggtctttaggtggctcttcttcatggatagggttaatacaagggatctccttgatagaaaacactatgcgccacccaatacttcagtcctttgcctctcttgctcagctaatgctagagaaactagagatcacctgttcttcctttgtccttttagtttggcttgttggagtcgtctgggatggacatggaaccctaacttggattttcatcaaaggatccaggctcaaaaagtggctgtcttgcatccttgctttatggagctattcttaattgcctcatggaatatctggaaggagaggaatggacttattttccaaggcatccaactctcagtgcaaaactggttgatgaacttgaagttagatttgagcttacatttaattaggctcaaagaatgttataggcccctagttcaatcatggatagatcaattgtaatttaactgttttttccttcccttttttgcctttttccttctttgtacatatttctagaaaattaatataccgtgggggcctcccccactgtctttggttcaaaaaaaaacagaagcttatgcaaatatttcttctttgactattgctttcatgtcagccaggggccaagaaggattgacagatatgaagttaccatacttttcagcaatcctaacagaggtaaccatctagttatccctcctaggtggacaagcatgcaggttctcaaatataactatctgccaactgtctgaccttgaattcttggaaagaagacatacccggggaatagctaccccaatcacaatttgccctaaccctcttggcatcatccctaacaaagttaatgactttcttctcagcaagagcatatgttgtgatagctttcttcaattgcttcttgcagttgaacttcatcccaggttcaaatgtaggaacacatgccttcttcttgtaccttggatgttgactacttttcattctcacctccccatcactaccaatttcctctactaactcctcttcatcattgtctgcatatggggttccattcccttcttcatcactagcttgcattgtcggttctgacctctggctttgcaagaaacaatcatctaggtcctctagctgccctgccttcacctttctcttagtctccttgtagtgcttctctatctcagcagcctcctcctcatcatctgtcacacccagaaattcactagtaatttccgaacttatttgtgcattaaatcctcgtccaggaatcagccgaggtacacaaactgacaatttaatatacagattcatcataataataacgtaaatacttacaaaagaaaagaaaaacaacagcggaattacggtctagcgaagctctggctccactcccacaggcagctcaactggggtataagccaaacgttttctccttcgcaacttgtcttcaactgaggtttgattgattattgcaaggtgagcatatgacatactcaacaagccacacagcaaatatgcaagtgcacaaggataccaaagaatggcataatatagggctcatttgcaaaagcagcatttagcaaacatttgaggattataaaacagtagagtaattaatcatcaattttaatcaacactaaacagcacacccatgctgctcaggcccaaccatcctgaacgaccatacccggctgtacagatctatctccaaaccaggaatataccattccaaaccaggagctaatcaaattattaccaattatagcatcatttattatggtgagaagtgtgagactaatcacgaaagacattgttagacccgcccataaccgcgggcatggctattcgaatagttttactctggccagaggtgtaccactgtacccacaagacacagccccacaacatgtcaccatgcgcctcaataccaccacggtacctcggaaaggagctgtgacagtacccctcgcacaacacaatccaccatagcgcaccgttcctggatcataatcacccccttataaacaaggcatggactccccagcgacccccgtaggcttatctccgctacttctcagtctgatgctccgcaatgaaccatgctatacaaaaggtaaagccgttgtccacgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgatcaaccatcgtgagcttccattaaatatccataagtgatagtgaagcatgatttatcccattagtgagctattgtttctaagcatggctaagcatctattataagcatctagctgaaccaaaccaatatataaggttctagctaatcaaattataacccataggaaaataaagtcatctttggccataattaaatgggaaaggctcaccacccggtgacattcgaaaataaatgcacagttcaaataaatagagaatttaaatataggatcaacatgctcaaaggaattgtgtttgggatctgtgtgacttgccttgcaatattcggtcttcaattagtcttcttgaatacttccaacacctcacgaatccttcgaaacgacataaacgacaagctaacacacaaaacgaggaaaaagactaataaaaaccaaataaacagtacataaaagtaaacaaacatgtagatcatgattttagataaatttagagacttgaacggtctcattccgatttcgtatgaattaattacgaattttacaagatttaattccaattaaacctattaaagaaaaagactattccacattaattaaaccatttacagatgatttataacggagatgaaagattaaaacaaacttcggaaaaagattagattatatttggtagatgacatatgataaaaagaactaatatgccattggaaagagtggaaatgatttatattgattttgggcggctgagattaatcttgaccgagtcgaccaagatcggatgacttagattgatctggcaagcgagcctcatgagataccgactcaacgagtcaactctacgtgacacgggatcacccaaatgatcaaccgaaaccggcgaacggaaccagcggctctgaactaaaggacgactcaacatggacgaacgaacgaagcacggggaacacctcgttcgaacaaatgagcgaacgactcagcaacggctgcaactaaatcggtgagctagacacaattcacggtaaagccccggtacggcaaacgataggccggcaggaatttagggatgcacctacagctagacaactcaactaccgagcaacgggctaaagcggcggctaggtttaagcgacgcacggctgcgacacagtacagcagcaatggcacgtcacagcacagcggccagacagcagctagcggcaagcagttacgcacagcagcagcaacacgactgtggcagggagcggcacaacggcagctagacgactagcgcagcggtgacagcaaacaacagcggcacatccggtagcgacggtgcacgggctagggcagcagcgcggcgaacaacaatgcaacaggcacggctgcggctgtgacaaagcggcttggcaagtgcggccgatgggttgaaatctaaaccaaggagacacggatagacgtcccaccgaaccaatcggggagagatagatgacgacggtgaaccggcggcaacacatggagatgacgacactagggccaaacaagattagattagattagatgggattaagaccctagggataaactacactgggaacggcatgggagcggcggttgccggcgaatcac

SEQ ID NO: 49790 - DNA, 2384 bp, Oryza sativa
gatgtgcggcgacaacggaggggtggccgggcttcacttcgcagctgtgaatccaatggaggcagcggcgaagcttggcgatgacgggaggagcagcagggcttcgccggagatcaaaacgcgacggcgagcttcgggttgacggcgatgatggagctccggtggatttcggcttcagggagatggctgccgggctccctctccttcttgcgaacccaacggcggcagaggcgaccaaaagcggcggctaaggcggctgctagctgcggctggagatcggaacatgacggcaacccactggttcatggcgaggacggcttccggcgaagtttcggcgcaaggggaacggcggccggggtggagctcgaccttgcggagccgatggaggtgacggcgcaggaaggaggcagatgaggcggcggctagggacggctggagcggcgccggcgtttggagagagaaggagagcgcggggagagcgtttccggcgacggcggcggacgggaaatgagaggatagggagaggacgactagggggtcctttgtataggcacgggagctcgggatcaagcccacaacgacgggaaaaactcgggaaagtctagggttctcgccggaaaaaggaaggatttgatccgcgaaattggaaagaatttccatagaaaattttggggatttcttggggaaaaggaagaggagattgaggggattccattcccgcaactaatttggaaagaggagcaacggggaggtcggattggtgggaggaggcggcggcactgtgcacgagcacggctggctcggctctgtctggaggaggaagatggagtactgtagcgcgggggaggcaaaacagactttcggccgggctgagaggaagggagggaatgggctgaattcggcccaagactaggaaggatgattttattgcttttccaaataaattaaccaatgagatgatctttcaattgttaaaaatactttcaatgctcaaataattccaagaaaaatcttgaacatacttggacactcaaagtatttaatataataatatccagatcatttaatgattaatttattatttaaataattgctaaactgttctttgtattattaagaattgagctctgaaaaatccaagaaaattccagagagtataattaatcatggagaatttaataaaaattaaatccaaccatgctttacatttaggaaattttatttcccacatttaacttcacttgtaaattcgattaataatttattaaataatttataaatccttaaacgaaaatcaggctgtggcatcatctaaaggagcatcatcccctggagtgtaatcactgtcaggttcaccgtcagaaggtggctggctatcaatgggtgttgactcaaagtggtcaacactatcctcctatatggtgtttactctaccattgctttacccttacatccactaccagcagccttagtaactcctttacctttggatacatctacttcaacatccttttttgcacactcttcttcactgtccatttttaattccatgtatgcctcataatcactgtcatcatctgacccatcacacaaatcaataatttctggctcttcaacatacacatctaccacatccaattcaccagtacaatcacatatcaatttgcaagccttgtaatcataaagagcacgaaaacatgtttgcaatgctcatgcaggtgtccaaataatgttccagtgcagcaatgcttacgtaggaaacaaccagtgcagcaatgttctagtcatcacattgcaatgctcacgctggtgtccagataactcaggcaatgacaccttatttcaatctatatatgacagtgccttaaatccatcacaatatttcttctcaataccatctagaacatatacccccttcatatgaaacctaaccacaagagtgttactcgtccatgatatcgaaccccttcatgcagaacaacaaaatagaatgatttagggtgatattaaatttctgctacagatatgacaagtccaaatcccaacttttgcacagaatgccgaataaaatatccccttatcaagtacaacactaactaaataactcccaacctacaccaaatccaagataaaaaaaagacatctaccaatatttaaaattgttcttcccgcatcccactaataccatgcagccacagagaggaaagggaatacctaccaattgcttcggacttcggattacgggggaatccttgctgacactacccttgttggctgtcgcgcgaagctccaacttggcctctaggtcgcccaaggtggtccgccacatcctaagccatgcctagctgcaagtcgagctcgagctcatcagtgaccacacccag

SEQ ID NO: 49791 - DNA, 7141 bp, Oryza sativa
aactacgaattgttattttcagctagcttgatagaagctccctacaacaagttccctggttttccttcaataatacttctgaagttcaacgtaacaaatatgggaaatagttctaaacttatatacggaatagaattaccattgtcagctatttactgtcagttcaacattttaaaaaaaaggcatacttcgcattttcacgttgtacatagcgtaaaaaaaagaacatactaaaaatagtgtaggtttttatgaaatatgtccatactttgcactttcacgtggtacatatctaagccaatccaggtcaaaatttccatgatctttctttacacgcttgagaaaagcctgtaaaaggaaaaggaatacttttagtgctgtgtgtcaaatgcacaagaagaagaagacaagaaatatgtgagagttccagtaatatcaaaaccatagcttacatggaaaaaaatgatctttccactgacaatgatgttaaaatcaaaatattataggtaaatcttggtttcttgcataaagtgtggagtttttttttcaggaataaggaggtcgagcttagatcatagctgatgtttcaatcattttcttattggatcacatatatttttaatagatacaattatgtggataagaaaataaaaggtatttcaaatatcaacatggtctgtaaactgcacttttgatcatgaatctattaattgcatcagtagtaaaattgttctttcaatgggcattttaaaatttaaacaataaatgttctaaaatgccactggccacacatattgcgagaatagaaatgtaccatatatccagggtatttgaaaaatgtagtttaaatgcaaagtattagtccgttatgtcattagtatgagacaatgtataatctataatgtatgaaacaaagtaataaaacggtccatctttaagttcagatttataagacctatttatgtagacatgctgtaagcaaagcttatttcaatagacacacatgaaaacagacagtaagtgattgaaatgcctacttaaggaaatgaatttggttaagaataatgtcctagtaaaaaaggatgctaaactagtaatgaagtaatattgaatacataaaccactttgaaactacagatatatttaatccgatatgctggccaaaaatgatacaaaatggtgattaagttcaattttgcaaaaggtgaatatgttcatcgccagaacgaaggtattcaggaatatcttcctgctacactaatgttagaacagagttttttaaacaagcaaatagacgtgtatcttgcaaccttatacctgtatccgcaatgctataacataatgttgtcccctgactgcaatggaatttgcaatctcaactgctggtgcatgtagcacagcttcccaatcagcagaatcacttattccggttccctttattttgtatcccttactatatgcttcctcccgtaacttatcccaatgagaagtgtctttctcctcaaatgtgtccataaactttctcaaggttctatgggaacatactggagttccagacttatccttcaccatgttctcaaggcgtgcattgtcccacgtagacatgtctttatgatgtttctcaataatagatataaaattctctataattgtactgtagtctcggccataattaccttttacctcctcattgtaaccattctctttctcaaaatcgacaggttttgtaaaatctgaactaccagaatcagtaccattagattgttcattcaaattcaatttccgtctcatgtcatctatcaacagagacaaatttgaacatgcttcagcattaatatgtctcttagttggaggaaattttgccaccaggttcaaaaaagcattgctgcatgtttattgaaaattataatcagaaacatgaaatgcagctgatagattcgctccagcacaaacatgtaaagtagacatcagattgcgtctaagttttaccttgataaattgtcagcgacattttgcgtaaggaaagtacccacaacagaatcagttactgatcctccccattcagaaaatcttctgggacctgacagaaaagtagtttggatttagaatccaatttaaatctgcatgtttcaatgaagcagaggattccaagactcgtttcatcccatacgcatatgttgtataaagtggacgtgaggctctattgctttgaaatcattaaccaggaataattattgtaccaacgatgaaaaatgctgctgatttcatttccttggtttttcagacaaaaactgaagtaaatgatttgatcaaattatacatcatgctgattggtttttttttctcaccgacctacccaagtgatgttcatacatgtgcttccaagtttgctcagaaaaatgcacctgattgattttaagtaatttcaccccaatttagaaactaagagatggaaaataaaacagctggtcacatttaaattaagcatttcaaaatctggagtgtacaacttggcgcagttattgattgttctcttgtttagaactgtagactaataaatcatcaataagttcatttcttactaagatatcatttgagccaccaggattgcttagtttttgtaagagttcacaaatcttcaagcttgcgcttacttttattccaaacaaaacactaacatgtcagtagagattttcaacataaaaagttcagtgcttttgtgtgatgtgcatactgaaatatctcctggcttacttagacaaaccaaactacaaatatctcccagcctacttagagaaatcaaactagtagtgcattttgcttgttatgtctctatacttcttatgttctatcatgtgctgcacacatgtgaagagaagaaaaaaggagaaaaagaagtttctagaatccggactattacccaataaaccatgcacagtagcaataaacacatccacgtaatgttcgaagtgacgccgagtttcattccattcaggcccgctgccaatgtctacaccttcgaaactctcactatcagtctcatcccacttcctcagaacattatacacttgtaatgtcttctcatcaaggcctaaaacctttgtccgcaagttcttcaagtgatttctgtggtgtacaatagcaagttgcgtagaattctgaattggaaccagcgcagatgatgatgtggcagctggggccttctggtaaggcacaagggccgattcgccattgtcctgatgttctccagtcatcttttttcttttcttccctttcttgcttcgcttgcctgcacccagatcatcgcgcagaccatgaaccttggcaaggcacctcaaatcctccatcagcttggctctgctgaactccctattgccttcaaagtccaccgcatcgccttcaaaattcaacttcctcctcactgatttatcaccaagtggccgcctaccattatccttagctttcctcttgatcttaacttcaacgggtgttgccgttctctgggccgccttgtgatctttcataatcttgaatcgagtcaaccccttcgttgacctcttcctgggtctcctaggggtagcctccactttctccggcgtagggatcgcactggcagcaccttcctgccgtgcaatcttgtcgccacattcactgaccggcggcgagacagtggactcctgggtgctggattcctgctgcgcaaccttgtctccgcactcgctcaacggcagcgacacggtggactcctgggtgctggattcctgctgcgcaaccttgtctccacactcgctcgacggcagtgacacggtcgactcctgggtgctggattcctgctgcgcgaccttgtcgccgcattcgatcaccggcagcgagacggtggactcctgggtgctggattcctgctgggcaaccttgttgcagcactcactcaccggcagcaagacggtggactcccgagtgctggatccctgctgcgcaatcttatcaccgcattcgctcaccggtggtggcgagacggtggactcctgattgctggattcctgctgcacaactttgtcgccacactcactcaccggcggtggcgagacggtgtactcctgggtgctgggttcctgctgcgcagtcctgtcgccgcattcgctcaccggcggagagacggtggaatcctgggtacatgacgcgcattcctcctcctcctcctccggccgagacacggagcgggattgctccccggcggcgaccgaacgaacagacgggtcgtcactctccacattaccggcgccaacccacgccgccgtagcagcggaaagggagcagcaagaagacccctccgcgtcggcctccgaccgccgccgccgccgctccgccggcttccaggcaacgtcgggggtcgccggcgacatccccgacagagatcctgctccgaaaaaaaaatcaaaacaaaacgaaacggtcacaaaacggaaaaatccggaggaaaattaacagcacccagattccccaccgccactccgtggaacagatatcacagatcaagcaaaaacaaacatcaattcttgcaaacaccataacaaccaacagatttgccccctcaaaaggaaaaaagaaaacacgacgaagaagtaactcgtgagcttaccaggatgatctagcgattcctccgcctccgcccccatcgcgctggctccagggaggggaaatcgtgtacggccgtggagatcgagtagagtttggtttggtgtgggtgcgtgcggggaaaactccggcgtgaggagggagaagaggctacctatccatccggctgcgtctgacaggggtttaaggggagttagttggggggagctatagccgcggcgtagggtacagtacagaatgggatttttttttctttgtatcgagtccaccgcactcgacgaggataaggtaggtataccagtactagtaataaattttacgtttctgactatttcttcttcttctggctgcaacagctataaattttaaaaaaactgtccgtacttgtctctatatcgagtacggttaatgatatttctttttctcttgcctcatgaaatcacatcatcttaactgttttctaatctttaaatattagagcaaccataatatttgaaaagaaatgctccctccgtcccagaatacaacgagctttagccttgggcacagctattaaggaagccaataaatagaccatactaccctccatgatatgctctggcagaaaccagttgcgtcagtcactggcgtgtacaaataaagtggcagcacaaactgaatatagaggctaaagtgtgaacacattaaaaatctactcaataatcacaagcgatagacaaaacaaaatttgaaccgctaagcgccaaatattacagctgaaggcgtgccaaatcacatggcttgcctgcttacataaatcaaaaccaagctcaaaaatcactagcgctagcacacttaagcatcaaaacactctcctccatccacaacatccatcaagagagaactcaacaccatccatccacaacccaacaaatacacgaggccacaatgaacatagatctgaacctagcactacaagaagatgaagagtgcggtgaagaacatggtctccgacaagatgatgtgcaagacgaagaatatggtaatgctgccctccaacttgatctcaacctgcaagctgaagaagagaagtatggaaaacaaccaggtatgtgttataaagaacatgattaagtttttgcataacaaagggattatatgatgatattgattgtgatgagcacatttcatgaccagtgatatgaaagacaagaagattatacatgctaaggattttagtatcaggagggatcatgagtagcttgctttccatgcataagttgaacttagtagtatatgcatacctctgatcgggagaggagtggctttgttgacgcttttcatcatatgcacaaggcttctttcttgctgtcaggacttaggacaagacatgataatggcagcaatgttaaaaactcaaaaataatataggggggaaatcagattttagtgtacaagtttacggacttctcctaccttattgccaaaacccagcaagtagtagtagtatatggtcattttcgtagtaccgtgcttggaatctaaaaatgcatttgacataatctagaatcatatgaatggcatgtaacaaatctaacatcctcatttacactatacttgtaatgtactcatggcaagatgaagaacaatcccaccaagctgaagaaggtgaagaacacgaccaagaacaaatacaggaatatcatgtcactattgcccatgatttcgatctgaacatgcatgatttcgatctgaacatgcaagtcgaagaggaggattatcaagatcaaccaggtatggttacaataggcctaatcataataacaacgagatggatgtagttatgtccataaataattaaagcattatcatagtgtgaaacttattgacaaggtaaaacttattgacacattttgatatttgtagaatttgaatcttatggtgaagtccaacaagagcaagaacaagcgccacaagaccaagaatatcatggtgacgctactcgtcattctgatgttaacatgcaggttgaagaggaggattatgagtatcaaccaggtatcaaatcatttttacaacttaatgtgtgtacaatgttcacaatttatgataaacacatctatttcctccatataatcagtatgcataatttacaaagtttgaagctgaaagttattttttgttccaatgaatagatgacgactttgccgtttatgccaatcatgtggatattggttatggagtagaactagaggattcaggtaatcgcagcccatttaaattacattttgcaagtatatatcacatttgaaaacagattcttgcctcacaatttcaggagggggacaagacaacatagatcatgatgtcagtcatgtagaacatgaaagtgtgaccactagtacaagaacttggttgatagatgaggatcggcaacatgttcttgatgcatgttttgcagacagtgagaacctaaaacttaaaagggacacaaccaccattgttgcaagcttgtttaacattaaga

SEQ ID NO: 49792 - DNA, 13518 bp, Oryza sativa
  unsure (1)..(13518): unsure at all n locations
gaaaaacatagtgcacttggatgaaaaatggttcaataccacagtcaaggtcaggaggttctacctacgccctgatgaaccaaagccattgaggacagtacataataaaaatgcaatcgacaaggttatgttcttggctgcagttgctaggccaagatatgataatgaaggaaattgcacatttgattggacatgtggccttttgttaagaaggttggcctacactttttgattgtcataactttattgctttaatgttgcatttttattttgcttctactagtagtaacatttttatatttgtcttaaaatactacgaactggcaatgaggaatagtcgcaacaggcctaggggcacaatggtgaaaaaaccaatcattgttgatagagaaacaatcagagaatacttggttacaagagttattccaactattgcagcagcatggcctgaaggaggggggactatttggattcaacaagataatgccaggacacatataacacaagatgatgcagcatttgtcaatgctgtggaacaaacaggacttgatattcgcatcatgcaacaacctcctaactctccagacatgaatgttcttgacctaggtttttttttgcttctatgcaataattgacaatacgaaggaatgctgcaaacatcgatgaactaatatctaatgttgaacaggagtattttgattatgctgtagctaaagctaatcgtgtgttccttacactacagtcatgcatgataggttatgaacactagaggaggcaatgggtatatgattccccacaggaacaaagaaggaatggagcttcatggtgttcttccaactagacttagttttgatcccataatatatgaaagcgcgatgcaaaccttagctcggtgatggatcgtacaatatatgatggtgggatgcaaccatggaatcatattttgggcatgttttatttggaagcattatcaaatgttgtcatgttttggaagaaatctaatgtgtgtgtgcatatgtatttaatggtcatgatctaaatatgaagtttgaatgatgatatgcagttgtgtgctcacatgtataagcaattagtagcggtttagttaacttatgtgttaagtaggtttatgttcatccaagacttaggtggagaagccaactgaatgtgaaattatttaacataaaatttttgtatgccaaaatcaattttagaggctatcttgacgacattgcaaatttgattattactagaaaaatgcccgtgcgttgcaacgggtaaagctattttattattattattattattattattattattattattattattattattattattattattattattattattattattattattattattattattattattattattattattattattattattattatatggtttagttaaggtgaaattcactgtgttaaattcgcttcgatatatattttgttagaaaatcgtgatctgtaattgggagttcgatcgtctcaaattaacatgcgagtttttgaaagagatttctatttgcaaaagcgaacgaatttaaaaaccaactccaatatcgacttgtatttctaaaagcgaacaaatttaaaaaccgactcatacacggatgatataccaaagtgccggcaaaaacatctctaatttttataatagtagagactagatccgtggttcaacttcaagaactgataagactatgctcaattgatgaatggttctttttcagtagtactcctctaaggttaaggtgagacaaagcagagtaatgaaatgagatagctctgttgaattcaaagcatgcaacaaatccatcaaacaggaaacattaagcatgaaaggtcttaattaattaaacaaattgatcaatcatcccatgcttacagagagagaagggcacatatgctactccattttcatttgttacatgttcagaccatccatccacatcatagtagttcagccaaaagagcattccatatttttagccatgatctcctaattagtcacctaacattgctacaaatactactcctactcaatactaatactactgctactaatacttgtactggtagtactactactccgacaatgcatatccttagtgacgtatggtgaagtaggctgggagtaaaagcctcaacataccttcacgaatttcagcaaattcgtcgatgccctcgtcgccagccactgtgtcatcatcatctcctaggatggccatctcctctacatcaatcggctcttcaacgtcatccatctgttgatcgtccaagtcggtgaagaggccgttgttcagctgctgctctccgttaggcaccccagcacccacttgctcttcgaagtcagggacatcgctaccaccttgcagctctgacttggggacgaagtagatgtccttagtgccgagcaccgctccacacggtgccctccaccacccacttgtaactcggagtcgggaggggcgccgccgtcgggatgttgctccacatcggagacgtcactaccatcttgttgctccaactcggtggtgaagtagatgccgtcggcgccaaccacaccaccaccatgccacccgcctcctcgtcaccttccaccacatggatgtggtgagtccacactactttcatcctccgacacaaagaggaacctgttagcaccacccttctctaaatcttggacaaaatcgatctcttttacaaagatggataccttgttcttgcctttgagagacacccaaaacccacgcctccagtattctacttgtcgctgaacgtggtcctctgtagactccacttacgctgcggctttcgccgccgcttccgccaccctccgcttgagtgtgcgccttctggccatgcacgctgtagccatctccaaccgccgccgcgccatctccgaccgccacctcgccatcttcgaccgtcgtgccatctccgactgccgaatcgaagaaccgcagctagaggagggattggggataggggcgacagaggagggattgggatctagtgagaggatggtcggggattggggatgggggcgatgggtgccgagaggagggattggatcaggagttggcgatgggcgatggggggagagatgcgtgcgtgggcgatgggtgggaggccgagcgatgtgatgtgcgtctcctcgggacagtggcgtgtgggtacggactggttgggtggattggtggcgtctgggtccagcctggttgggtggaattattgattcaggggtattatgggtactctagggctaaaaggtacattttgcaagtacaaggttgctatatttgggacaaatctaaaaggctaaaagttgttatattctgggacggagggagtaacatcaaaataataattgcacctgtaaagtgaaccatatacattgtgaaaagtaacactagcttaggatgcaccttataattaaggtctatcacaagcaaaatgaaagtactttttctctcattcacctcgcgagcaagagccgaaactttttctttttattttatgtgggcctatgttgcggctaaattttaaccatagtattgtggaaattgctttaacaatggttcactattcataggtcccactttaaggttacactacaccataaacattgaggttgcccttaatttatcatctaaattattatcttttctcataaggcggaaaaattgacccatctgagagcttattacaagatagaatatgtgccacaagcttattgcaaaaacggactacgaccttagcggttcaacatcccagcacttccgttggcgctaaccgccatggcactatgttcgagtcagcatggcagaaggtcattaccaacttgtacaatgttgaaccccttctcctatcttagcactagttttgtcagaactaaaatcaggaaccttaaatctttctcatactcgtgcctacctatctctcatttggttttcgcaaaccaaattaggacttaggtcgagcaggagcaactccgaaggtgtgttctctatatccgtttatttttcctctagtgtagttattattttctcaatttcgggttgggatgccttgagacacctcgatgcaatggttggattaaagttctttatatatttttcattatgggaatattaaggtttgattgaacaaacatgaacccgatgtcaccttcgccgtgcatttcatgtcatccgtgttgctaaagcgtgtgggaaaaggctactactaggctgtgatgaatcacaccatttgtggcttctttcgcttgtgaagcaaacgggaactggataacagtaaaccatgccccccccacacacacatcccttctttctataaagttatggccaaaagctcaaacctcgtgcttccacgtcatcatcaaattgtgaaccgttggatgaatgtattagattgcttctcagacattggatggaatgcagcatagaggccaacccatcagtcaccctgaacgagtgagtctcttggcctcctcagtgccaaatgtagcccacatgaacacatgagcccatctctacacacatctacttgtatccagtccatcaatctggctataaaagagctttatggctgaacgctccttcagttgacatgtgctacctaaattatctacaaatttttgatagggctgctaaaaagaatttctccaagaaagctatttgttttattctatttcttcttgagattgtacctcttatctaaaaaattgatgttaactaagtcctgcagcaacgcgcagggcatcctatagttatttatatttctgagtgtacttggcagacaaccagcttttaatccaccactgatcaatttagttcctgaaaaatcatgattttaatcctgccgccaaaataaactgtaaccgttccagggaaaggggcatggtacaattttatacctaccttcatttgttaaacataggaaaagatcagaattttccatactcaagttttggggcaatcttgtgtttttaaaatttctcctcttttctccctaaaattataaaataatgtccggggtgtcctatagccaattatacgattttttagtgtccctcagtagtggcacgattttatagtgtcttctagccaattatttgtatgtcctgtggcaattttgcctttaatttggatcccctaaggctactaacgttttcatgaaactactcatgtgaaactatccgtgcacacaccataattactttaggttttgacccctaaacttagttcgaagatggaaaaattattttgtcaaacgtacatcatgtgtttgcaatgtagcggtaattgtcaaaatcatatgtgttcgactatatatgcatcacatatgacatatcttctctttaaattttaaatatacatggtagaaacttatatcaggaagaattacatcttttggctagtgcgcatgattggatgttgcaatctgttgtctcagaactaacataactgcggtggtagggtggggggcttagcaccaaacatcatggcgctgaggttgggaaactcagctctagtcactttgtcattcttaagtaggtcacaagacaaacatctcaagcagggtttcctttaccgattcgaggagggttatgtagccccgcggtaaccgcacgttaaccgccgaaaaccgtgtgaattttgtcagcaaacatttgaattcaaaattttgcgattttgcggtttggtcgcggttaccgcatggtttgacgcgataactgcgatatttgtgcagcaaccatgagttgtgtagctgaatagaacattactaaaaaaattgaaaaaacacttaaatgtgtgtagaaattagggatgattagaagattatataggataattgcaaacctaacatttgcatgtaaaatataaaaatttggacccaagagatattttctcctctattggaccttaatgggccggttgcacagtgcaacttaaggcccgatactttttccttttttcctttttctaaactattatcggttttgcccacaaatttgattttatcatactctttttcaaacaatttcttcaccataagtcactaaaaatcaaggagtccattggctacttatcttcctagtaaatatcatggttgtgatggttgaggtgcatccattatccaagaaggaccgagatcttcttggtcatcttcctcccctcttcttggattccatcaatatcctcgtcactgtcctcctcctctacgggtggcaactgggcagggcgggggcaggttgagttggaatgccccaggccctggccatggagggatgaacagggcaaaaccagtccctgaccccgatcccttcggggccccgcaacccaaccaagaaggctgacgatgaggtttaggcgacgaggtgacatggcaacgacgagggggctcagcgaagaggtggatgtcaagggggtgcaacaacgatgtggcgaatagcaagggggctcggcgacaaggtggatggcgaggggtgcggcgatgatgcgtcggacgacgagggggctcagcgacgaggtggccggcgtcaaggtgcacagggatgaggcagatggtgagggtgcgcagtgaggcagcggatgatgaggggctcgatggatgacaagggccacgggaatgaggcagacggcgaggtggcggtcggcaagggtacatgtggatgagaggttggggatgggggtagggggcggtggtagtagggtagttgcggggtggggtgagggagaaggtggatgaggattagggttagcttttatatatgggtttaatttggcctatattttttaaacgggctattttcacaggagtaactcattccccaaggcccatctgggccacccgcgggtagattatgatccccaaccccgtccccgaaaatttgcggggccccgcctctgctcacccgcgggtaagaattccaccccacctcagccccatagggacgggtccacgtcgggtacccgcccccaacggggaaattgccacccctatcctcctccctctttcgggcatcatatatttcatgtgtacatccatgctaagaatatcgtgactttgccaaaggggcggctgaacatgtacctcggcaatgtctacaatcccatagccaaggcaagctgctaactttcgagcatgcacatactgaagctgaaatgacgatagctatatgtttgggttaaaacatgcgatgagataatttgtgactataagtaacaccatcctggtggcatatggaataatggtttagtacggtaggctctgaatttccatgattaaaccttttgaaccgcataccccaaaaaaggttctgtgcatctgattcttgaaccttttccttgtaatatttgcttctgattttttgtttgtttgtattaagtctgcaatgagtacgaggataagttaaatagtttgtttcttttcaaacatttcaaactgcttcttttggctgcaactgctataaatttttaaaactagctgtacatgtctctatcgagtacggttaatgctatttatgtattgtctcataaaactacatgaccttaattgtttctagtctttgaatcattaatccaagttatctttcttcttccataaagccgaatcattaacaatttgaccccatttgaaaaacatattacaggaatagactacgacaaaaacttattgaaaaaaacggatcgtgacctcaatgctagccctaatggcattgccgtgttggtgcttacctctatgccatcatgttgctatgtctgaattgacatggcaggaggtcagcgccaacctatatgatgctgaccccgacaaaccccttccctttacacacatatcactagcatgcccattgacgctaaagtttgaatgttggaaaagatagtgatagatttatactttgtgatttggtgaattgtgatactaggtatgttagtggggagttcgaatgttgatattcttctgttatttatgattataatgcattggatttgtttggtaaggttgagaggaaaattatactaggaagaaaaataactattgaccaattttgttgaagtgtaggttgcttttcataactttagatgatatttaacctttggaattagtcaaaaatgtaaattattatatgtatttgaattttttttgaagtttgttggttgtactggactcattggattttaccacttgtcaacacctatcgacaaacattccatggtccatgtgttggtgcagtaacacgtgcaaatttatgatgagcgaaaatgatcaaacttactgtgccaaaagttttgggtgtgcgcaaatgacgcatactccctagagaagctaagccacaacggaagaaagggacgtccaagaagccaatggaggttatttcaaacgtaatgaggttatttcatcactatgttttttcatggtggctaatacattgccatatttgaaggtatccaaaccacctccgtttctaggtgactttgcagagtggataggtatagaggtctactcgaatatgttgggcgtctatgcaagcattagctttggttcaaggagcattttgaatggcactatgacgcaacactccgattggaggaagagcaaaaaaaaaaggaagaaggactaagattataaggagagggaagattgtgaggccaaaagagagaggaagcaggtgagggtacacagtgcgaaggaagccagattgaaggctgcaaggaaggatatgtacatgtcgcatgttttaatttgaatcccctaaggcatgtactaatgtttttttatgaagcatctcatgtgaaactatctctgcacacaccatacaccatagttacattcggttttgagcccgaaaccgtagttcgaggttagaacaattatttcgtcaagcatacatcatgtgtttgtaatgtagcggcaattttcaaaatcttgtcctccattacatatgcatcacatatggataccttgtttgtcaatttaaatatatgtggtacaaacttatattaggaagaactatgccttttggatagtgcgcatgatagaaagttagaattcttttttctcaacacctaacttaatagcaatggtagggtgggtacctcaacattgaacaacatggtgctgaggttacgaaactcagctcaagtgacattgcattctttagtaggtcacaagacaaacatctcaagtcaaaaattccatgacgattccacaagcacaaacatatcaagtccacaaattttcgatatttctgcaagcacaaacatgtcaagcccacaccaagtagctgcactaattcaaacacaagtatgagttccggttttgcactaatttaacttaacccccctaacttatcgtttacattgtcgtggtacatcaggagcccattgattagttctcttcctaggacatatcatggttgcgatagctgaggtgcatctattatccatgaagcaccaagctcttattggtcatcttcctccctctcctcccctcttcctaggttccctccacatcttcgtcgttctcctcctcctccatcccttggctgtcttagctttcgggtgtgcatccactcaactaagaagctggtgacattgctggaaggacagcttgaacgtgtacctcggcaatgtctatgatcatgtagccaaggcaagatattaactttttatctatattagacatagttcctttaatacctattgtatttaagaatttacatgcttaagctaaaaggacgatagctatatgttagggttaaaacatgcagtgagataatttgagaccataagtattacttttctggataatttaagatcataagtaatacttttctggtggcatatggaacaatggtttggtttgaaccttttcttataagacttgcttgtgacttttttctttgtactccctccgtcccattataagtgcaaccataagtatccgtgctcaacgtttgaccatctgtcttatttaaaaaatttatgaaaaaattttaaaggttaagtcacgcataaagtactattcatactttatcatctaataacaataaaaatactaatcacaaaaatatttcaaataagacggatggtcaaaattgggcactgaaattcacaactgcgcttattatgggatggagggagtactaagtttgcgacaagtatgaggataagttaaataatttgtttctttttaaccgtgtctaattgctttttttggctgcaacagctataaattaaaaataaccgcatgtacctatctccatcgagtacagtcaatggtgttttcacggtcaaatcagcctataattatgaaaggaggaattgcaggactgctctggcttcaacgacaagtagcaatgagggtggtcagaaagaatggaagaaactatggaatctcaaatgtccaaataagatgaagcacttcttatggctgctcgcacacaatagcttagcattgcgaatgaggttgagtagaaaggggatggaaattgacatgtgtgatatgccaacgttttgatgaggatgggggcatcttttttttttcaaatgcaattaagtaaagaagccgtggagggaagtgaatatggaaggaactcgtctcaaattgtcagagcaaaaatctgcatgggaggtactgaagagtataatggaattggaatacgattcccagttaactgcagtcctactgatgtatacgtggtggcatgagtgaaatcgaatcaaagaaggtgagagcagaagggacgtttctagcctaagcttgatcgtgatgaaacaagcgacgaagtttgctgaattaaaccaagaaacactgaatcaaaatacaagatcaacacagaaatggaggaatcccgatgtggagatgttaaagatcaatgtggatggagcatatacaccacaaacggggaatggtggatggggatatgttattagggatgatgctggctcattgattgaatctggagccggaagaatcacacatctcatggacgctttccactatgaagtcttagctctcagagcaggtatagaagcagcagcacggaaaaggcatgatgagagcaactggaaactgaccattgatgctctggacgagccacaggttggatgcagcaggaggtcttctatataatgcagttttgtgtaaattcgtttaatacttttagctttcatcactgtccccgtagttgtaacaaagtggcacatcctttggctgcttatggttgtaactgttctcagctaactgagatcagttgggacggtattcctcctaaactagaggattttgttgccagcgattctgtcgtaccagtggtataatgcaattcgatgttccactaaaataatgtttctagtctttgaatcattaatcaaattatttctctcctttcataaagttgaatttttaataatttaacccatttagaaaatttattacaccgtggcaaaaacttatctaaaaaatggagtgccacctcaacgccagccctacgttgctaggtccaaactaacgttgtaggagcaagtcatcctcgcatatatggtatataagggcagaatgatcatttcattcataccgctgcatgcgaagatgacttagcatgctcacgtgacactttttgtgggtccaaggactatattaacccaaatgattaatttggaggacctgtttggacgatttgaaacctcaagtactaaattgagcccgaagcgaaacttcagggacaatgttagctattcaccctttattttatgatttttgtcattgaattgagaagcatgagataacatgccagaatacggcttcattcgatctagttcataggttatttgtgcatgattagttgagtgctaattatcataaacttaaaatgatttatttaacttttaaagaaaattttatacaaattttttttcacgaaatgtatcgtttagcaattgagaaagtgtattcacggtaaatgaggaagtggcccatctatataagataagaacacatcttactaactaaaagagtttctgataaatatgtcttgctgaggaggccatacgaacacaataaaatctaatcctgttataccatgttttttcccctcccttttcaatgtgaaaagagaacagaatagcaagcagtgatacaaaattagattttaatcacttcgttgggtttgtactcttgtgtgcttctaaaagttcgacggaagaaaaatatcaacatgtaaggacacgagaatttgaaaaaaatgatcgtaaaaatatttttacgaaaaggatatttaagggtaatgtacatgctaattttgattctccgctgtggcagcttgacactgcataacataaatcactaccaacaagatgagaaaccatgccagacagacagacacatcgattttacaacaactggtgtggttaatcgaactattaatcttaaccctccgaaacattcagggaaaaaaaatatgtacacctgtgtgatgttgtacacccattgatctgtcatgtttaacagcaggttcctgattctaaacatcttacactgtacgcctgtatcccttcttgtaaattgtataattctatagtaaattcagagtttcagttgttccacgtcttctctgtcattccgtgagtgatcatatgcctgcctgttctccatttgctccctggaagtatctgttcttaggccagagcttgcttcttcagtttcagagcagccaggtcgctctgttaggaactgctcccagaacttgtcattcaccactgcagccggggctgcaggagcctcactggctactcgtgcatccgctcgtggtgttgtggcatctgctgtacgagaatcagctgatttcttttggttgtcatcgaagcttctgtcaatggtgtcatccttttccatggtagctgttgctgcctcagttgggttgtctatagtggtcccatttgcattgaggccttggcttttgtcaacatccatcgagcatgatgcaagagttagactcagatggcatgttaagaggccttcatcacttataggtggtgcaaagcaagagctcttggaggggcagatagatgtgccggtatcggagagttccatcatctgcggcaccaacgggagacattccctccccatcatgtcacactctggatgtttaccatgagggcttctgttatcttcgtttgagctttgcgtgcttagcgtgatgatattgctctctgtcatggcaggacaaagtcccaacctaagcttatcagagaagtgctgatttaaaagattgcctgtttcttgcttagaagtgctgctatggtcatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49793 - DNA, 1249 bp, Oryza sativa
ataaaagtgttgactgcatccgtcttttgtcattaaagcataaaggtttcccggtaagttatatttttctaaaaagaaaaatcaaatattgtcaacagagtacgtttcattgatcaatctcttgacaggactgcatgctcctttcaggttgatgtcaatgtagctcgcatagtcacaggctaggatgggtcaaacttcaacccttacccttttctgcagagttccatttagttggcttgtaagattggcctcacccaaatttataaataatgattacaattctctgcttatacatacatatatatttatatatttcccttttggtgaaggtatccaatcatgcgtgatgtgcagaaatatttatggcctcggttgtgtaccatttctaaggaaaaattgtaagtcatttggtcctctaagaaaagtttgtcatacctttggttttcggcatcccatctgatgaacctgatacgataggtatgaactacactgcctcatgataacttttggaaaggtatgcatatatatcgcagtgatcagcatgattctgcatcattttaggcacataaatgtttacattgtcaatattgattgtgtattgtttccattacataggcaatctgcacaaaagtaagtccaaattgcagggcttgccctttcagtgcgaaatgcaaatactacaacagttcacttgccaggtatttttcatagattgtgaagttattgcttaaattgattatcagaatgatctaaaatattgctatggtctgtaacatcctttgttagagcttaagtagtatcctttgcatgatcaaattaatcggtactgtagcatatgttgtaaactctgttaagagcatgttaatgagttgtccctgtgtactctagtctatgtgtatcttcaattgttatttcttttatacggaactatgagcattccataaaatctgcaacacaactaaattgcagaccacccttaggctaaaccaatcacataatgcaactagtgaggttagaagtccccctgaatgttgttatatttgctgcagtgtaataacaagagtagtcttagttatcatagtatatttattatgtctattttagggcataatatgttgcgatttgtagatctttttttatttggtctcatttaaattagagtactgtatcatgacactgggttgttaccagattatcactccctcctgcagaggggcatgggcatgaatatggtgaagagcaagcaagc

SEQ ID NO: 49794 - DNA, 823 bp, Oryza sativa
agagcacttctgcccacatctcatgacgcagaagacccagcaataagtatagttacatcccttgaattatgctacattagttgcaactcttagatgctgtaatcgacagcataaataaagtgtgtacggtgcctcctctacattaatatgcatatacacaacgatgaggtcataggcaaaatcaggatccctggcacaggccaagatggaaacaaacttaccatgcaaacgtcagacttgtcaactgttgaactcctctcttcagctcgacttggcaagcatcctagccgaatatgaactgcaagcacattggctggtagagcaaaaggcaggctttgcgatagtaatgttaaaaatgatccaagaaccgcgtctcttcagtcaaagatctcctgggcttcgattttgctgtgctggctgcagggtttggtcaaaggtgaatgaatgaatcaatcaatcgataggaaaagtgtgcagaattctgtccatatgtaagagaagaatgaacggtgccacacttactgttcatccttggagactcggtagtatttctcggcgagctgcctctgaccaataagctgagcaaacctctcgtcatgggtgatcacaatcaactggaagttctcctgccctttcctgctctccattattctgtgtcggaaagacagacaggcgcacacacagttagggtggaagctccgggtgataacaatttagtagtaaatctgtagttgccaaaaggaatacctcaaaagggcaccagcaaggctctctgcattaggcccatctagattggtggtcggctcatctagagctaatatgc

SEQ ID NO: 49795 - DNA, 732 bp, Oryza sativa
ttgaatgaaaaaggttcccaataattatctcccttgtacttgtaaaaacctcagttatgcttgaaatatgttaattccagactaaatattctcgttaccattggttcaagaattaagtggatcaaccataatacttcagggggttaattcaaccttttcctatacttttcgtggttgactacatttgtacgaagtaccttagtacttactgcaagtatattcatataaatctcaaggaagatattgtgtgttatttttgttttgtattgataattttctgtttcagtcaaactacgttactagtgttgttaatttcgatacaatgaaacatgctttctgtttcttttgagttatgttaacaaatgtgcttttcaggagtttcaattttggatagtgatagttctggtatcactatggagcttgagttgcaatgggatggcaatccaaatatagtactggacattcaaacaacacttggaatctcacttcctgtgcaggtaactcgtaatttttgtaacatgacctaaaacaatggttatatgtaaaactgctgtacaaaatatagtgtggaaacaatttttttgttatatttatttattagtgttctgttcttttgaacatcttagatagaaaaccacattcaacttcatctcctgtttgctttatgtttaactcaattaataagacagctgtttctgatattgtttttaatagtaactaaggtactgagtg

SEQ ID NO: 49796 - DNA, 7006 bp, Oryza sativa
  unsure (1)..(7006): unsure at all n locations
atgccttgcatgatttactcatggtggaagtatgggatcatgatacgtttggaaaggtataatgtatcttttttacttttccacactgtttcattgtactatgtttcaattgctctcctcttgttaacattgtataagtgctccattaatccttaaccattactccctccatctacttttgataatcatatttcatcttggcacacagaccaaagataagtaattctacttattatccatttaaacatgctactaatcattcatcgtaaacaagcgattcattaatatttacatttctcgatgcctatgtaaccaatcttgtgtggaagaatgtagtcacgcattaaatccgagaaagtaattaataggataggttgttggattgaaatatacctatcaaaaataaaattttcagatttggaaatatgcctatcaaaagtagatggagggagtataatattggttggcatttgttgaattcatgtgcattttcatagcgcctcagtcactaaacattgttctagttattgctgcatatctacataaacttcgtggttgtactaatactgtagttctaatgccaatcttctacctagtatctggtcctgtagtcctgttattcttctgatcttgtcacactaactttatttattcaaattgcaggattacatagggagatgcatcttgacacttacgagagtaatactcgaaggcgagtttcaggatgagtttgttttgcaaggtgctaaatccggaaagctgaacttgcacttcaagtggacgccgcagccaatttatcgtgatcgtgatcgggaccagtgaaatctgtgtagatacatcacgtcaagcagctgataaatatttcttcccctacggtgcctgtacattagtttttctgtacagttaattcacttatcttgtagcaacaaggtgtaatggaataaaagaatggtggtttcatgttccgacggaaatgcgatgtgctatgaatggagggttgcagaaagatggatggtaacacggggagatgggttacccaagtatggaaacattaagttcatcatgcaagcagatactttatgcatcttctactggtaaaactaaacgtgtttgtctttaaaatgcaacttgtaatataattccttgtactaacaattactacctccgtcccataataattgcatttctagaaaattggagacagattaacaacaaacacaatttaccacaataatcctatttaataactacactgcatgtatatattccatatgtaaacttgattaaaaggaaggttgaggaacatatttcatatgtaaacttaattaaaaggaaggattgggtacatattccatttgttgcgtcccatcttatcagaaatataatctttctgggacaaaatttgaatggtagaaatataattattatggggtatcagaaatataatctttctgggacaaaatttgaatggtagaaatataattattatggggcggaggtagtagtttttaaactgcggtactgcctccctgattcttgtcttgaacgtatgtttgtcagaaagcactaatataaagccgatgtaacaggatgaatttaactcaacaccagctaacagtgctttgagacctgggcggggtaaacttgcaacaataaaattcgagtgaatttcaaaaatctgtcctattgttttactcgtttcttcgttgttttataatggatcattcatccattttgattttagtctgaatagccccattttgatttggcaatgagccggtgtgagtagcctagaccgctgcaattcagttcgtgatgttatcctatctttctatcttttaagagcaaatatagtaaggcttattcagcatgcgatataaaatccacatcagactcggtggtgatttggacgagagagagaggaggaaaaatggtgcaagcgggcgatagattagtcgccagctccgcactggctccaagacaccacttgtgatactttttttgaaacaggtgatactttgtcagtgttgcagcagaagagagagaaaagagcaccaaagcaccgcagagaaagtcattgatgtggttaaaaaaataataaagcttttggttgtttaacgtgactattatactctccaactattaggttgcttttagatgacatggtacacaattatcgctagcaatcgacgataatattaaacctgccctaatgccgacgtagtctgtcttcacggaacaaaggtcgcagccatgtccccgaggtcagtttttggctcaaatttcggaatcatgataaacatgctgtccttcctgttgttttttttcgcgaactgtccttcctgttgtttccaaggagatgatgataagatactctttttacatgagctgagacataagcgtgctctttgtgttggcgcttagatggttgcagatgatttcaacttatatatacagaagaactttgtgttggccattagataatagcagggtatttcaacttatactagaattgtatcgagcggcgacacgccgcgcaccgcatgcaaatagtgattaaacaaaagatttactccattggcctaaaagagtacccagacgtagcatacctatacaagtgacattcattaaaaattagattacataggtcagtacttcagttgcaaactgtactatatgactaattttaagtttgttattgagtggcgtcaaacttcaaaagaacacatttcgtgtaactaataccatgatctcacaaacattgtacacataattcaaagtttggcaatagagtggctctttagataaattgaacaaacttcaaacaaacaaatctcgtggaagcattcgctaatggaaacttgcaaacatatctggactggtcaatacccaaaacatcactcttaaaactatccttgcatttgttcattacattacattgtaagaaataagcatggtcaagatctcaagatgtgaaaggcaatgaacctctgtagaaaaatggccaaaggaagcaacaaggggaaaactgacataacccaaaaatccacatgaataatcgcccatgagtcaataacttacaacagcctctcatggccacatcatcacagtgctccatttgacataaagaaatttgaagaattcatcccatattttcccaattctacggacaaagaaccatgcgggcatgctcaggcgcgggggacggcgatggcgccaaggggtgtagcggcggcacacggtggggaggaggtgggaggcggcagggtatggtttggaggtgggatatatgtggttgttttccgaaaaaccccgtctttttaggtttacagtgctaccctagaagcagaattttcacttcttctggttgtacttctatggaacacgaggggttttctggataaaatacaacggggtaaccatcggttcgaggacgtgtgtgcaattctgtgcaaatgcgaggagtttttttacaaaataacaaaacacgcataatctttccgaggagccaaaaaatatctgatggaactggaaaatacccgtataaggaaaccgacacacagacagatggcacgcagtgaaaaatcggttttaccggcgcaccgcgtaacaatggttacagcgcgaaatcgagacgctgaaggaagcatgtggatacgggtaaatcagcgagatagccaaaaaaaaaattctaaaacatgagaaaaacgaagcggcatcaagttttattatatgatgatatacactagcactataccttctttcgtggttcagagacttcacaggagaaaagaacttagttcgtcctgtagtcacaagatttgccgcggcctactaaatattgaagtcacttcatgaaaaccaaggtactttaataaactcgttctgctcagaaaaatggtggtgcagcaggtaatagttttagtctttaaccactttgtatttagcattcttgctgtaaactaaagactacttgtttacttctattcatgaagatttccaaaaactgaagagggaagacagtaggacaaatcgtgctagatactaatggattttggcctaatcgtctaacatatgcctttggtcaaagttctgcgcttagttgattcagatgaaaagcctgccatgccatacatttatgagcatatggtccatgcaaagaaagaattaaataaaattttaacaataatgtgaagagaaactacatgcctatattgaaaatcattgatgaaagatgggaatcacagctttctataggcctttacacactgctgcatatcttttgaatccagccttcagtataagcattgagaccatgcctcctaatattaagtttggtttgtattcctgtattgacaagatgacacccgacaaatctgagttagtgaaggttcacctgtagcttgatagatctaagagtgcaaaaggacattttggagactaagtggcagtcttaaccagatcaagaaaactccaggtaactaatatttccatctggaagtgttgggctcccctttaatgcaagtttttcatttggttggccgtataataggtgttggacagccgattgattggcgaagtgaggcctgcagcacctgtggtctaccctctttgtgatcaaaatgaggaatccatccaacacattataatttcttgtgtcagtctcgccaagtgtggacaatattcttcctacggttggggttacccgatgcggcgcctcaaccttccacggatcgttttttgagatggtggagccaagctactaaataccggccgaaggaggtacaataagggattaattctttggtcactttagtggcttgggagatttggaagcatcacaacgactgtgttttcaatggtgtcaatcctagagttgcgtctgtcttgcaagtggtagaaaacgagagtaatctttggtgttctgcaggtgctttggcacttcaaaagctccttagtgggacagctaacctaggcagttagcgctccccggtgtggtcttgggtgtgtgggtctcagtggaagtggaagggctcgggtcctcatactttgtaaatattttgtactttgttttttccccttaataaaatgaaacgcagtactcatgtgtttctaagagaaaaataatatttccatctgtacatattatatacattctctaattcattcataagctaatttatttttatattaanctgattggtagggatttgtacggggataacttgtagcccttttccggccaacacggagtcgccaaccacctcaattataaagctctaaattaagatgggtttagaaaagaaataaaaccggctagtgaagccaatttagaaatcaaaccaacttctagaccgatttagatccatttaaagataaccacccatctcgtgggcgaatcaaaaggtttatgggacaaacctacaaagagtatcacactctcgcaacaaaggcaggcgatttacaactgcaaatcgacacagatggacgaatctaggttaaagtagaaaaaaatggctgaaaagtaaaggtaaaagagcgattcgattgattgtgtaggagttgaggtcgggggctggaatcgaatcggccatagcccttaaggggttggtctggcctccacggggccttatccacatcctattaggcttagagatcaattaagacacaacagaccttaggcccaaacaaggaaacacgatatttgccttaattgaattcggacttggcctctgccagtctgaccggccactagccatcggtttgactggccctagaccgtcggttagactggcctcgcatggtaagctaggactcttccaaatctagcccgagttttcctattttccatttaggtgtcaaattttggtgttaaatgtccactgccttttagacaaacttatgtgccgaaaagtctagaacgcatagtcttagggcgataatctgtatcggccttacaggctcccaagttcttagcaaatctttctctttctaatatttcaacaaagcaagagctcctaagaatgatttgcacaactcgattaggcattcccgactaaatgattacccagcgagctctttacaggcttctaacagtaaaatcgtcttttcatgccaagtctttaatcccgagacgattccactccagttctgttgttatgggttttggctataacttcgtattatctctttagcttgttctaaagtcttcaaacatttatcggtcactttatcactattaacgtcttataaccactgactgataaatcatctcactcaaacaaggagaatcaacaggctaaataatttatcccctaagctgattgataaattcgataatgcctcatagcactttatccatagcaattttggattggccagcatctaaacatcttgaaagtactagctctatggtttgcaatgaaattctatattaaacaaaatgtatttagatgctccaatcaaccgtcttgtttagatctttgaaatattaaactagtggaatccttcgattggtaatcttaaattcataacacatcaatagctatgtactacgggctgcaatccttggtcagacgggcattatcctcacggtcataccgttcctgtgctcaatcagacaggacaagaagccacagtcaaactgacattgaatcatcggttagaccggccatgtaattgaggttagaccgacctgatctagaattatcatacacaatttgtaatcaagcactggctttgtagtacaaaatttggctctcctatcttaataaccaaatgcttgttgtgtcaaactattggtcaacatgatttctgaagtagctatttgaaataattatcaaagagaaaatccattctatacccctaagtttactctagttcaatgatttgccatcgactttatctccctctataatatgccaccgactttgtcaatttttctataatatgtcatcgagatggatactttttaaaaaatgtctaaaatgcccttcaagccatataa

SEQ ID NO: 49797 - DNA, 6609 bp, Oryza sativa
ttatagatgatgcatccgaaactcacagccacttgatgcatcatctataatgaatcacccaaaagattgacatgttttgcacccatggattctaataaactacaatgtatgtaactggctcaagcatagatgaacaaaactctaatagggccaatgtagcaaaatagcatctctaggtactattagaaatcaacatactggccatttgtataagacaaattattaagaagtaaaactctcatagtgcaatattaacaaaatcaatatttaatatggtgatccataaaatcatatatagtttggcttttaatagatataaaaaaaatcaagagccaaatcatactcaaacaaagtgtatgccaacttgttaattctatcactaagaactggcctttgcagcatgtatgtacaatatcgatttaacaagcaaagacacatgtgctagatagcaagcaatgttctaacatggtataggcataatataacgatgaacatgatacacatacattgtcttagcattcaacaaattttggctcaaagatgtgatgttgtacccgttgccgttcatctctctcgatttcttcaaaagaacattaatgtcttaccccccgagcaaaatcagcttttcttagtgcttgattttgagggcaagataaacaccatattaatgtcaacaacatcatgtggatcgaggaagcttatgactaatgaccgatggttcttctctcaacgaattggatttatcactactttggaaatcaccgttctctcatcttttaccgccttgggtctccacactctcttaggagcttgaggctctaaattgttgcacgtttggttcttcacatcttcggcctttgtctcctttcgatccttggccccaagacattgtagcctcctcttttgagagcgcgataagccagaaggtatccactgcggttgtgattgtgttccaggaggcaaatgatgatttttgatactcttgtttgaattggaagctcatgtactactctcagatcgcctagctatctctgatgccccccggttagaccggccttggggctctgttgacggtcccttaagtaacccacctcgacataattctgcataaagtaatgaaagaatcaaaatggagtagcaaacttagaggtagtggttattagtaaccattttcataagtcttgtgaatatttgtatgtaggtgaattacgaacggatgcgagtacatggattggagggcccacatatcaatcaaaacaaattacaattgagcccaaccaaggtacaacatgtagatggcccaccagatagcttcccaaccaaaggagtaatcggaaggtgggacaaaggggtcatccgaacccaagttggcgaacctcctttgtctcccctcgccatcagcttccacgtgtaggttcctgatgactcccaaaaggcggttatgagtgattcccatgagttactaactttataatcgtcataggatggctataaaatgaggagaagctcttactctcaaacaacaaaacaagtggagtacaactcacttacacatttaagctactctctagtagagttagaatataggaggagagagagagggaaagctccggaatgagtgccccaaatatcagagttccggaggagtgccatagatgtcggcattcttccaggggagttccggaggagtgccggagatgttggcactctctccgatcttatacttcgacggatgtttcttttataagtaagcattcatgattcttttggtatttacttttttttatttaagatatataatcatcgttgcggtttcatcgctctgcttaagtagagtgttgacagtcgttaagtaccgatttcggccatcaactatctgttaacgaccaaatttggtaacccaacgatcggatgtgaaggaggaatcgagacggagttcgaggtagagattgttccggaaacagagtgaggatcggctgaagtctgaatcggctgcgactaggatcgccagagttcgagtcggacagggttagccgattgagccgaatccgacaatatgatgcggcatacgttgtcgggttaggttgacgtgcttcatgatggttgccacgcatggatagagtcctgagaaggcaattgtatctattaattaggatattttatgtaatttccttagagatatgtttgggcaaaagtctgccgcaaagacttatgatatcttagagtttgttaaagataagagtcatgtccgatatggacatattttgtaattctcgggtataaatagaccccgagccccatgtaatcaaactaacacacgttcaatacaatctcggcgcatcgccacccttttactttcgttttatttcgacgagttcttactttcgggttgagctgcatcggtttcgatcttcaacaaaaggtaaaacttgttatggcggcttgcgttctcggcattagtgcttccatctctatgatactctaatcttgtttatgtaattcgtcgagttatcatatatcttatataatctccggcaatatcgctatctaacctacaatcggctaacatctgtcagtagaaggtagccgattaggttaaatatcgatgctggcttagattatacaagatatccaccactctatgaaacatccaacggcttgattgtctagatattgttcttcttttcatacttatagctgcatcagttgagtttgatcttatgagtcgtgattagaatctcaatctctagcctgcctttgattgccgattagggtagtatcggggtttcagccgatcttacctgatttaagtactttttatcttatatgcttgattgacatgttaaatccaccctttatgttaagatcttgttgcatttaagtatattaggcttttgtttagtatattctacttgccttaatatcttaatatagagtggtatcggagtattagccgatacatgctagatctatctgatcggctatgctatgaacatatataatcttgctgttagtatatatttcgatctaggtgatttatactgtcttggcatggcgaccgatctatcccaatcacttgagttaagtatatatcgacataaggattacgtattgtgaatatctacagccgatcgagtagatttagttctttcttacttattcatgactgccgatcgattcacatatgacatcggctcaaggataaatgatatgtcatcggcaactaaccgatcggctatcgtttatagatttaaccgcggtttctttgtctttgtttcttgttgattgcaggatcaaatcaactggcatgctcacacacctaaaggcaagcttttggacctgcactggagttaagcagatctcccaggcctcgtgtttttacatcaacactatctcaatgaataaagagagaaataatatttcttacacttatattagtattaaataatgtagttccacttgtcattagagaaatactatagattcagggttatgagacaaattaaggagaaaatgcactgacatgcgaagaaatacacttccggtgaatcatgtgagagcacacggattgatgggccacaagtctagtccaaaccgacttaaagtggggccaaccaaccatgcaccgaccaaggagtccacatgtcagcctcaggacaaggtcggtcaagaatggtggtttccctggttcggccgaaccaggggtggcgccccttggtcctagcttccatgtgtcactctcttagccactctcaatgatagttatgccttattcccggaccaaaaccgacttaagcaactgtcattggaagctatgaaaagaggaggccttcatactctcaaagcacacacttcaaggagcaattctttgattccatattgtattctctctaatagtagtggagttaggtttagagtagtcttcggtcctatagcctttatggagattccaatatgtctttagtactttatcattttgttagactatagttgcaataaagaaagtagcttctttatttaattgtgttcatagtccataaactactttgctagttatgtgttctatgaatagattatacttcatttatatgcttcacttgattaggctagtctatctaaactatggtaacgacccaatgatcttaacgggttgcactagttctaacttgtccatcctctggatggtaatccggggaaattagtggtattatttgttaacataagcatggtgcttagattaaataaataccattagatgcaggaatgccccacagaaagtgaggtaggcggcatgtggtgatagctctatccatcctttgtattcctccatgtccgggtatgacgtaagagttcgtaaaatgccctccttgaccactcgagttccttaaccatgcacacactcaaccatagtgcacatcttcaccttctagttttcttcgcgtacatcagtcattgcacaattgatcttgtgaagtttgttatgaacacctcctgatatgatatcaccatgttttttattgaatagtttcattttcaattttccgatattgttttcaattccggttaccattttcgactgtgtttccggttaaaaaaatacgaatgtcgaaatggtttaggtgtttttccgacagtctcaggctgttttcatccttctctatccaaactctaaagtggttatatcgtggccgtaccgaatcgattagtttagtgattaattttgacaaattgacccttctataaaacttattgccaaaataaaccgtgtcaaaaactaatttcaaaaatagaccgtcaagggccaactaaggtggcgctgagacattttagctcagcgctgtcggggttggtgctgaggccacggtctatttttgaaatttgtttttggcatgatttatttttgaaactagatgatgcccccgcgctttgctgcgggatatatgttagatattggagaaatgataaaatgatttgtattgaaatattatgaaaatgatttgagaatgatgatttagtatgtgtatgtttagttttagaataaaactagttatcgtgcacgtgcaaggcacgttttggtttatatacataaaaaatagaataataaatataacttttttatgtactgcactccatacaaattatacaaattctaaaggtaggtctatagtaggatgacaatttgcagatggaaaacaaaaccaatagttcaataggtccctgtcaaacactttcaatttggcagtaaccaaataaagcactcttactatcacccctgtcagcccataggacaaaaaagtacaggaaacataactgtaaaaatttcaaaataaggttgtgtttagttccacgccaaaattgaaagtttgactaaaattgaaagtttgaagaaaaaagttggaagtttataggaaagttttgatgtgatggaaaatttgggaactaaacaaggcctaagatacgatgctatataattaatttaggaaatctgctgattttttttgcaatgattgatgtatactcaatatcatttctcatgaaacttgctgagttgatcataccttcgttgttccaaatataacccaaaatcaccaacaaaacaaccttgattctctttatattcactacaggagattcaaattgtctttcggcttgataacaggtatttcagataattacctatccgtcaatttggaaccattaggttgtaaataaactattagagaagagatgaactgcacaggaactaaaggaggttaaaatgtttctcctcttcaccttgaccatgcagtccgctctcctgccccaagaactgtagccaagaacatctgttcactgcaaaagttgtacttcctccatttcacaatgtaagtcattctagtatttttccacatttattttgatgttaataaatctagatagatatatatgtagatagatatatatgtttagattcatcaacatcaatatgaatgtggaaaatgctagaatgatttacattttgaaacagagggagtagttctttgccatgcatgttttattctgggtcactgcacaatttgtagaggctcagattttaccgttcctatggaatttcgttatcctaggatggtcgcacagtttattgttgttttattcactaggagctgttttgctttaatgaagttataaattctgctctagatttttactgaggttgtactgagttccatcttttgctaggtttttactaaggttaagtgtttggcattggtcgcctatccaaaacctattttaattcgaagctgttgtacttgctacgtggttcttttttttttttttttggctcactcccatctgttttcagcatttgggtatgacagtttttttgtttttttatccttctagtggtgtatcctatagaaaaagaaagaaagacctactgtttgtttgcaacctcttgacaatattttttggtgcttaatactttatttagttactataagagacgtttcggtgataattcttgttccattgcaacctgaaatcctagttagggacttaataacattttcttaaatacaaaaatgatactttctccatttcatattataagtcgtttcgactcgtttt

SEQ ID NO: 49798 - DNA, 2576 bp, Oryza sativa
ggagtattttagcctccctacaacataaatatgcaaataggaagaagaaaaagtaacttttcaatagtgcaacaagatttaaaacataacaggtaattaggactgctagcaactgcgagcagttgtgattccttctattcgagcgttctatacatcaccaagaatgattccttctattcgaatcaaatcaaataacacagttgtgaaactattcgtttgttctgagagcactggatttgatctcggtttggtagatcaaaaagaaatcaagaaccaggtggtgattcaaaaagagaagagaaagataggagcgaaagcaatagagcagtaccttggggcggcggctgcagcgttacccgcgagaaggagtgactgcgggggcagcagtggagtgcggcggcggcagcggtacacgcgaggaggagcgacagtaggggcaatggtggagtgcagtggtggcaacggtgcacgcgaggaggcgaggagacttttcaggggtccggtgtgaaactaaatgtagaggtgtgaaactatacaatgataatatatgaattattgtcataaacatttaaattgcatttagaaataatatttatataaaaaaattgtatatgctacctcaaaatttttttccgagaacacactaatgtagctagggccttcgttggttcatccaattctgagaacaactgaattaactagtatgtaccccgcgtgttgccgcgggacataatgaaaattggttattataagcatggagtgaagcacggaaacaaaaggtattcatgtagattttgaaatataaatccaacgtcaaagctgatatgattagaaactgcagtgtcgttaatataaatgtgaatacatatatttttaatatttcacatgacaacaaaaatattactggaagtttacttactaaagcatataatatatgtaagatatgttatttcatcggacaaaagaactgatgacggtagtcagttggcaattaaaatagttatattatttacatggcaggcatacaggtgagtgagacaaataatttatctcgtagaacactcttgcaagccaaaaggtacatactagggcatagaggtgcattgatatgttttctagcagaacacctgctgatggaaaaatgaaatttatgatgatcattgagatggctggatgcttggttcttcgtatgatggcagcctgcattatagtaagattatgagcatcagccataatcaagactggtagcatagtgaataacagattaatttttaagtaaaataggtatgtgtgtgaaacatccatatacagttgttaaagtagctgatcacattgaaacagggaaaataatatcatgtgacagttgatgagatgacaaatgaagtggtaagacatgttatgaaacatatatatggatggaaaacttaatgaattatagcatactatgaacttgtatcaagactaaattaataggagtaggtgtgtgaccaaatatgatagactacttaaaagcattagctgtgagagaatctagatttggtgtggaagatttttttttttggcaatgcaggaatgcaaggatcttcaaatttatataggtaacctgtaaaatgctgtaaacttcttttcacattgaacttgtttagtggtcagaatgcaaaatataaaaagaggaaaacaaacttacgaagaaaccatggataccagaaggcatatattagaggaaagttgagtgtgaagatcacataaaatagacaggaaagaactgaactattgtaacaataccaactgcgtgctgctttgacaaggcagaggtttcggataaagaatcctacaaacaatgaacataggtaaatttgacattaagtatcaaaacacaaagaatataatcaggtcaagttagtaggtctgagaaaaaagaacctaggactcacattgggggcaaggcaacaaaacacagcaaattaccaataggtagaacacgtatgcttgacttacctgtaatcatgtatgcattccttgttgatccagatcgttaaatatttctttgtaaacaacattgtgagtgctggtcacatgctcagttggactattctcaattagaatacgaagaccatcaggcgatgttagacgtgagaatgcgacataaagttgtccatgtgagaagacatggctaggtaagtagacaccaactctactaagtgtttgcccttgacttttatttatagtcattgcatatgacacacgtacaggaaattgtcggcgctttaatttaaaaggccacttcttatcaattgaagtggttactatccttggtatatatgccttggatccttggtatatatgccttggatcctttagccttccctgtaattatctccccttctatcacacgacgagtcaattgagtcactataagtctggttccattgcagagacctttagatgggttcagattgcgcagcagcataattggcactcctatttttagttgaaggtgatggtctggcaaaccgctgatttttatagtgttcaggaactcagttgggtaaagagcatcaagagtggcacgatta

SEQ ID NO: 49799 - DNA, 7722 bp, Oryza sativa
aacaacaaatattataccagcagactgagcaagtagtcttcgacgtatagagcgccttgatggcaaatgaaaacttgtagggaaatcaccaacatgggagagggcgtcatcagccagcagaacaacgccatcgctaggaatattccccaggaaatagatatggcacaacagaatcatttgttgacaaataggagagctcaataggaaaatggtttcaaatgtagaaataaaaatttatatggcttggagctaacctgaaggtataaaagctctctcgggttgcctgcgcttgcgagctggtttaggtgttgatggcccagaagaggctgacatcattcaaactgatttatgaaagtaattagtggtttactggaactataataatgaaagtgatatatttattatagcagccaaaacatcattatatgtgtagcaatcaagtagtatacatataaagagaaatttatgcatccataaagtggcacattaggtactggccagtttgctatatcttttttttttttgcgataggaagctcatttcattcgtcagggaacagcaggattacaatcttcagtcacaaggtgctcgatacaagctggggctgactgccactcacccagcctgtcatcagccgtgacttgcttcgctaatacatgagctacatgattgcaagatcggggggtgtacagtaaagtaaaaccatgaaaactggagctaagctctatagcatcactgataatcgacgcaacatgcgatctttgagagccaccctgcttccacagtttggttagctcttggcagtccgtctccacctggattcttaagactcctttctcccgggcaagttgtatcccatcccggcaggcaagggcctccatcatcaaagcatccaggccatgaggatgccatctagcccggccgcctttgaacctcccatcaacatctcgtaggactgcccctgttgctccctggctatcgttcctagagaaagctccctggccagtttgctatatcaggtaatactaattaaactatatgggaagagccataaaaggaagcagataaaatgcactacacatctagtcataattaatctttttgaccaattgatatggagttctttaaatgtgagtgtacttgcaaattgtaatgaagaggctataatgcattttgtttatgaaagaaagcaccaaactggaaagaaggttaaaaaaaagatatgcacatagggaaattgataggcagtaacagagaaagttcaaaatcaaaccaccaagaccaaatgccatgctgaagcgtacatatattctaaatcgacccaatatggcaagccaaaataaatagcaaaattagcactgcaataatccaaatgccaagctgcaagttgacggcctacaaatatttaataagctgacaggcaaaatgagaacatatcaaggaaaagcgcatatctatctttcgttcattagcatattgtcatatagtgtttaatctgaaaaaatcgcaaccttggtagtattcactcagcctaactatcgcaaggaagcatagggaaatagattcatgttttggttgttaacaacagcaaagattgatcagcctgggcattgtctcggtgactcaaaactgaaagaaagcaagattggtatccaacagcaacaaagagcagtatagagaaaaatgacttactgaagaaaaccgaggatggaggcagccgtccagagcagacgggctggcagatggcagccgctcgaccagggcaacaatcgggagccttgttgggtacggccagcgcgctgacagcctgaccgatggagatagctggacgacgactataatcagcggcaaccaccacggggcaaccctacaatcacaggtggtgggtggggaagaacgcaggtcggggaagaggaaggcagccgccggcgaactggtgatcgatggggcagaggggatgacgtcgatttctccgatggattagagaattctcttcatgaattggggattgatgggtgtgtggtggagagggcaagcagatggattagggatttattttcatgaattggggattgatgggtgtgtgctgtgtggagggcaagcatatcgggttggcaagcggacggacagatcacagccacgacagagcatcgcacggcaacgcagccggaaggaagctgttgcactgtagcaaaatactggcctctggtggagcaaggtactgttggtagtggcttaggaaaaggacgcgactacacagctagtgctagctaatttgtctaaacaagctactactccatctatgaaagacactatccacctatacttcaaatacaattttctcttaaactacttatctgatctacgctccgattgcaccgttgtgtttgtaacaattaaatctttataacaagatctcacacgattatactttgatgaaaaatcacaaattacttttataatatatctaaattacttttagatttcactaagttacttcttagacatatgaaagtaaattcaataaaacctaaaagtaatttacatatattatagaagtaacttagatcaaaacgaaggtaactttaattaatgccttttttcattgaacaaattatcatatatataagttacttttagattttattaaaaatacttcctatacattcataatgctctgagttgattacttttattattgtttttagttaattctataatttgtgctgattaatttaatttctagatagagtcatatttttatctttacaacgaacttacttcaaatgacatgccaaagttacattcgttttgttttaagttacttctataatatatgtaaattacttttagactttacttaatttacttttatatgtttaagaagtaacttagtgaaatctaaaagtaatttagacatttcataaaaataatttgtgatttttcatcaaaatataatcatgtgagatcttgttgtaaagatttaattgttacgaacataacagtgtaatcggattgtaaatcggatgagtaatttaagagaaaattttatttgaagcatgaatgataggaatattttccctacttacttaatggattaatactataaaaggcacgcatgttgacataataggttggtacaaatcctttcaccctagcattaaactctagcttagatttctctcatacttggcaactggaccgtcgctgctttgtactaaaccgagagtgctcttggtttagattttacgttaggaaaactaaagatttaatatgattaacctagcattactcgtatgtgaacaacaagcaagttagaaacagcaactatgggaacaacaactactgaatcaatttttcacatgggcttgacgcgatggcaaattggcaattgcgaaattgactcacctgatcagaaaacctacgatcgttgtcctcgttcaaaggtccagtcggtgcgcaagcaaaaagcagcggacagccgggcttgcgtcggcgcggcggcaggggtgctcggcgcgccgctcccttgaggattgcgcaatctaccgatctcgtcgcatgaggagtgaggatgagggtggcgccgcggcggtaatctcgctcgctcgtgaggagtgaggtctctctcgcgtctctcgcaattgtcaccgcgcctgttgggttccgttttctcgcatgcgcctgttcggttcctggatcagggcgatgtggatgcagatagatggacggtatggattcacctgttgatttggctggtagggttggaggggtgcaactcctcatttttatattagtatagatatagataaattgtagatataattactatatgattgcatgttgaactttttgtgcttaatgggttgatgtgacatgcttgcatgtgatatttaattaacattagctttatagaaagaagggataagttatactccctccatactcataaaggaagtcatttatgacaatgtttaagtcaaaccttgggaatataaatcatgaataactctcaagttattgagattgaaaatgtaaaaattatacgtatagatttgtcttgaaaaatattttcataaaagtatacatatatcacttttcaataaatatttttatagaaataagaagtcaaagttgtgttttaaagaccgtgccgctgtcctaaacgactttctttacgagtatggagggagtatagaagtgtcaatttgtcaaaataacggtagtgttgagaaatttaacaatatgccactccataaaaatggttttaacagaatgccaccctctaggatgttcttataaaagttccactcaatagagggtactccttaatagaatgccactttcggctgttttgaagcttttaacgtgagaaatgacaaaaatatccctgatttgtatgagcggcggtggtgcagtgggggcggcttggtgggggaggagggtggggttggtggctgtcgcggcgagcgcggcaacgccgttgtcagtgacgaggtggagggagtggagcttgagtcagtggaggcctgggccaaggcggtcagtgactcgcgcgaacgtggggttgacgcgacgtggagccgcgcccgcgcgtagaggatgaggcggcgcacgaggcggcgttgacggagagccagcggcgcagacgaggaagcaacgcttgcggtcgccagagccgaggaggccaaagacaacggccaggagctcggcaaggaggtcggcggtgtgatcctcctccgcgggggcgtcgtcctcaaggtaggctgtgccgccacatgcttggcgggggtggagagggaggaggccgaggtggcttgcaggggtacctagcgatgatggtggtggtagtggtagtggagtgagtgtaggggcctcatggcctagggccaacgacggcagcggcgagaaagaaggaaatacatctggtggtgcaggggtattttagtcatttcacgagtgaagtctgataaaaatatccaaagtggcattcttttaaagagtacctcctattaggtggtatttttataaggacattttagatagtgacattttgctaaagtcaccgctacgaagtggcgccccgtgcgtcagttccccactcaaaccctcgcttccgccgaccacacggccgcaccatggcgccgccgccggagctcatagacaacgtcaccgcctccctcccgccggatctcatctccgagattctcctccgcctcccgccggatgagcccgagcacctcttccgcgccgccctcgtctgcaagtcatggctccgcgccatctgcgagcacggcttcctccgccggtaccgcgccttctcggccttcttcacaggctcaaagtcatgcagggagaccccgccgcccgcctcgcccgcaccacagcggtgcccctctcccccgatcccacctttcgccgggccctcgattgccgccatggccgcgccctcctccacgcttcggacgatgattggtatctcattgtctgggatcccgtcacgggcgaacggcaccgcgtgccagagcctggcatcccgtggctgatctactccgcagcagtgttctgtgccgcgagtggctgtgaccacctcgattgccacggcggtcccttcagagtggtttttatagccacggacgatgacgacgaactcgttaaggcgagcgtctactcgtcggagacgtgtgcgtggaacaagacagtgattcttgctgatggttatcaaacctggcaagagcgtttgcaagccatcactagaggtgaatcataccgtacaccttatgtccagcccaggcgaggtgcccttgttggagatgaaatctacttcacgcttcggaatgagaatgcaatcatcaagtacaactgggccgcgaactgcttatctaagattgacccgccgatacgagatgtgtatgacatttccctcatggagatggagaacggttcactgggttatgcctgcattcagggttccagcctttatgtgtggtcgaggaatgccagttcagaaggggctgcagaatgggtacagtgctgggtgattgagctggagcaaatggtacctgttgccaatcgcggtgatgaagcatttgttgttggctctgcagagggtgtgggtgtcatattcatgagcacaggtgttggattattcacgatcgagctcaagtcaaggcgggtgaagaaggttgaagagcctggggtctactctagcgtcttaccctacatgagcttctacactcctggtattgtactaaaaattgcttatctcctgtccttcatttcctttacagcttctatatatttgctttgtcataatgtaactgcaatattgtaatttcaattgacaaaaacagttttgtgtatgctagagaatactgaatagaggcattgcaaatcagagccttaatttttgtgatgagagtttgcttgctaagaaccatgaccttgcattggtctaatatattcgggatacaaacttgttgatctggtatatttgttactctgttactttcaagcatatctgttactcaggcccagttgattcatggaatagttcatgcagcagtaagtagctaataggctaaactggctattgctaaagatttatagaagccttcttgttatgatatttatagaaacattagattttccttaaatggtattggtaccttctggcatagatgaagctcatatctcagacccaaccttgtaacctttggaactggttctctgtacatagttcgtcaaactgtaaagtttgagctggacagttggttatgagttgtgtgcttgactgtttggtgtgtttctttttttcagatcgtggcacattgttatcgctagcgaggactcactgatactcaaaacatgttgcaattgacttcttccagaactaccactatgaaatcatttattttctgttcggcagtataagtatgaacaatgcaagtaatcatgtttcgaatgtggttctagtgtcgaattcatcctaccaaccatgaactgtatttaatttatcatgtctggcatatttcagttgagcctcaggtacaggaaactaaaatctaaaattatgttgacttttgttgcttccattcagagatctgcaagtcatgcgaagctgaatagctggatcatgtttacttcgattacaaccttacagggccggggtagtgaggtgggtttgatcagtcttgcaattttttggtggtcagttcaacccgaatatgagtggaatattcttttttttaccaactaaacccacctaatcctcaaaccaaacagctgcaaaaaaaaaaaaaaaaaaaaaaaaaaaggatggccccgacccgacgttcaacttgcagctacatactggtattcaagtagtagctcctgccccatcttaactgccatcttagtgaaccttttgcatcatgtcttattggcaggaaaatgttttggacaaggacgggaaatatggattatagcatcatcgatcctcttgcaccaaacaatgctgccgtttttgtttccgtttcatgaataaatgaatgtcaagtggtacagctcgatcgaaacttgtgctctcaacattttatctgcttgtttccgttcctacaatacttgtggactacgattactttttcagttgtagactactgagtaccgactacggagtactaggcttttgtctgatcactactgtgctcaacttattcaggagttctttatattgtttgg

SEQ ID NO: 49800 - DNA, 2555 bp, Oryza sativa
tggacatgcatgtacagcaagctctgtccagcactgctcattttttgtacaacaaaactcatatacaacagcaattggaatgaagcaccccttgacaaatgaacaccacatacatttgtgattgtaatagtcaacaatcaaatgtacatcagcaaaacgacaatgaagttcaggagattagtcaataccgaacgattgagatactacatgatttagcttttgtggcgacgcaaggaaatgaaaacaattaagcatctacaaatgtggagtgaatagaaaacttggtatgttaagccctaatcacgtatggttgtctagcgaagtggcaggctacttaattaaggccaaatttaatattatagattttcatcttagctcaaggcatggtagctaagctacatgcaggttatatcggggacaaaagtacaacctaagcatgacagtaagaccgaccgtattcagtttggaatgcaacaagttagtttagttgagtttaaattagctgaaattgctagttgcagtattgtctcgagcaaattaacaataaatgatattttagccacatgaaggactgaaaggcagtaacctttcagtgtggaatgcaacaagttagtttagttgagtttaaattagctgaaattgctagttgcagtatcgtctcgagcaagttaacaatgattgatatttagccacatgaaggactgaaaggcagtaaattatgtgtacccgcgacatgtagttatccatgagatgtatcgttgatgatcttcgacatgtgattatccgcatggtaggactcatgaaagcgcacagtcacgcaccacatgaacaccaggacataagagagaacacagtggagacagggacaccaggtcggggtgaagaacccggggcaaaataaaatgaatagttccccgtgcgatctccaccccaacaacacaaggaaaatatctttttattgtcttgtggcctgccaagcgagcgcacccaacatggcaaaggccttcctaccctaaatctagatacatcatacatagtatatagtacaacatgattatacaacatgcacatacatgtgcattagcttaccgaggtcattaccttatcttctggttgggagatatggacatacatcatctaattagcagcacatcaatcatcaaacaagaaacatcatcaccatcacgattcctagatgaaggaatgctcatggcaccattgcaaggaaggaaagcatctgtgcatagtaggaaaatcttaggagtctggctgtaggcgacattaacgaagaaatcatcgtacatggttacagctccacacccaaaagatcaattacgcacacaggccaccagttgcaaagtgagcaacacggatgaagcaaaaatctcatcatatctgcaggaacagaataacagaattagaattaggctaaaactgtgcgtgcaatagttctttctaccatgaaagaaggtatataaatctaccaatttaacagggattattcaagtcagatgagaaaaaactaacataagaaaaaggttcagaaaaataccaattttgggttcaagtcagatctagacacaactatgaggaaaaacagatctaatctataaaacctattgagacgtgataaaattcaaccaccaccaccaccaccatcctgagaaggcaaatcagatcaagaaaagccccaacacatcaggagaggtaactaccaccaccatcctgagaaggcaaatcatatcaagaaaagccccaacacatcaggagaggtaactaccaaccatagcaagatggagaagacaatattaataaggtgcggcggcttaaatcagctaaagtaacggaaatagatcctgatctatgaaatatgtatggcgcataaaaacaaaacaggacgaaaactgaaaatcaaaatctactccatcccaaaacaaacgtaatttaatcttccaatgtaatcaaccatcaacccatcttgtactcctatactaaacgttactccctccgttcacatgtaagactttttagcattgctcacatacatatatatgttaatgaatctaaacacatatgtctagattcattaacatctaaatgaatatgagctatgctaaaaaaatcttatattatgaaacagaggaagtagtaagaagggagcggaagaacgaacgaaccttacgaatcgaagaggaccccgaggagaaatcgtgacgagacgaagagagagaggaagaggggcgagggggaagaccatatataccggcgtggctgccctggttggcggtggaaaacaagtcggttcgtgcttgctatggaaaggacgggtcggtcatggatataccaccattgggtcttcttgcgtgtcgggtgcggtttagtgcgtggctttgctgctggccacgttacgtatacttccattgacctttgctgctcgtttacgtcatcccttgcgtcacatctaggatggatcgcctgtgcccatccagccgtatggccggatttataggtgtccaaacgggcggcacggcccggcccggcacgggcacgggtcc

SEQ ID NO: 49801 - DNA, 4323 bp, Oryza sativa
ttttttttttaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagtttttaaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttagtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgagcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaataagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaattagcaatttcaagaaggttgtgcaaaattatattagcagttggataataaacttgtgacaaagttagagtacaatcataaaaagtttctagaaattagtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgtgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtattcccaactgcgtaccgtaccgtctgggtttaccataagttgctgctgccggagttgtattccttgcttcttggcacacgactccgcatggcgcttgaggtgacctgtaccaccagaagaacgagcaaataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaagctaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcccgctttcggcctgacgggccgccggcgaaacgggccgtgccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcctggcccgtttggccacctctagccggattcgcgcgtagctggtgggcgccgcgaagttggccttcgcaaaacgggaggcgggagacgagggttgtgtggcggcctccgaggccatcgcatcattggccaagccaccaccaactccttcccaaaatcaccccaaccccggcgccctcttcggccaccatgggagatggcctgctcttgccgtagccgagctcgctgtggccccacaacaaggaggaggtcgtgttgctggtctccgacggacgcagcatagtggcggtgacgtcccagaccccgagacctgtacctactaagctcggtcttgctcttcatcttcttcacctaccacggcgcctagaacctgcagagcaccatcaacacagtagtaaacagagtcattttctcaaaactgatctacatgcacgctagcttccatggcgtcaaatttcgattgagctagtgtaggacaagaacctggggttggtgtcacttggattgttgtacaccgcattctcggtggtgggctagccgttggtacggcagatagggtccaagcgggcgttcgtgcggcgaggagcagaaagggaagaccgggcggcggcgaccttcccaccctgcccccgctcgctgtcctcctccctcctcgcccggccgctgcgcgccgcccctcctcacccgccggccaccgcgcgccgcccctcctcactcgcgcctggagagaggacagaggagagggggagagacgaaggggagtgaggccaagaactttcagaatatgctatcgaattcgcactgcttcaggatatgccatctaattcgtgctacttttaaaatacaccatcagagacgaatttttttgttccgtgccactccgtctcttccgtccatagcgtcgtcgtctttcgtccgcccggcggcaccgtcgtcagtacgccagtccgccaccgcccgcgccgacgtttgtccgtcgccggcatcgtccatcctcgtcggcgtcgtcgtcgtcccggcgtggcgtgggcgcggagggaggcaag

SEQ ID NO: 49802 - DNA, 7316 bp, Oryza sativa
ttccccaccgcagcaaccgccttattccgccttgccccgctgctagcactcgcctccctccgcgcccactacatgccgtggacgatgccgccgccgatgaggatggacgatgccggcgacggacggacgccggcgcggcggtggcggactgacaacagcgctacggatggaagagactgagtggcacggaacgaaaaaaattcgtactccgatggcgtattctgaaagtagcatgaatggatggcatattctgaaaattctcgttgggcctggagagaggacaaaggtttgggaaagaggaggaaaacgaggaggggtgagcatgacatggggcccaccattttaaatttagttatttggtgtaactgacatgtgagaccatgatttttattattttccaaatcaaattgccacgtaagcgctacgtcatatgacgatcaagtcaaattagtcagatagacgtgcacgtcagcgaaaactgttgtccaaaccaccatgggacccaccggttttgtcaattgagggacccgttgtatctagttttctagttgaaggatgataatcggattcattgacaagttaagggacctcagatgaacttattctgctagagagagataggggacggaaaacggacttttctggaattggcccaagaagaagaggatttaaattattcattgaaatgatattttaatttttaaaaatacttccattgcacaaataattctaaaaaatacttggatactcaatgtattcaataaaaatttatctagctcgatttgatgttcaaatttttcatagtttttattcagacacttactttaattattaaataatttctaaaattactttttcacaacaatttataatttagcaatttttagggtgtgacaagaagaatggggaagatgtaataaaatagcggaaaaatttaaaaagtaatgccatgtcgtcgagaccggtggcaacgagaatgaaaacatgggagagtgtcatttgagcatatgcaagttgggaaggtcgccgctagagacgtcattgtcatggtctcggccatgtgctcacgcacacattgcgtcaccaagaggaaggggatgatgacgagccgctcctcgatctacttcgttgtcgactccgcgagagaggaactgtggtgcggatgacagaggtcatggaggtcaccagagctgcacgctagaaggtcaagcccccgatggaaccaaccgcacgtgcgatgtccaccactgccaagatctggaagagggagctcaaggctaatatcggagcatcgatatcgtgttagagcgtctcatgtgaagcttgtcactggtcattgccacttcacctgcatgtgggccctttagctctcatcgttgctaccgagctcgagctcaacgaggtggctatctagagcttgagctggcgatacagagaagccactcgccattgtttcctttctctcgtcaatgatgcacacgcaagagctcatggtggcggccatggcaacctcgacaaatggcagctatcttggaagaagataaaaaggaaaaaaagagaaggaaaaaaaagtgggaaacgagagaagaagcaaaaggagaaaaataaagaagaaagaagaaagaaaaaaaataggtatctggtggccaaatatggtagtcaggaccgtagagttaatgatgatatcaaatcagcgcaacttaaagattctacaggatggtgataatttggtataagtgcttgtacaatagtctttattagtggtctttctattgccatgcaagtaaaattaatgacatagaagaaatagaaatatggttgttagagcaagtataataatgagctataggtgtactataagcttatgtgaactgtgaaggagagaggtagcaaaaaaattaagagtgttggctctcatgcaagagctaacttaatacaatctacaatacaaatacattcattgtataagttagagatagagagcggagaagaaaattgtagccaaccttatagctaatctattatatatattgactttaagatgggctaataataggaagtaagctatactattatccttgctcttatgcatgacaatggtttagagtcgactcttagcatttattagcacaaattttattgcatggtggcgaaagaaaggaaagaagagtaagaaaaaatattttgatacattaatgattagagatcatattgtcttcaactgttgtagaatactggtctctaaataacgtaaagctcatacctgactctacctctgtacatgccctaaaataaagtttaacaagttttgtcatccaaatttggattttaagaatataggaactttaataatagaagcgattaagtttagtgagtggttgtctgtatagtttactgtaaaaaagtttatacttgtgtttttgacaagctaagggtgcgttctaataggcgggatggtttagccgacatagctgcacgtaaatgagaaatgtgattagtatttgattaattagataatattttataaaaaagttaataaataaatttattagatttttttaagcaatttatatatataaagttttttcacaaaacatatcgtttagtagtttaaaaacatgctgacgaaaaacgaggattagctaagcggctttagctggaaaggacgcacccactaatactggaaaatattgaaaagctagtaaaaaataattactaaattaagtttgaaaatgtaaaataaaacacaaatattttcaagggaggagaaaccgtatcgtacaggaaaaaaagaacgttcatcacattttagtatttcaactactttcaggctttcagcagagttcatggaaccgatgtgtttcgacggaaccgatgcgctatcatcccatggcctaggctgtgtgcctttctttacctagcgaaactttgtcacttttacgggagatatttaactaagtgcaagtctgcgactcttacatgtagcaattgaaaatttatcaccactaaacctatatgctataggcatataaggacccatatccacatgtcatgaactgcgaatgataaattttttaaatttttaattgccacatcacaaatagttagattccctcttttatagaattctatcaaatccaacaatccaacagtttttatttatcgatctgcctttttgtcgatcaagtcgatttcacgaaccatttttaggctgctttcctttccagccgttcctaactcagcgtgtacgtttttcaaactactaaacggtgtgtttttttaaatgtttctatacaaaagttgtttaaaaaaatcatattaatctattttttaaaaaaagatagctaaaacttaattaataacatgctaaacgctgcttcgttttgcgaggggtttttaactatttaccactcttccggagtgccactatccatatgccactcttctagatttttttttatacaaacaccataaaagagatattttctccctaattaatatgctatgtcagcaagggagacttgaaatgacctttttgcccttggtttcatataatttgagagagattatatacaaacatatgttaacaaatattgattgaacaagttcaccacaatataataatagattaaacgtagccactttcatatagaatcgaaccatccatattacaatatatattggcaacctgtcatgttcacaaggccataataagacatcgcgtacaagtaatctctcatataataaagttcattgagagatgctaggccgtacatgcaggccatgaagttcggtttagtttcaaaaatatcacatcgaatctttggacgcatgcatagagtattaaatatagattttaaaaaaactaattacacagttaggggaaaaattgcgagacaaatcttttgagcttaattaatccatgattagctataagtgctatagtaaaccacatgtgctaatgacgaattaattagactcaaaagattcgtctcgcggtttccaggcgagttatgaaattagtttttttatttatatccgaaaaccccttccgacatccggtcaaacgttcgatgtgacacccaaaaattttcatttcgcgaactaaacagacccgaagtagtttgtagcaaaataagaaggcatacgatcattaggccatacacatcatatcacaacaaaaggcgccaaaggcttatcagaccattcatcatttcataagttcatcaggccacatcacatagcaaaatcagttgaatagcttgagtggtgaagcaattttgggcttgttagctagcttttttctaggagtaagcttcttggattgctagcaaaaaggtcatttcaaatctccctactgacatagcatactaattagggataaaatctctcttgtggtgtttgtgtaaaaaaatctggaaaagtggcatatggatagttgcactccagaagagtgacaaatagttaaaaaaaaaaccccgtcggccgccgcgcgtcactccctcctcacccgccggctgctgcgtgccgctgcctcctctcccgtctccctctggccgccgtgtgccgccactcctcactcgcgcctggagagaggacagaggagaggggagagagatgaaggggaattggggagggaggaggaagaagaggagggttgagaatgatatgtggagcttccatcattttaaaattaattttttgggtgtaactgacatgccggctgacaattttttattattttcgaaatcaagttgccacataaacgccacgtctttgccatgttatatgaagaccgaatcaaattagccacgtaggcgtcacgtaaaccgccatccaatctgccatgggacctatattgtattggttttgacaaatcgttatatctagtttttcagttgaaggatgaaaattggattcgttgacaagctaagacaccttttatgaatggaaaaagtatactgaagatccctcaacttgtcatcgagttacaaaatcatcctccaaccacaaaaccacgtatgtctttagttggttttaaccccgggtttgtcatacgtgacggctgagtcagcgtgggacccacatgggtcccacatgtcagtagccacgtcagcctcctatctccttcctcatctctctttcacgctttctctcagatgggtgcccccacgcgcgtcgcatccccgccacgaacgccatggtgacgagccccatcgccgcggcccccgccacagccatatgcggcgcggcgcacgcgcggccgggacggttcgcgcccagctcgttccccacccgtgttgacacgccgaagcccagcaacgacgggaacatgtactccaagggctccgggaacacgccgaatcccggctcccgtgtcgtcgccgccgtgcttcaagggcaagaagatgtgggatgacgaggaggaggtccagagccttctcaccggtcgcgaatggcgccggccgggaggttgaggtcgaacgcccgggcggcggagtggccgttgccggagctgcgggcggagtcggcagcttgacccggtggctcgtcttgtggccgccaagcgcctgataggcttgccgcagacggagcacttgaactccgcacctgccgacggccgcaccaacgccgagagcggaggcggcgcctggacacggtggtggccgccgcgggctagcatgaggaggcagagccgcaatatgtaaattgatcaactagaggcttctgttttcttaccgtgtctgtaagcaaaggagactgaggtgccaaaacaagatgtttcggttctgtacaaatatgatcatgaaatcaatctgtgtttatgttacagcgtactgtacacgaatcaatctcccaatatgatcgaatatggtctacaatatatgaccgccaaaaaactaagtgtaaaagatacaggtacagttccagtgtacaaagaaccaaggaagagctagacatagtatctgtatgactatgtatggctatgtatcactcgtttgctatgtacaaaagcaggaacaaattaaacaatagcggcacaaaacgaatcaacgaatagtttgtttcgaccgtgaatttcactccctagaccaaaaactgtttgagagatcagatccgtgcagctgctgaattacgcggtgagaaggcgagggggctctggacctcggaggaggcaggagccaagacgggagatgcgggcggagtaggcagcttgaaccggtggctcgtcttgtggccgccgagcgcctggtaggagctgaaggacctgccgcagacggagcacttgaactccgcacctaccggcgccgagagaggaggcggcgcctggacgcggtggtggccgccgagggcgagcatgagaaggcagagcgcgaggttctcctcctccgatcgctggcggcgcgacctcttccgcttcgcccacccctgcggtaggtgcccgccctcctccccgcttgtggcgctgctgctcgtcacgaccgccgcctcctccacctcgtgctgctgctcctcctccttgagcaccgcggcgtggagcgcttccgtctcgccattcgcgacctgccgccgccgcctcaccctggcggccttcgccccagccaccggccggcttgccgagaagagtgagagagagagagatgaggaagggagaggagggggaagagagagagagggtgctgacgtggccacgctgacaggtgggacctacgtgggttccacgctgactcagccgccacgtatgatgaaaccgggttcaaaaccaccaaaggacctaaaatgaatgttttttaagttggaggatactctgtatctggttttctggttgggggacgattttgtaactcgataacaagttgagggaccttctgaaccgggttcgcgacggatggccgacgttattaatcctattttatcagtgtaaaaataattgtaaatgatatcataaatctatttaatccttttaattaggctttaattggattaaatatcgtaaaattcataactaattcatgcaaactcgaaatgaagtcgttcaagtctcaaaattcatctcaaatctcatagttaaacttatttcttttcatatggacacagatttggacaaattttatttgaaattatagctcttgacgagatttataattttataggtgatttttttttcatttgaaatgttttagatacttaaattcatgtttcaagtctcaattaagtaggctcaaatgaaaacatatctatcttctaatgagatatttcatgaaatgccattgacaagcatccaaataccagaaatgccatcgacaagtgtgagt

SEQ ID NO: 49803 - DNA, 18305 bp, Oryza sativa
ttgtcgatggcattactgggacttggacgcttgtcaatagcatttcttggattatcttttttctaatagaatttatatgtagctgagttggtaaaggagagaggtgttgggttcgaatcctaaccatgacaaggccggtataaaaaaaatacttaggatgatagtttaatatagtgtggaactaatgctacatatgaagtgttgcaatgtaattttttgccatatctattttgtggcaatatgaaaatttgttatcactaaataaaaatcattacaataacctattaccactatatttattagcaacaatttaaaaatgatagcaacatatatgtattgccacgattttttttcgtggtgacaaatcattttcggtagtgatattcgtttcatattataattcgctttaatttttttcctagtaaaactttgttaggtttgatcaaatttatagaaaaatttagtaacatctaaaacgccaaaataatgatgttaaattctaccaggaaaatagtatgtttgttttgtacgaaaatggtactatatctttttataaacttgtcaaacttaattttttttaaaaaatcaaaacaacttataatataaaatagagggagtaatatacaagcaaaaagaagaaaagaaaattgaatgattgtgtctatgtcattcatgaccaccaggtataggtgctgttattattgcacaaaattcacaaaaactcaatgaccaatccaacgtgtatgtacgtatatttatgtgcaagcactccatcatcatcatccctcgttgtccggccagaatgtatgtgcgtgtatcaatataatgtactcctctgcatcgatcgatcagccgctgtcgttggctagccagtcgaggagcgaccggaatttcttggcgacggcgcccttctgccaccggagccgcttccaccggcttcccaccagcaccgggtgcagcccgaggatgtgctccggcatgaagtcgtgcctcgtcaggatccccaccaccggcgacctctgcaacgatcttattcgaatgagagtttgtaacagtggaacaaaaggttaagtaatttgtaatttggattggagcaggtgtgtgttagtaatttgagtagtggacatcgattcacatacgtcgcaggacttgggcacgacgaggaggtgtcgcaggccgacctcgcggaagaggacgagcgccttggccagcgacatggtctccaccaccgtgtacggcgacgtgttggtgaaggggtgcaggtcgacgtacatctccatctcctccggcgacagctccacgtcggcgatggtgtcctgcttcccggacccgcgcttgtcgaagtcctgcgcctcgaacctcccggccatgtagtccttggggcaccgcaccggcgccgtcaggaactcccgcttcttgagcagtaccagcaggtgcgcgcgcagcacgaggccgtacagcaccggtgccggcgagaagggcggctcgtcgaccaccgggaacgcgtggtgccccgtggtccggagcgtgtgcacgatgtggcccaccttctcgacgccgttgaagctccgcagcggcccggccaccacgtcgccgacggtgagctgccgcatgtacggctcggcgtggccgtcgaggtgcgggaggcccttgagattgaggatgaggtcgtagatgctggagttgaaggagtcggcgacggtcttggagatgagcagcacgagcatgacgagcgggaggaggagcaggttgttggtgagctccaggatgatgacgcacacggacaccgtcatccggagcgtgccgccgaggaaggaggcggagccgaggatggcgacgaggccgtggtcgagtcctgagcggccgccgagcagcatggcgacgaggcggccgtaggtggcgccggtgaggatgatggggacgaacagccccgacggcgcgacgacgccgtagctgagcacgccgagcgcgtaggaggcgacgaaaaaggcgagcatggagcccgggtggtagacgtcgttggtgcccgtggagtagaggttgcggatggcgtcgtcgttgatgttgaggaagaggctggccaagtcgttgtagtgccccgccgggcagtggaaccgccggaatcggttcagcgaatggcacgtcccgttcggcggcgacggcgccccggctgtcgggcacggccggcacggcgccagccacggcaggccgaacacgcagcacgacgtcaggatggacaccaccgccgccagaagcagcttgtgcgcgttgcccctcctgcacatttcaaaaattaatttcattggattggattggatttttcactagaatataatcagttcaacttcaatgtgttccaaatgatgtcataattaattaattgaacgaacaagtaagccatgtgaaattggcaaagatatggaatgatcgtagctagctagccatactcgttgatcacgctgtagacgcgcaggaccttcatcatgaggaagttgtagagggcgcccaagatggcgccgatcacgccgatgaggacgacgatggggatgtccttgaggtggtaggtcatgaggtcatcaaacttggtgctgacgtcgtacatgatcagcccacccttgccgaacagcccgcacttccccgacgcgcacagctcgatgaacatccgcagcaccaccgccaccaccgccgtcgtgaagaacgaccgccagatcagcgcgctccgccaccttgattaattatcagccacaaattatacattcttgtaattaagttgtcagccaaaagcttcagaggatgaacagaaaaagaaaattgcagcagtgcatatcattcatgtgtaatttgatgggtagttttaccatgacgagagtgattcgagagcgaacaggacgccgccgacgggggcgcggaaagccgcggtgacacctgcgccggcgcctatggtgacgagatcacggcggtcgcggtcgttcttgaagtagcgcagccagcggcaggtgaggccgtacttgcgcgacccgccctggccgaagatggcggcgatgcacgcgcccgtgtgtaccattgggccagctttgccgacgtgcagcgaggatgacacggccgcgatgttaccgattatctgcacagttggaaatcagaatagatatggggagttcagcttaaaatgctccagttttgtcagttacacaacgttcgacatgtgtaatcatccctattattatcaccgtatttttactccctcagtttgttattattcatgatgttccatttattttccccatatttgaacgttacgctggttcatatctgtgcctggagttgtacaggacatcattgcctttgcctagactaaccacaaaagcataagaagaatgacctgtttaatttgccattaaaaattttgcacaatcctatgtttgccatatattgtggtaccctgccggtcttgattcaattccaacaatccaatattgccggcacatttcttgcaaactcttggggtacattattattttatttttaggagctgatcaatgtatgctttaggataagtttaccatacttagggcccctttgattcaaagaaaattcataggaattttagaggagttcattcctatataaatttttcctatatagccatttgaattaaaggaatggatcttatgaaatcctatgaaattcctatggaatgactctttccatgcaagtttcggaggaaatttaacataaggtagaacctcatggaaagaatcctttgagtctttatctctcctcaaattcctgtatttttcctatggcccaatcaaatagtcattcctatgtttttcctgtgttttgcaatcctctcttttacacttgcattcctgtcagaatcttatgtttttcctattcctccgtttttttcattcctatgattcaaaggggcccttaagatattaggagataacatatttttctaagtgtaaaacttgatatctccagatactaggtattacacttaacttttatgtaaaattttgatgtctacaagtgctttcttaagaaccataaaatttctcttttttttaacatatggattttgtctaatgacccaataattctttttctaaaaaaaataagagtgaatttcactactttagccaaattatcagaaacctacagatttgacatgatgtttcataatactacatatttaacattaaatttatcacagaactacagatttaaggtggaatatcgcaaaattacacatttagtaacaaagttatcacaaaactacatgttttatatcaatgtaatcacacaatttgggcatttacaactcaaacataaaattagagctaaatatttaaatcccaaaatcaataattgtttgataattttattattaaatttatagtttttggataaatttatcgctaaatctgtagttttatgatacatcagttaaatatgtaattttgcgataatttaacccatgtatctgtagttctatgaaatttactaaaaaaataattgatagataggaatatttcagtcgctcaaatgaacaagttgactcgttttatgaatattggggttttaagaaatctacagaaaaacaaaataagtatcaattattgaggactttgtaggcattccaattcaaacggaagtcgtgctgttacatttcactttcatgagataaagatctagagattctatatcaatcatggatccattttataactctgtcaaccccaatagagagcaaacaggtaaagtaaacggatgagtgatgtatgtagtggatccaaacaataataaaaaggacacccaaggtctcaattattaatgatgcccatgtaaaacaaacagccacacacataaaacaattctttgctgcaagaacatgccctttcatcgtaaaagaattagcactaattttttggcagaaacttgcacgatcacggctattcttttgatcctaatagtactaccactaaggccgtgtttagttctttggccaattttttttaagtatacggacacatatttaaagtattaaatgtagattagtaacaaaaataaattacatatttcgtctataaactgcaagacgaatttattaagcctaattaatctgtcattagcaaatgtttattgtagctccacattatcaaatcatggtgtagttagggtcaaaagattcgtctcgcaatttgtatgcaaactgtgtaattgttttttttcgtccacgtttaatgatctatgcatgtgtccaaacacagaatttttggaagtttgaagggaactgaacacagcctaatatagaacgaattaatgtcccttttgcccgtggataattcaggcacacagttccaaaaaaagaagagaaaaaaaaatcagtcgcacaactggcaattacagtaattgggagtggctcatgtgctaatctgcgctgagctgtagaggaggataggaacgcaccttgacagcgagtgtcctgagcgagaagatgtttggcgcgtccacgccgttgaggtaggccttcacctccgggatccccgacccgccggccgccggcgacacgaacgccgtgatggacgacgcgaacagcagcagggccaggttggttccggcgaacagccagaacgctgtccaatagctgcatccgacatgagtttcagacttcagactcggagtaacagacagaaattgatctttgttccaaaaattcagtcaattttgagggttcagaattctagatcacttgacagatagcattctcagatttgaacaagaattgatctgatcagggacaaaaagagtacgggataataatagacaaagcaggagacaagcatgagtgaatttgtcgtactcagcaaaagcaacattacttttttcttggacaaggcaataggaggcaatgagcagaacctgctggactccatgagggcggacacggcggtgtgcttgaggccggcgacattctcgacggcgaggttgatgacgaagccggcgatgccggtgatgatgccgatggcgaagcagaaggtccacttgagcaccacgtaccgcacctggtcggctttccctctcgacctccagttctgatcgaacaggtcgttctctattatcctgtaacccaaatcaaatccccaaagaaaaggaaaacgaattagcattgtcgcaaaccgacgaaaatattaccaacaggttacagagctgtgtatattactatattagcaaattggaatggtaattgcagcgagtaagataacctccgcaggagtaggtggatgaaaatgcaagtgggggcaagcaagatacaaacatttctgacaagacaataggtggcaggaacatgacatgtccttgagaggacagctgaatcaataaacagagagcaattggatcaccatacgaaacgaggcagcaacattgagatgctatcccaatcaagaagcaaatcatggaacactattggataagaaaaagcatttcatctcgacattgaatcaacaattcaacatgatggagaagcaaggattgggaaagatcagacgatacaggtggtaggatccagagtccctgacaagaacgaacggagagagaaagggaggcagagccacagaggagagggggcgcgtactcgtaatcgaggctctctatggggcaggggttggagccgaccatggcaacctgggaggtgttgttggtggcgctgcggtggagcagggcccggttgagaggcggccggtgctcgtcttcctccatgaggaggtcctcctcccgtggagccgtgcacgccatgagagagcttgccgcagagggagacgaggggagcagagcatctgggtattgcgaagtgtaaatagcggggagcagagacgggtttgagttagttaggcctggtctatagaccaagatgtggaattattggagtgtgtttattatttagtgtggcaaatgtccatatcaatagtagtacatattattttgtcagcaaatatttcttgccaaccacatggcggaaaaaactatttccttaaattgtaccgaccaaatatgtgccttcactgtcggtacgaacttacgatggataaactatattaaagagtctatataccccactaaactttggtaggaaattcatctagcattcttaactttaaaattatacatccaaccccctaaactttgcaatatcatttatattgtcctctaatgccttgttcggttaatccctgcgagggagagattgaaggggatttattccacatgtattgtggtgtagaattattcctcatcaatcccctccaatattctttaatactctctaaaccgaacaagacctaaggtgttttcggatggtggttttgtgaatttaaaagcataaatgagtgattttgaataattaatataatatatttatatatcattaatactcggttctcaatttatactcgatagtgatatcatagtaatattatgtaagtcagaacaaacaaggaggaaaaaaaataaagatttgggtggagattttaacacatatatccaatgtgtatgccacgtagtcaaactcattcaacgtatatacatattagattaaaaaccacattgcaaaaccacattaggagattatatataatggtattataaagttttggtgaggtgggaggggattaaatatccggttttaaagttgaggactttcaatcaaaattagggagtatttggaatttttcctaaactatattatgtcataattataattaaactataaatatataataaaaggaaattttgaaaactaatttctaaaaaaatactaactctatcataaaaatacaataacctactatgagatgtgacaaattctaatattacgagtttggataggtcccatgtccaaatacctaatattaggatgtgttccatctcatactaagtcgctatttttgaaatatgggaagtagagaatatcatgtaagtttatctaatttgactacctttgatcaaaatttataaatttgatttattttaaggaaaagaagctccctagaaataatgaaaaatttagtcatacctcggtgaaagattgggattttagttttactgagtgagtactaaataaacatgggatttaccatcaattatgataggaaaaaacaatgcacgatcaacactgttaatctttttagataaggatgctttgtgttcatgggaggaggaatgcctaaggtaaaccggaataacctgaatgcaccagttgctttgagatttcctgaacgagtagctagtagtgtatagaccgagcccacaggattctagggagagaacaagagcgtgacagggctgggaggggtaggatgacatgatgagttggcaacccgggctggtgtcttttgccttttgggatgcaggggagccgttgttaattatctcatgccaattattgatttgtcgtggtcgtgcgatgcgcctgggccaggagcatctgggagagacaccttcttttcatgaatactccgtaatagcaaagggaggacaaaataaattgctcgtaaggatgtggtatgggttgatcacttgattgcctattgcagttgtaagagcatcatcaatattgattacaaaatatcgattttccttcggagctagagatggtttataataacgatgaaaatgcttattcagactactgaaagcttgtttcattaatataatatatgtgcgatgagtacatgatgagctatagaaatgaagaaattgtaatatgcactttttaaacttcattattcttttatttgccacaccaatcctatatacctatacaattcatccccactaataggaatttcctgcattgttgtgcagccatgtcacctcaaattagcacagccattagatgaaatagcaatggttcagattgcagtccctctcttccctgcctttaaccacatcccaatatagatgggcaagcccaagccactgcctaggcccaattcgcccattccgattatactgcgtcgttatcactcccgacccccaagcgttcacatctgccggtgccgctaaaatcgtgaccgacccgccggctcctgacctcccgcgcgccttccatgcttcccggcttctcgagactgatcgccttcatggtgtttggagagataaaaactaatcgccgccgcaacttcgatttgtctcctacttcatctacctcgctggaaacagcctctccctcccatgaaaccttcacggcttcacccgctcagtcgctcactcaccttcgagtatattcctctccaaaagtatgtttccttctcttcttaaatcttatatatgttcattcaatttattagcatttattttctttccagtcacgctagactgatttttttcatattgtcagtgaagttatcaaatgattaaaaaacagagagatggatttggtttcgcatttctactagcaagattgaaatttatttggtctgtacacattgagtcaattcatggtatttattcggtttatactagccctgttcattgtatataaaccaattttacaatgtttctacacctataatttgttgtctttatgtattcatattgcagttcatcattaatattaattcctattgcagttcgttcctattactactgcctactgaggtcagtccccagaacactcccatccaaagcagcaactgatttggtttctctatatgagttctctatgaagtaaaaatcccaatatattcggtacctcatattcgttcatggtcatcggctttccagatattattattatatgaccatcctacgataccttctttgtaagaggtactaagcaatttcttccataaaaacaccgttagaattttcatgtgtagacagaaaaagatcatgctatgattgtttcagcaattaacttaatttaggtacatatattggttcctggatgtgcacatgctacccttccttgctatatgatgtttctactttacgttcaggtttgtaagctacagttttatgattgatgtaaccttattcttcgcattttgttctgctggaggttttaatgtagtccaaggatgtaatcacatcagctgatgcaatcaaccacaaaacagaaatgccattgatcgccattggcaacaatacatatagtaatttgattatcctggtgttcaaaactttttctcgacaacttttggatctcagattttcctaacctccatccggtaagtttattgatattgtggtcataaatttctatttgtgctacatattgctttctcctttctatccggaatcatccgccagatatcatattttctctttaattagttcgctaaaattgcagttatgtatctatgtggtatttcagtatgaggtaaaactgacccttttaaagcattttatggaattgtactttcttttgttgaactattgcctttgttatacatgttgcgggcacctacattttgtgtcttcttaacaggatgtttcagctgtagacttgctgcattgcaccaactgcacagaccaaggttagtactttagatggcagcttaattagttgcaaggccctagctacaaaattgattacaatttaatctgcttattccacttagacatggtttaagaatataattcactctaaaaaaactatttcctttaattatctaatctatatatgcattacattataccacagcatcaccaatcaattgcacccatgaatggtactttgatgcttcagattattgcataatatttctgtactatattaatcatgcattttcttagatattacacagttcagattatcgaataatattcctgtactatattaatcatgcattttcttagatatttcacaattgaactattgatatatgtttaagtttattataactatatattgcacatgaatccccgcagcaacgcgcggggtactatctagttattattattatgggtgataaattttgcttgcacacgccactacacacatattgcatataccactagagtgtgtctctttaacacacgcttaaaagttactccatctgttttaggttataagacattttgactttggtcaaagttaaactacttcaactttgactaagtttgtagataaatataataatatttataataccaaattagtttcattaaatcaataattgaatatatttttataataaatttgtcttgggttaaaaatattattatttttgtttacaaacttagttaaaattagagcagtttgactttgatcaaagtcaaaacgtcttataacctgaaacgcaggtggtagatgctaaagataaatatttagtcttcatgactgggacacaacatgattttgaaaagttgaaaggctgtttattttgttttatatttaaattgttgattacatattgttgttcccattaatcactagtgtatgtgtcaagttataatgtttctacaaactaaacaaccattatattctagagaaaatccaacaaatatcattgacaaatgtcctattctaagaaacaccatcgacgaatgtcggttctaaaatatgtcattgtacagggctatttgtcccagaaatgctacagttatcagtgttccatccatttatcttcattaacccatgtaaaaatgtgatatggttaacgagtgaaatggatggaaccttaacaaagatggaatttcgaacataagttggctcatacaatggtatttctaaaagttgcattattatttaaaatgggcacttgtcaatgacatttattatattttctctatattctaaggcacataagccgctcataattggaacaaaatactcctatggagcaacatagggtacatgcaaaactttacatactattagtacatgtaccttggcttgtccttttatcactttcttaatttttggcataatccctacaaaggaagcaacaacaagatatagatttttgatttcttgacttcttccttgaatagctttcagctaatagaagcaacatataattttcaaatgctttaatatatactatcaccggatttcataaaaaactgttgacttttgatatagatcatacctttgacttttgaacatatgtttgatcattggttttatcacaaagttatataactattatttattttgttgtgatttggtttatcatcaaaggtatgacttacaattttttatatttatgaagaaaaatgtaataagacaaatagtcaaatatattgccaaaaatcaacaatattatctattaaaaactagagagagaatgaaatacaaagccatgttgaaaaaaattgcatatagttaaataggggaagttataaaaagccacgataattctatccatacatgttaaggataatgtggcatatggttgtgtcattgtcatgctcaagggtagactcgggcctcaggacactgggctggggcacaaggcctatgattgaaggtccattaggatgaagatttttcaaccatataaacacatacatataaacacatacaagtcccaactctcaatgggctggctagggccttaggctaatcctggttccgcccatgatcacattatctctgttttatactattagatgtgttgattttttataaagtcaaaccttttcaaatttgactaatgttgacttcagcaagggggttgggagcccttcccctctagcatgcaaaatggagtggtagattagcacgtgaataattaagtattagctaaaaacataaaaatggattaatatgatttttttaagtaactttcctctagaaaatttttgcaaaaaaaaaaacacattgtttagcagttcggaaagcgtgcgcgttgaaaacaagtgagtagaagttgggaaagtgtagtatagaacactcataagtttatagaaataagtagtaacattttcaagacaaataaatatatttaaaaaatatatccaatgtttgatttaatgaaactaatttagtgttatcgatgttgctaattttaatatatttaatgaaacttaaagaaatttgacttagaaaatttcaagatatcttatatatgaattagagggagtatgatgcatcacatatggcttatactaggagcatctgtaccagtgatcgagtattggagcatgagggcacttgacgtgccaaacagactaaaatccgacgacgatggagcctataggaaaccaataaaaggtggcatctaaagagaatatgatgaggattgctagtttgcgtgtgtgtgtgccgcaaacataagtcacacatgtggtgcgtccctaccgattccgctccttgctactgagtagagaagcgttagctttctgctaattgagaactcatactacgttcaaaacatcaacttgtgccataaactttaatctcaaaaagtcacaaactttcaaatcaaataaaaaactttcaattcaaatctaaaaccttcatatcaaaatcacaaaaaatctcaattaaagtctaaaacgaaaatctcaaataaaacactttcaatttaagtctaaaactttcatatcaaaataataaaaatgtttaatttaaagtctaaaactttcatatcaaaatcacaaaaactttcaatgaaagtctaaaacttttatgtcaaaatcacaaaagtttcaaatgaagacctaaaacttccatctaaaaatcacaaaaattttcaattcaaatctaaaactttcatcttagaaaatacacaatactttcaatacaaaatctaaaacttcaaataaataccaaaatctatcttctcttctagcctcagccatcgcccttccagccccgtagccacgagcacatcgcagggtgcactacctatgctcctcctactctgaaaaggttagcacgatcccgatgcggtacacaatggcaaccgtgagagagacgcggagacaaggagtccccatggcgggagcaacgactgccagcgaggtaggattttcacaatgaatatacaagttaagtagctcttgctggataataaaatgaatgcttatagtatgtagaaaaaaatggtgttttagattatgaaagacaaatagtgctttgaactttaatttccactcaaatggaaacatctaattaattaattagagtatggccctattaattgttggactagatcagttgtagtcacatatataacagtttgagtaccataccaatatgttgacttgatatgatcaacgtaagaattccttagccttgatttgtggtttgttgatatactgatgatattattgtatgatagtactacttattgtgtgtaagctcatggttcactacccacactaatctagtggttagaaaaccgactaatactagctatcggtcaatcggcattaaccgtgtcagtttgtaatatactggccataaacctaagatgatggaattgcatgatatatagctgtctctattgctgttacttgcttcgtcgttataaaataattaaacgtaattctagcatttaaaatttactccaccaaaaaatataattctaacttatagagggtatcatgttttttacttattattttagatatggatacatagtctgtaaagtaaaaaaaaaacccaacccatcccataatacaacaattgtagcataagtataaattgccacagccaatgagccatcgctctcaatttctcattccctgatcaatctccgcaaaataaaataaataaagaatagccatacaataataagattagtgctgctcaattattatccgccctgctgctctgctattaccgaaagctccatcttagagcaagttcaatagtatagctaactactaacttcaattcatctatagctaatctaacagctcattcatataatagttacatactacactattaatatctggtcccacctgtcatacataatatgtgtcttggagtccgtgctatagctggctacaaatttatagcccgttgcccttttctctcctcatttatctctttaaaatatgtttgcagcctctatttaaaatatgtttgcagctggcttatagcgtgctatttccactgacatctgtcgccacgaaaacgtggcccctccggcaaagtgacacgaaccaataaatgctaccatcgcatccttttcctccgtacccatcgcaagcaacgagccaaccggcaatgtagatattcaacgcacatcttcaagcccccaccacatcccaagcacgcgatgcgagatccacccactcccactgatatgtgggcccgcgcgttcaccgacaccccactcctcaccctcacgcaaagttcccacacaacaggggattaaataattgcaaatccgaataataaaagaaatataaaaaaattggaaaaagagaaatagaaaaggaagcgcaccaccgctctcggctcgccttcccttggttcccgcaccttctcctccgcatcgaggcaaatcaatcaatccaatccatcccacacaccgcccatctccctggcgggcagcctcggcctcgcgagggaggggaggaggaggagagtggcggcggcggcggcgcgccatggcgttcctgctcggcgccttcctcgggctggtgctcggcgtcgccgttgtcatggcgttcgcgcgcctcgagaacacccgcgctgagcagcgccgcgagctggtacgtacgtgtcgcgaaatgaaatcctcccaattcatttcctgttcgtgccggggtagcgcattgattcgacccagtccgatacccgccgcgggtgggtgtcggtagtgattgggagctggtactggtggtgaattgcgaatttgcgagaggtgttggttttcggagaggagcgtggagggggaagttgctggcggtgccaaactgtgagcagactggtttggaacgccgtatgccgccgtaattgctaggatttttatcctaatcttcctccttgccaccaactgtgtatgttatgcaatacgtgggccgtgggcatgatggaatcggcagtaatgatcattagagaatttattagatagtgcttaatatggcattataccgagtaatgattgtttgcaagatgtcgttgatcttgcttccgtgtgagttgaggtgattagttttgaccaggccacccgatcatgcgggtcaatttaattactgtgatttgatattgttttagtttggtttatctgagtggagaaaggacatgatgcttaattttggaaaattattgtgtaggccaccccggattttcctaatatcatccgccatgtggcatactcaaacttgcccctttagtttgttttgggttagtttattattgaaacagttcatttgaaagtagtaagattgaaatctcatgagtaaaatgaccactgagtaagtatcacaacttataatagtcaaacacaccatcttcaaaggctgacatgttggttctgtttctcaacttcttactattctagtatttttatagagtagtttctcaatggtagtgtatctcagtgaacctcctcaattgtgctgtacatggataacaatgctgcatattgtgtgtcagtgttcaccaacctagatagttctttaaagctcaatcctcgttggtgccttcatagccatatgttctgttgcaattgcaaaacaatggaataaacctgtaattggtttaattcttatgagttctgaacctctgcaattattcatttctgaagttgctattgctatgatcaacatgcactaatagtatgtacagataaaccaggaaattaaatcatctgaatttttttaatgtatctgtcatagtgagttttgacagtatcttctgatctatttagtgtagtatctgcatgagtatatgatttttctaactgataaggtcataaaatgtgcattattctaatcatatatagttcttggatggtacatccatatggttgtttgtcatttatttgcagataagtgtcatttttggctcatgcacacatattaggtgtacttctattaataaatgtccagttggcattgtggtggattatgatagtctgatttggttcaatggcttctagacattggtgtttgaaaaactgtttctatacattggtgtttggtaaccataatattattgcattttgaaaatttggaacatccaagagagacatgacagctagatcatatatttttgtctaaccttaatttaattcataaaaaagtctataatgaatataagctctaattttcacaaaatcttaaaaacaagcactgcacagaaaaaacaaactaagcataagtccttacattcacagttcgtaaagcccaactgggtgtcaccatggtgagatcacctgtcaactggttagcatggctggcttcatgaggttttgtctgagaattccatccattccacatatttctagtattgtcctatattaccatataattgccttacactaactgcaattaagaacttcaatcatcatccattagagatccaaaataaaatttgcggataatggtcgtacacccaaaatttctttatctcaccccttgcaaaaattacattgccagcactacaagccatagttccatcccatctcatttctgagcgacatgacttggtgacaccacctccccttatctgcaattgttgctgttctctctctttctaatgcatctccactatgtgaaatcattgatgtttcccttcctattcggcttcccacgtctctattcaatatcatgcttgagtttgtcacgtcttcttgaattcctgttggtttatcacgcataatggccatacatgtgtatctgtttgagttttcaccaaatatggcaaagtagcagccgcacgaggccactacgtggaggatccatcagcatttgctggctgtgcctccaactccaagggtgtcaacggatttcatcaacagcgggtataacttgcttagttgtttgcaatcttgaccagttcctctgactagaagctgccacatggcccacatcattgagtgctccatctccatcttcctcaattcaacaaaatacagaaatgatcttacctactataattgttctctgttgcaccaatttgctcagatcaatcattacaataaatttttggcagcattgcatccgttttccactggtttttaaaatattacattgtccttaaaacatcttataagttataagcaattggttttccatgccacggaaattgtcatttgatgtaatactattttaatatcttctttcatttgtcattagatgcattttctatcatgcttctgcta

SEQ ID NO: 49804 - DNA, 23471 bp, Oryza sativa
ctccgtttatctgttttatattatataagtcgttttaactttttttcttctagttaaacctttttaatagtcaaacttctttaagatgtttttctgaacatagaaagttacaaatggcatgattcaattaacctttttttatcccctcatttcattgctctgctaccttcccaatacttctatttttttttctattttttattgtttgtttgactagattgctttgactatcatatgaaagtatctgcatatgcatgggaccttctcatctagaattctcctgacatgtgattggtatacacgcaaatgatccaacggtctatatttattcctactctcatcctaaggccattagtattccagatgacatggctcatcattttttgagacagcttgttgctttcacatatgtagatgggacgagttggtttttatctttctttccaatgttaaatttatgggcgagttggtttaataagacctttttagttgataaaagtaaaaataaagagttatgaagttgtagtatttttttaagaactttcaattttgaactaattcatagcaaagattaagatatgatattttacggatttcctatgctatgcatatttctgtttgttacactattcttattattatgtaagctcacttaacttgagcatcacgtttgtaatgttagatttaattgggtaattgatccatttaaataaattaaatcaaataaattccaaggctcattatgctaggaattcatgtgtattcattctcttatgggatatcaatgggatgaagagttttgagaattaatccatttgattagtgaattggtaacctacatcaattactcctaattaatggttggttgatggatgtgtagtggaggatggttgatggctagttgatgagaattagttactctattgctcttcctattccataactcttactcttcatcttccgttcctcctataaaatgagaatggatttgatctcccgcgtgagagaagagatatactttcatccatttctaaggctgttgctgctacggtaatcccatcccgacgagtgtgtacacacgcgttgggagagtaggcctccgaaactacgcactgctgtgatgtttgcacggacgggagggcgatcaggtttttggggagcgtaaggcgcgactactcactgttcgtcaacgtctacatcgtcttcaccaacatgtcgaacactggagacaacagcaacactggagacaaggagaaggaggttcccgtcaacaccaacggaggaaatatttcctcaaactccagcggagggccatttttagggtataaccttcttacattagaagttttactgttaatgttcatcgcaatgtcaacattacgttattatatgattgttaatgcttattctacgttaagcatgctatgttgattacattcacaactatcactggatcaaatcccattgtaaatatcatgtttattatcttgttattttggattaaaatataccgaattatgaccaaatttccaacatgtaattccaagtcatctatttaaatccaatagttgagtttttttctatatcgatcatcatttcaaaatagggtgaatataaatttcatttttggagtagaagcaaggaagaggtggaatattacaaagagaaagggtaccttataaaaaacaaaaacaagttcttgaaattggaatctattttttttaaaaccacccataagctcccttatatatttagagtgatccctatacttaatgattcacgcagtagatattgactaccgaagcaaaaaccctaccagggacaaaatctttgattagaaaaaaattgttatcaatatggatgatactataaatgagaattttcataatttaactgagccaggccaccaggaccatgttagagaaaaaataacggttatggaatgcacataggataaaatatactctattcgttccaaaatgtagcaatctaggatgagattagacccatcctaatactaatttcatcctagattactacatattagaatggaggtagtaaaggagcttgaattgaattgtgatgatacagaaacccacaattgtacttatcattgagtagtactccctcggttccaaaatagccattgacttttacacggtcttcaacatatagaacttcgaacaccaatcttattcatattactacatctacttttgatatgtatatttcgaaatctgaaaaatttatttttgataggcatatttcaatccaacaacctatcttcgtaatgaatttctcggacttaatgcgtgactctccattctttcacatgagattggctacatgggtatagagaaatgtaaatattaatgaattgcttgtttgcgaggaataactagtagcatgtttaaatggatgataagtagaattacttatctttgatctgtgtgccaagatgaaatatgactatcaaaagtagatggagggagtatattataaagggttaattggatccatgtcattgcaaaaatgccaatttcagataaatttcactattattcacgatatcgtatacatgccactggaatttagggaaattggaactatgccactccgtcacgatatctatcaaaaatcttgttagcctcaactgcacatgggacataacaaacatgttctatcttcttcacctccctcccctctcttctcttttcccaccctctctgaagtctctctttctctggcactcatcatcctccaccaccgtcaccgtcaccgccaccatcgtcgaccaccttcatggctccatggcatcatcctccaccaccgtcgccactaccgttatcaaccacctccacggctggagggctcgggagccattgccgtcaccgtctcaccgaccccaccgttgtcgtcaccgccactatctttgacctcctccatccacggcaggaggctcgggaaccactgttgttgtcgttgttttctttaacctcctatccatagcgcgagagctcgggagccaccatcgtcgacctgctcccatcctcgtcgggagggctcgagagtcactactgtcctccgccatcgtcgctgccgtcttcgacttcctcccatccacgccagagaccttgggagccaccgtcgtcgacgccaccgtctttgacctcctcccatccacgatgggaggcctcgggagccagcaccgtcgctcgtcgacctcctcccatcctcggcgggagggcacaggagcccgctgttgtcatcttcaacctcctcccatctgcattgggggggggggggctcaggatccactgacctcctcccatcgacagcaatttgccgttgcaccggccatgcgcgccgcaccattagcctccctcgttggtgccctcctcaccggcagccacatttgaaaacaagatgagagatgggaaagaaagaagagggaggatgaaggaagaagatggaactgacatgtgggtcctacgtttaggggtattttggtcaatatgatgacaaaaaaagtggtgatgatggcataattttaattttgtgcatattcggatggcacgactacgaatagatgaattacagtgacatttaactaaatcggtatatttgcaatgacatagttccaattaaacctattattaataactagaaaataatcatcatatgaaactactttcaaatacggatataataatatcacacgtatagcactaatcacatatagtgttactttaatttattagttacagattgtaaaagttgattttaggacggagatggaggggagtatatactgatttattttgatcgcaaattacgtcttgccttcagctatgccactgcagctagcccacggtatcggacggatccggtaaggttgccttgcctctcctcagcaccgacctggcggcccatttgttgccattgactagcgttcacccggccctggatccccctctcccatctcccatctcaccacctcggccgccgccgccgccgccgccgccgccatcgccgcagcgatctgtcacaatcaccaccgccaccggcaatgcccaccgcgtcataggtcgaggcgcgccatgcccccgccgaccccgctggcccgcctcctcgcggccatctccgccgccgcctcctcgcccgccgacctccgccgcctctcccaccgcgtcctgtccccctccgcgcctcttccccctctccgctgcctcaacaccctcctcatggccctcgcacgccaccgtatgttcccggacatggagtccctcgcctcccgcatgcccgcccgcaacctccgcacgtacaccaccctcatcaacgcctactgcctcgccggcgacatccccgccgcgaagcagcatctcacctccctcctccacgcgggactcgcgccggactcgtacgcgtacacctctttcgtccttggatattgccgcgcagggatgctgacgcacgcctgccgggtgttcgtgctaatgccgctccggggatgcctgcggacagcgttcacgtacacggcgctgctccatgggctgcttggcgcagggatggttcgtgaggctatggcagtgttcgttgggatgagggcggacagctgtgctccggatacccatgtgtacgcgacgatggtgcacgggctgtgtgaggctggacgaactgaggaggctgaggtgctgcttgaagaggcaatgtctaacggatttgagccaaatattgttgtctacaatgcgctgattgatggctactgcaatgctggagaaatggaacatgcacttaaggtcttcgagggcatggatggcaaccggtgctccccaaatgtgcgaacatacaccgagctgatacatgggttgtgcaaatcagggaaggtggaaagggccatggtgctgttcagtcggatggttgaggcaggtttggagcccaatgtagtgacatacacagctttaattcaggggcagtgcaatgagggtcacctgcaatgtgcttttaggcttcttcatttgatggagactaatgggctggttccaaacgactggactttctcggtgttaattgatgctctctgcaagcgtgagaaggttgaggaggcccagttgtttcttgggtctcttgtcaagaagggagttaaggtgaatgaggttgtttacactagcttgatagatggattgtgcaagacaggaaagattgatgctgctgatgaattgatgcagaaaatgatctcagaggggtttgtgccagatgcccactcatacagttcacttattgatggattatgcaggcaaaagaagttgtcgcaagcaacattgatgttggaagatatgatggagaagggaatacaggcaagtcctgtaacatataccattataattgatgaattagtcagggaggtaggatcagaaggtccaaagaaaatattcgacaagatgatcgcgacaggtatcaatcctgatattgtaacgtacacagtatttgtccgctcctactgtgaagaggggagaatggaagatgctgaatccatgatagttcaaatggttgatcgtggtgttttccctaacctagtcacgtataacactttgattagagggtatgcaaatctaggactagtcagtcaagcattttcaacttttgaagtaatggttggtaaggggtggaaaccaaacgaggactcctacacagttcttctcagacttgtggtaaagaaaagttcctctgataactctgttgatatatggaaaatagcagacatgaaagatctccaggtacttttggaggacatcactgagcgtcagttgccactagccgccgatatttacagttgtttcattagatgtttatgccgagttgacagattggaggaagcaaaacatttttttatggggatgcagaatgctaacttgacccctagcgaggatgtatatacttcgataatagactgctgttgcagattaaaaatactaacagatgctttgacattgcttgattcaatgacgaaaagtggttatttgccacatttagaatcttatagaattataatttcttctctttgtgagggaggaaactttcgcactgctaaggaagtttttggtgatttgttactgaaggaatccaattatgatgagattgtatggaaaattctgatttatggcctattacagaagggcagtgttgctgagttctcaagtctgctctccgtcatgaaggaacatggttaccaacctagtaacacaattaatgccatgattacaggtgaaataacagttacaaatgaagttcaggaaatcgctagataaatttggagaaactaaccaactgttgtgttgatggtctacagcagaaggtatgcatcttgatttcattttccgtccagttttattttggtaaatatgttcaagttatactgcggtaaagtacagtccatctgtaacaatataaaatgtaagaactatatcgttggtgatcaaatagttatttactaatttgagagaaaagtcaacacgaccatttgctttatctaaacaggatttctctgtctcccccccaccccccaaaaaaaataattattctaagttaagtatagcttttttacatgtatctatgttttgttgaaaaataagaactccaattaattggcaaaattggttctgtagcatcgaaagtgtccactttcagttttatagcactgaaaagttcacggttcattttagggcctgtttggtagagctccaactcctaaatttagctccaggagttgggtctagagtgaagttgtggagctgcctaaacccagttccacctctctagttcattttgtgagagagctctacctagctccgctcccatttcaggtggagctgaaactgtttggctgagctccagctctaagagaggtggagctggagctgtgccaaacaggcccttaatagcatcgaaagtttatctccgttactcccactcctttagaactgctgccacttattcctcttgcccttatgttttcttcctcctccacacaccctcttcctaccgttccttttgcacaagaaatcaccatggtacagtggcaggcgggctggagggtgacatggtgaacgatctcggcagcaactgtggtggcagctgacgtgctcgattgtgactggggagtgaactcgagggcagctgcaagaacaatctggagggcagcagcagtggtgtttgatctctgggagagagggatggagccgtggaggcaagatggcctgtagctcgagcacagagcttctgttggcttgagcgtggttgagctgccaagatgttggccttcctcgagcactaagcacctagtgtggaggaaaaacgcggcgcttccgaccatggccgattcgagtgctctagtgagaaaaaaaatcgaattttttaattttgaggggcaatgttcatgaggatgagaggatgccaattgttaaaacaattttgtattggttgaggccttgaggggagatcgagtgagttggaccaggatgtccagatccttctgttcttttctccccatcaaaaatgaaactcagattgttccgcttgttgtgtgggcaggtgtgcaactcaacattgttgcctttctgtgcacagtgaagcaacagatcctcatggactacttccatttgtggcatcagcatcgggctcagtcgagccaggcgcagtaccgtcattcgagcttgagaacacgtggacatgcgagtggtcaagctcatgggcatgctgacggccatcaagctcgagcctcgaggacggtgtccggctagcattcgagcttgagaaaggagagggggctggaggaggaagaaggaggaaaaggcacggctggtatttcacatgttgtttttcgaaagataaaatgaataccaaagaaaattgaacagaactttgtacggaatgctgaatatgagagcaggttaactttcgatgctattaagtgaaacgcgaactttcggtgctataaaactaaaaactggaacttttgatgctgcagaaccaatttttccttaattaatactcgtatctgattagtactaggcttaatagtcatttgtaattatatctttattttttatatttctacctaattagcatccagtcattgtagttcattctacaccctggaaagggcaaaatttgacattcttattcctacaggcgttcagtatgaaatggcaactaactataactggcacttgctcttgcagttggttatgtgtcaatccactgaagcaagcgggctatttgagaagatagggtagctatactttcagtggctccagaaactgctagacttggatatgtgaaattaacatccattacgaatgatctgatcccggagctagcattctagttaaattgctgtgactggccaaataacgatcggtacatactcaattctattgagaactcaacttcatcaaaatttggtggaagagctagagcaattttcagtcagtttgcacacgccaaggtagctgtgatcacagggactaagaaggtatctttgaaattatcatacattctatgttatgttttattcccaaattgttgattgctcatgttacatttgtgatgcacgttttgtccgattatcttattcttatcacccatttcttcttgattaagattagtcacacttaatttaattaagtaggctgatattgtcatgtggggccagcactatatctgttggcaccacagccagttcaaccatggtgcagctgcagaaacaggggtgcactcagcccccttggtatccttatcagattagaatctatctgttaaagagtttcttggttacatttacctttgttgagatattagttaggatatattagaacacacatagagttattttaggagatgttagctatatatgttagggcctctcctatataaaggacttggcacatatacctggacttaatcagatagaaaacagaaaacccaaatacctctcgttctccttggcgcatcacggcgccatggcgataggactctttctcttgacctcccacatcccacgacaacttcctcctcccctctaatccccaaacacatgagccgctgactgatatgacattgtgtatcacctgtgtactaaattgtttatctttctcctttttcttttcctccattatctttatttttcaggatcaatttccaggtcaaaagagatatccatatacattatatatccagaagttgaagtgtaattgcttgtgaaaatggttcgcaggagactggaacatgatgaaattactagattctacttttgttatggtgaagaacatatacatagaatgatggctgagtatgttctgagaaggtcactccaaaaataactggatgtaagttccatttgctgattttgtcttaagtagatcacctcttctttttttttattatttatttcagtttaattgattttacttttttttttcattcagcagatagatgaggtgatcgactccttaaaaatgctacagatgtttttcatggtccatgcactgactaagcttcgtttattttcaaggtaggctgggcagtaccttaaatattagaatggtgattattctatccatactttaattttaggctttagggtgcaataccatgatcaaaatttacaattatcataattcatctctgcgttattatggttgctcattatgttttctattaatactctcctagttttggaacctctgataaaaatcaaaactactccaaagatgaaaatactactatgaaggttgactttctgtgagaactaccgttcatagtgattgtgcatttacccagtccagatggagcgattggtgctgtttaaaatgttggtcaaaacaatccaatgtacatacaaaatggtcagatttctatgaaaatatagttgtcataggcgttgggcagagaggccgaggcccacgaggccaagtcctagcggataaacagtaccacgagtactgtagcagttggttaggacataggataggattagatagagttagtttgagttagtttcttaagggtcaagtcatatcatctctatataagggatggattgtattcatctctagttaagcaatgaatatcaattagtctaatctctccctcccaataatattcttctccctagcctaaatctacatcccttctccaggagccgacgccgcccggctatcttcccggcggtgtttatcccgtcatggccttgggtcatgacaatagtttggtgtctttttaaagaaagatacaatattgcccttaatgaactttcagtgagcagctccaggagtccgaatcaaaggccttgttgatccccagcgccccatacaaagaggactttcctaacagttgtatataagatcagtccaaataataacactgaacaacttagtaataaaaaacttccctagggaattattgatgctgtcatgctgcagaaccatgttgtacactactctgagcataggtttcccttgatatatcgcacatgagagtcagattgacaaaccaagtcattccctggtcttgtaatctctcaaaattcttttttgcgcaatagtgcatcactgtgtcatacatttttctgatagcacctactccctccatcccaaaaagcattaacctaggaggggatgtgacccctcctaggttgattctttttgggacagagggagtagataggtaaataggtgcagatccttcataaaaaggtgaaatctacaggagagcaattgattgcatcataattgaccaatccagtggttgattgagatactttcattaacttagataattattttttattttgtttgatgcctgttttggtttattttagcttgttcatcaaattgaccaatgcttgctctcatccattatgccacttgtatgacagacatgttggtgagttgtcttgtcagtgaaacaagagatttgcaaatatgcagtggcaacataaggcatttatccgatggggttgagatggaccctatcaggatttgtcaacagaaatttcttcctagttcacctagcaaaggctaacagggttactaatcccaggagttatggcattttgtgttcttttggatcctcattgcatttgtatgtaggttgaaaattttataatttttttttctaagaagagaggtaaaattcaacgtaatgcaaaaggagtaatgtctcttggtctgggtctgagtattatgtctaaatctggggttgaaatgtggcttgggcactgacacactgaaatgcaaaaggagatgagaactgagaagttctcccattcaagctgctggttcagctgactccggcacatgccatggtcatggagcccaatcatatcagaaacactgagtcttaataggtgttcagaacaaatgtccgtgtgtcatgattttttcacaattaggtcactgtcattgtgacaatggtagaagtaaatttagtgaaggtgcaagtgagacgattgtgactaatattgtgatgaaaacatgttctatctatgttactatgtgagtggtggtttacatctgtatctccatgggcaataccacgttggattttgtaccttggatggtacatttaacaattttaggggtattaactttgcattttccaagttaatggacctagattacacccatgcacaaggaccgctagtgtatttttactctagttatgattgagcctgtaaagaattcaatttcagtacattttggtgctcaaaagatattattatattaaatacattatgaattcctgatattgtataatggataaatagacggtatgattttaagtcaccccatgccccactgaaagatagctagagccgaaggtggcagaacttcatttgcatgaactgctctgttgtatcagtggcttagtgctgatcctactttgctgagttcggtaggacttgttgggaacaaatctcctccgcacagaaaacggagcagtccattagcgcgtgattaattaagtattaacttttttttttcaaaaatagatcaatatgattattttaagcaacttttgtatagaaacattttgcaaaaaacacgccatttaacagtttgaaaaaacgtgcatgcggaacatgagggaggggagttggaaaaacatactgccgaacacagccagtatatggcagtcctaggagcaactgtttgtttggtatatgctaaatcatagagttgtattaattgattactaggagaagaggatccaaaataggcaaagtactgtcagacattttcacttgtctttcacaactaccttgtccagggaattatgtgtttcacttttaataaatataattttccaaaatggcatcagaatttagtaccaccaataccatcttttcgttcattggaaagcctcatactagtacttgttagtctgtatttattcttttttgtttatgaccactgtaggggttatatgagcatgttttatctttcgcttgtgcagagtttcaagatatgtcatgaaaggcagcatgatggaatattggcccccattttgcagaacttgggcgaggttcttggaaagttctgaacctttgcctatatgaactctggggaagttagtattaagctctatatagtaaatgatattcacagcattcaacttgtgttaatagtttgcaggcgtggaatattctttttgaccggaacatggactaattatttgacaattgtatatagagattcaatcaatacattcttgacagaaataaatgcagatagtggatcataccagtttgaataacctagtcgatttgaaaatgcatgatacaataatattttgcatgtcataccgtcaggaatgctatgagaaatccacttcctgcaaaattcttatgaaattgggagaatagctattatggtccctgaagttttgctccgagaatattttagtccccgacctttcaaattgtccaagcaagccaaactttatcatgtggacatatacagtccttggctcttcaaaaattgccatgtgggcatgccatgtcatctttcgatgcaaatatatgatgaaatgcccaattttcccttaaacatatcatatggaaaaacagagaaaaaaaaggagaaaatacaaaaaaaaaaggtgatcttgcatattaaatatccgttagagttttaacattgtaatgcaactacgtacatggaatttagttggcatggtaattatatatttagtggttgtagctaacttaactttgtagtagtataatccagtgaaaaaagttagccacatatccatagtcacattgaacaaagtttttaaattcttttcattatttttgtatggtatatggaagggtaaattggacatttcaccatatattttgcatgagaggatattcacgtggcaatttaagtgggcccaaggactatattagcccacgtgacaaattataaggctcgtttggacaatataaaagattagggaccaaattgatctcggagcaaaacttcaaggagtatatgcacgaccctaaactccatatatcagtattcgtcgccacctttagggtttaggttttgcttagattaatatgtcaagaatagtttcgccgatccttcggtttgtaagtccccaacttgtgagcttaatcattcatctgcaactttggttgcattctttatcgctcttgtttgtgttcttcgatttgcaagcagggattaaccttttcggcgaggtcagccaggtttcgacacagttgataaccagaggagacgtggtgttgcgattgcggggctcaatagcgtgtttgttcagaagccagatcgacttgtgttgcgacttcaccaaatcaactgtttatcagaacctttcagaagatcagaaacccttgtcgacatcatccacatcctcgagctagcccggatagcggcctcaatgaaccacaccccaccaccaccaccaccgcaatccaccaacagctcgccggaatccatggagactgcaagcctcccggccgtcttcgccacgcgttgcgcctccagcatgctctcggtgtgttcctaacttagggccatcaccacggcttcgccaccctgtcctagaactcggggaggaggccgtcgatgaacgtagacttgaggaacaagtcagggacgtccgcgcagctgccgccagggaactgtcgaggacgtccgtgtcgcatgcagcctccattgcgccgccccgtcgctagctacctgggaaagctccgcccgcctccgtcgccggctgcctgagcgcgcgcgcaagaaaaagaagtagtggactggggaggtgttgggctgagggagatggatgacagctaggcctagggaggtttttaaatttttttctgactgaactgccatgttgggagtattagtccggtataaatagttgcgggtgtaaaatatctggtatatgaatttaaaggggtaattctgttgaccgtgatagtttaaggggtaattcgtattttttcttttttttaagcattattaagaacaaacccgcgggtatactagcttcttgcgttataaattcgtatctccttcggttttctttcattaacaccatcaaaatcaaatgtggcatcacacgtggggcccaaattaaaatgggaagacaaaataagttcaactaaaaccacataacctcgagtccgtgcaactactatatttgcgattaggggtgaaaacggtacggaaacggacggaaacaacctttatcgttttcgtttccatatttttttcgtaatcggaaaccccggaaacgaaaacggaagaatgttatcgaaaccaaaaatggagcgaaaacgaaccggcgcagatacggtaaagaaaatttatcggaatacaaaaacccctcaaactgagcttcaaacttttgtcaagatcaattctcaagccttaggagtcaacaattcatcataaaacacaattatatgaagtctaattgttaagtctcaacagcaaaatatattcttctataacttgataacttcatataatttgcataacaaatattctaaaaaaatttcagcagaacaccatggtataaggtataaagtatacactgttagcccgtagcccgcagcctctctctccctccatgggccggcttccccttcccctcctccctcttcgggccgccggctcagcccttttgctcctccctcgccgagaagtctattttgcctcctcctgaattcaaatattttttagggtagtaaatgatttcaaatgaaaaaattatcaataacaaagttgtataacttatcaagatcaacaacttttgttttggtcattttgctatatgactttgtttcaataatttgaatttgaatttcaaattatgacaacttcagacaatattttcaagtactaaatgatttcaactgaaaaagttatcaacaataaagatgtataactcatcaatatctataacttttattttgtttatttcttcatccgacaaagtgatagtaacattgttcacaaaatttacatatatctcctatagtttataaactatataagagaatatacattttgtaaacaatcttataaatcactttatcggatgaagaaatgacccaaataaaagttatggatcttgatgagttataccactttgttattgatgactttttcagttgaaatcatttagtacttgaaaatgttgtttgaagttatcataatttgaaattcaaattcaaattgttcaaacaaagtcatatagaaaaatgaccaatactaaagttatatatcttgatgagttatataactttgttgttgacaactttcccatttgaaatcatttactacccgaaaaattatttgaatttcttatattttaaaattcaaattttatatagtccaatcaaactcggatggagaaatgaccaaaagaaaattggtagatcttaacgagttctacaactttatttttgacaactttttcacacaagtttatttaatatcataaaattcgattcaaagttttaatattttgaaattaattgtttttccctcctcctcccttcaaattttttcatctcctcttctctctccctatcctgatatttttacctctactcactctctctctttctatcatctcccctcactctctttctttccttaactctctttctctcctctccattcctcctaggacggcggtgacgggagctggcggcggtggcagcggcacggctcggctgccttgggctccggcctggagctggcggtggtaggggcggctcggcctggagctagcggcagcgggggcggcgacctcggtcaaagagtgggcggcgacctcgggcggcggcaccgccatctcctcctcaccgccgccgccgacgaggaggaggaggcgacgggccagatccggcggcgacggttctcgtcccgcccggatccagcggcggcgggcctcgtcctgcccgaatccgacgggtctcgtcgggcggcggcgccaccaccatctcctcctcacctccgccgtcgatgacaacgaggaggtggggggcaggtggcggcaagagcggccggcgagctcgggcgacggctagggtttctttttttgaattctttttggaattttatttttttttcacgatttagtgtgtggccgtcatcgacggtgtggccagtggctggcgtcgtccgtgttgtctgtggtggcggcggcggcgaagatgtaacatcccaggttttagctatagttttagtcacgctaatgacttgatcacactggctgagagtggtgttgattgggccacgatgctggctaggacatataaatatgttgattgttgttctattatggatcttaaatgatttttcgatcgtttccttgtcatttatttatcaagtcatatccatatgcattattgatttatttttagttagagtaaacctggtgaggagtgggataatttagttttgggttaaactatagcgtggattagtcatcacaaagcaaggtacacgtgcacagtagaaatcacaactgaaactatagtaaattattcacaaactatctggttatcggttgcatgcatgcgatacatacatacataatatatatatccatgcatacacatatccattatagatattgtacatatgcatcttatacattgtatttatatacaacattaatgtataaactcacacgccatgcatacaagttaaaatacaaaattaaatgtattagaaaatgtttgtgtgatttatgatcgcaaatttaaatttaggaggtttgcattctagaaagtcgaaatagtaacaataaacgaatatttttgagttgctacaatttataattttgcatccaactatttagggacacaaaaatctacaaactgagccatctcaagccaacttccaaaattatccatttttgcatacaactccctgagttctagggcaattattaatcagtcccttaactctggagtaacctccaaaattccaaaagcttatggactggaatgcaaaattactaagtatcccaatttcaccagatttccattaaattgtaaattagtgagcctctcaaaattattccaccgaacatgccctggtgaggtttcaaagctagcagcagccatgtggtccaagcaggtgaatcaccagcaccaaatgcactgagataaagcataacaatgtgaattatccacagtctggtagagccagccttggttgcaacgatagacacctagctacagctagcaactcccagtagtacagcagccatagtagtagtaagatcccagcaacagcaagcagcctcggctggaaatcagtggagattgggagaaagagaaataatcacagctagtagatcagtagttcaacatctcaaccatgcttcaccacagccgtagcagccttgtgtgtgcagccaggagaggctagagtgagtgaatgagaggtcagaggagtagtaggagaagcaagaaggagcagcaatcaagcaagaggatcaacaccaggaaaagcaagggaagtagcagatccagatatcaatcaagattttcacatatcttaccatgtaaaccaaagcagcaagaagatgctgaagtgagacagcagagagaccaacctgaagaaggagcaagtggtgttctagcagagttaccattgatccagaagagcagcagtagaagagaagacttgggtttctgaaggaggggctgaaccacacatttttcaatcactgtagaatcatcagaggtaaccaaaaattaaaataggggaggagagtagatcctgcatacatagtatcagcatttgttagaactagagtttcatgcagatatataccatccatcctgaccaaaaaccttagtaattctaaatggttaaaagtaacaaaatttggggataaagttaaagataagtgcatgtttttaaatcctgacatatataaattatcatagaagaaatctgaatagtaacaataaatgcctgtagatataattcttgaataaaatcaactggtgttcatgacataaattatttaggaatagagcatatatagaagaaccaaatcatgcatgtgaacttataagctttcagatcctagtcatgtaaacagggcataacattgacatgtgcatatacagatatagaagatgagtagtgtgttccagtaaaaagaatcaaattgggatgacaagattaatgagtagaaaaccatagatttctacagtagatagtctatagcaactgtttagatttagaacatagcatctggataagttgcatatatctaattagttagaccaatagtttaattactgtcctcatcaaccattgtaataaagtaaattataaattgggttattaactactacagcatatggagatgataaacagaacacaagaggcagtagcagtagatcatatagaggacaaaattgccatctatttgtattcatgataatgttcataggtgataatttaattagttatagtacagattttctcatgatattccaagtgtagaatcatgtaattttcagcatcattcaacaaagtttattctaggatctaattctgttactatgtcacaaatttctggaattgagttatttcatcatgcaagtatatatataaggacagaattatgctaatgtgctttctatttcagtaataaaattcataggtttattcatgtgagcattcatacatcatgggcatacaggcatcatccaatctagcaaatccaatgacctagaaccctagagtcagtaatgacaatccatatcatagagttatcgagttgaccattaggattaatttacaagcatctttagtacacccacaatcatatatcagtagtacaaaagggaataacaccttaccaatataaacactagaaattagagggggagaggaagaagtagagacccgagagcacactcatggggatagaacagggccgccggagttgcgcagtgcttggcaccggccatctccacggcagcagcggctattggagaggcgagggatagttagggtttgaacagggaaagagaggaaggaaggaagggggggagaggaggaagcggcggcgatgcgccctgggagcgcagcgctcgtgcgccagggagagaagagagcgagaaagagaaaggggaaaacgggaggaaggaagagaacgagaaaaagagagaagaggaagaagatgggttaggtgggttgtgttgttgtgggctttagtagttgggctaatagaatttagaggtagagttagaaaataaagaaaattagtatatgacatttaaactctttaaattcaaatttaggtcttgcatattctaatgtattattgcagctactattttaattcactccatatgatttttaaattaaattaaagtgtgtcttttttgaagtagatatatgtacaaccaaatctttcatattagaaatctaaataaaagtattccttgaaatatatcttataaactatttttctaagaaaacaaatatatttatttctatgaaagcaatatatatcttggggttgttgaataaaatctgtacagtgaatcaaatttcttctaaataaaataattactctttcttaaaataaaagtttaacaaaagcaagtccataacctatatagatcatgtatgtgcattcgggttagacatatcatgtgcatctcattcatacaaacattctcgtatttagttgtgttttattgtttctttcagttggatgtttatctcggatttcttggagttctacattggtttattcgttcttcgatttcgggtatcttaggcaagtccaacatctttgatcatctcttgttatatttttgtgattgcaatctatatgtatcacattgcattaaattatactttctatgattaaaataaatatgctgatggattggattgactggtggagcagtcggtcatactatagatgtattctgaacttgccatgtggtgggggttcagttgcatatatttatcatcatcataaggttaaacaacaactattatatggcatttaagcgccgtagcgatcgtgtcgaccatatgacctagaatgggacaggctggcttagtagttctttcttaatggctttatcctgtggcttaaggacttccacgaatcccgtgagcgtgggctagcgatgagggttgccgttgttgcagaatccgattagatgatgtggatcgccgttgttgcgggatccgatgattcgccgttgttgcgggaatcacctgcaaagataattgccagatgggattgatgaaaagcttgtgaccttagccttgccggcatacaccatgaagtgtgcttaggcgctggcgtggtggcggtgtagcgcgggcgttaaaaggtttaaggcgtctatgggacagcgacacacctctgcagagtgtatgaattgtgatacgtcactacctgtttcaggtagaaactgcgaacgcggcaggaaaggaacctatcggaggttctaatacctatggtgccttatatgcagtagattttatagttacttaatatgagattttactacactgttttatgaacatgcataaaactaaactccttgttggattatgggatttggagatatatatgtattatgcaggtggattatgggcatatatttgttggattgctatagatggacttgttgagtaccattcgtacttatcccctatatattatttcttgtagtgttgagctaacaattaggtgaagagaagattctacaaaattgatcaagtgttgcatatctctacatcaatttactgttgaaggtgatgaagatctataagagcaaggtactgttagtattagtattttgataaaaagctaatttcttatggttttttatttattaggtttcgctacaattgtttctactatgctactttggtgtgctcagttcttggtaagttggttcttactaaggaatgagccatagaccggtattctacctcggaagtggaatacgagggtcgctacagaaaatggtgggggcgaggacggagcgagagaggaatggcggcgagacgacgggggcgaggtcgcgaggagccgactagccgaggacggcggccaggcggccagcggtggcgcgctcgacccctggatgcgccgctccgccaccgcctctcaatctctggatgcgccgcctctctcgatctctctctcctctctagggttagccaattcgggacttagggacttgggttgggctgggaacttggggaggaattatggactatttggatgggcctttttaacttcggaaattccgacaaactttccggaatttttccgaccgattctgagttccgacggaaactgttattatcatattcgattccgtttccgaaaaaatatttccgttttcgattccgtttccgagaaattccgaaaaaattccgaccggctgattccgtttccaaaaacaggttcggaatccggaaaaattccgaaccgttttcacccctatttgcgatgaagtgaaaaagaactaaaatcacttcatagcatcacttattagtgtcgttaattcatgagccaatatgtccgtctttggaatctgatccaacaggttggcccactttccggccagtaggactccatcgtctagaagctaatagcaaatggcatctattctactagttcggcatacagaccgcaatttcatggagcagctagtactattacaaccaaaccgtatggaaatgttgggccccacctaaatgcaaattcctctcgtggcttatcattcagaatagggtttggacagcggacagactgcagaaaagaggttgggctaatcagcatgtatgcccactctgtcgtactgtatcggagtcagcacttcgcctactcgcaagctgcaggctctccaaaagaatttgggctgaagcacaaaggtggactggtatagacctccgcctacaagaatgggggaatgcgcaatggttgaagactggtggtacaaaatttcacgcatggtgaactgcccaaggaaggcccttaaatcgataatcatcctggtagcgtgggaactctggtgtgagtgcaatgccagaattttcagacaagtggcatctacacctgccaccattatcgcaaaaatcaaagaggaggcgcgggcttggatcgtagcgggagcgactaagctaaccgagattattccagtgggagagtaggtctttaccttttgctttgggctcgagttcctcgggctttgtaaataacttttttaggtttgttctcctgctctatcaatatataagaggtaaagcttttgccctttcttcaaaatctttggccaacttcagtaggctctgtgttgaagagtgtgtcatggtaatggtaaagttatgggagcataattcttcactaggctttaaattaactgaaagagcccaacctatgccattgagttggtattgggtcaacaatattgctcatttctataatatgactagtttctgcaatataatattgagtcggatatttttcaaaactacccaagactccaagatattttatgtattcaagatttctttcatgtaatttacttttcttacttttaagaaataatatttttgtgtggcatatcagagagaaaaccatctacacaaaagataataagacaatagtaaaaatattttgtgcagcaactagtattggaaaaatgattcacataaaaatgacaacacaaaagtattgtatttaagacatacataaactctatgttgtataaggaggcttaaacactacaccagatcctcacatctctgacgggatacctgtgacgggcaatcaaaatggtcactgatgaccgttacctctgacgggtcatacgggatgccgtcatcggtgaggcatccggctgcgacccgtcagaggtaacgagc

SEQ ID NO: 49805 - DNA, 4782 bp, Oryza sativa
  unsure (1)..(4782): unsure at all n locations
cctgcagccccctcaaacggcttttaagtcccagcccgtttgagatgacttctgccactgtatatatatgtctcctctcccagcgaggcccacatgaggagataaggccggccggctccctcttctccacttctcatctatctcttccacttattctctctatctctcctctctttctctgtgccatggcgaggggaggcgcggcggcgccgggccggctagggcggcggcggcccggccgccagatccggcagggatccggcaggggcgggtggggaggtgcggcggcgccgagccggcgggggcggcggcggcggcccggccgccagattcggtaggggccggaggggaggcgtggcggcgccaagccggtgggggtggcagcggcggcccggccgctagatccggcaggggcgggtggggaggcgcggcggcggtccggccgccagatccggcagagacgaggggaggcgcggtggcggacaacggatctggagccgtggcgcggtggcggccgacggcgggaggggaggcggccgaggcccgacggcagcagcggtctccacctccgccgcctctgccggggacgcctccagccgcgcctccgcctccgccctctgccagcaagtcctctttcacccatgtattttatcttgtgttgttcatattgttccaattgttgctactgtgattgatgattctgagtcctatggtgattgagattcttatgattttgttttgtgattgggacaactgtgatggaacaaagaagaattgtgacgatttttttgatttgtgaatgccaaatgcaatcggtcgaaatgaatgtgatggtaacctaggaggacggtgtttctcttttttttcccctttttttcacaccagtgacggccccaattagttgggccatttgaggtgactctaacctgtgacgggttttggttgggaccagacagaggtaactctcacctgtgacgggttttagttggggccgtttgaggtggctcttacttctgacgggtcttcacccgtcaaaggtgactcaagtcatcagtgaccactaatctctgaccgggagctgaacccgtcaaagttgagggtttgagcccgtcagtgctgacctgatccagtgtagtgaaaaatcatgatgttttgaaacttctaataggataaatcgaaggtcttttttttgcattcttgaaaagttgtccacccggcttgtaaaagaattgataaactctatgccaaatcattgaatctatgcatacaaatagttctatacacaaagatgcactctcaataatagagaatttagtaaaggtcatgtatttatcattgtcctacgtttttttagtgtgtcctcattggtgcgtgagtgttacttgcgtgtaacatggtgtgcacgagttttccacttattttagatcaaattggcgcactttcactttttaacataagtcactaggactaccataatatattggaacatagatgcgtcatgcacattttaacatacgtgagttagcaacaacgatggtttattcaacaactcatgtatctttgaatatatacttgtcttaaaaaatattaaaccaagacactgtttgatttataaagccctttttaatttgtagagaaaacatagaaaatttaggattttaatcttatagaaagccatacaaaggcattaggaaaaaatattaaatcctatctatttcttagaaattcttatgaaatggacaatcttgtactctaacagaaaagttagcaaaagcttcgatcatcgtataaaatttcttgagcctatttttttcattgtttcttccgcgtttctcatgtggtttattcaaactaccgttcctttagttttctttgtttcgtgaatcttcagtttgtacttgtgctcgtatcaaaatcttgtattctttttctatttgtttttttttttttaatcctgtgttgccttaaaccccatttgggctgcaaagctttgttggttactttgaaatataaacatgtccttataaacttaattatcgtgaaattcattagttgtttgttcccatcggaggtcgatacagcgaaaaagaagggggagggctaatgggcgggtgatcgtccacagcaatcgcccccgtccctccctctaacacgcacgttactttctttccctactgcaccgtaaatttcccaaaaaaaactagttacaaaaaaataaaaaaaatagaaaaatctaatacccttaaaaatatattcatgtgcataaactttacacttataaatatataccgtaaacttcgtacgtataaacttttatgtatagaaatattctatatagaaaatatttaaatccaaatttaaatttgaatcgggtatataaacttttaacctataaattttaggtgcgtaaactttagatgcataaactttaggtacatcttatcttaactaattaaaagattcatattttccgatcgtcacctcgtccgtgcactttttcgtccgtcccccacccccaaaaaaaaaatcccagaacacaaatacgagtctgcatcaaatttggatccaaatcctagagaaaacacaactataagaacacaagaacaagaacaacattaacacaagaacacaagaagaaaaggggagggtgtgccaccgtcgcagggacgcatgaacgctggcccgccggcggcttccctcccactggatcctgtggaggggaggacgccgccgccgggccgccactgcctcccctccccttccgccatatccgggatgccggaactggcacaccgggttgccgccgcctcctctcctgctggatccgacggaggggagggcaccgccgccgccgtgacaccgggctgccaccgcctcccctcccctcctgttggatccgggacgtcgggtcgctgccgcctcccctcccactggatcagtggaggggagggcgccgcccgtgcccgccgcctcccctcccgccgtaagggagggcgccacccaccaccgtcaagcacctgcggggtcactggtagagggagggagagcggagaaggagagaatgagagaaggcgcgctggcggaggagatagactgagagaaagagagaaaggataagagcgagcggaagaaacgaggcatgtggtgggtggaagaaacgaggcgcgcgggtcccaccgctttctcgacggacgcagatgtaaaaatcacagtgtgactttcaggccatatccaccgtccgtctcatctgacggaggatatttcccgcatgtggttcctgccttcctggcctcattattatttgcttgctgattctaatcgaggattaatgaatctaattaaacaataactagtaatcatgcacgtgcaatgcacgttttccatgtcacatctaacatcaacgttacattttatggtctccatacatatgcaggatattcattttcatttagtgatgaaataaagttatccagcttcattttatttccattctaagtcgaaatgaaaaagaaaaatacaacatattattgcattcaactaataatacaactaacagtaaataaatcactaaaacaaagaagaaattaaacctcattttatttccatacaaaatgaagattaaaaagatattcactcattacaaccaaaacacaagtgcacatggaattctaatgcggcgatgaaattaaaaaaaaaaacaccctctaaggcatattacttttttcagcgaaaccaaggacaaatcaattcattctgtgtagagagacaaaaaaaaattgtatggatacatgcaaccaataagtaataagatggttgcccaggttctaggacatttaagtcttagatgtatgaagaatacaaatattcccatcctatttgaaaaaaaaaaatcagaaaacgaaatatggatggagggagtacgaccttacaaccgagtgaaatttgaatgagactaatgagtttcgaaactaatgagaatataaaattataaatcaatgattatttcatatgactccaaacaaaagttcatcaagatcactttaaattgatcaaatgctttgaattctttagtttgaactgaatgcttcttgaacttgaacgccaattcatataaatgggacccatgtcaaacatcaatttgaaaaatccataattaaggaacttacttagatatctacaaatgcttcttgaacttgaacgccaattcatataaatgggacccatgtcaaacatcaatttgaaaaatccataattaaggaacttacttagatatctacaaatattataacttacaaaggttgaaaatagttaggaacaggaaaaattgaaatatatagcaaccacatgcttcagacctatttagcaaaacaatatgctctagcatattccactttgaatgtcctgcttcacttgggctgcagagaagtgaaaaaagtatattaaaaactattaaaaggtggtttgaccataattaaacaaatcaaaaggctaaggcatggatcaacattaatccgttcatttgagtttagcttcagtggtgttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 49806 - DNA, 2178 bp, Oryza sativa
tagattaatcaggcttaaaaaatttgtctcgtgaattagcttttatttatgtaattagttttgtaagtagtctatatttaatactctaaattagtgtctaaagacagggactaaagtcaagtccctggatctaaacaccacctaagaaatctgtaactagaagttttatttgtgataccgtggaaatcataaacatttctattctaagagtattttccagctggtttccacatatatatatatatatggtttcacaacatgtttccccctttctctcccacgtgttttactcgccgcggccaccggcggcggcaccttggctgcttatgatttggtgagactcctgttgactattatatatagttggttcatttgaccacgtcatttccttgggtcatcagtcatcgccagcgttgtggaaattcgtcgtcacatggagcgcgagaacggtatacttttgttcggcagacgcacaagcacacgtacaaactacacatacgtaacatcgatcatacccacacctccgcgcacgtgtcctctaacatatcaatccaagaccggttaaaataacagggccatcttatctactagatacatctgacttgaaatattttctttctaaactaaccctacagacatatatatttagcagggcgtatccatggttggggcttgttggggcttaagccccagctctgcccgcacaacttatgagccattccaagctgcaataacgcaatactgaatactaagagccaatgagtatggaaaactttaaaagctgtgagtattaattgataagattgtttgttagcttgttaatcctatcacatgatcgatgagtagattctgagataatgttgccaattaataaacgttgagaataccaatttgttaattttggttgaatttttttaatgtttcaaaaactataaagtcattgataatttgggaatttggtcatacggttaaactattgacatggccatgggccacaccaacagttttgaatcataatttggttatacgattcatcttttctttgttttatttatgtaataattgattgagtttagagaaatgacaggcatatatatatacttggcaccaaaataatttacatatataagagcacacgcttaaatttcattctagatttaccactgatatttagtccagcttggtaacactaatcaggactaaagattattattgggggtctgacacgccatgacagcttttaaaccatggctaaaaataatctttaatcccggttggtgttatcaaccgggactaaagattataaagtatcattgggcttttgaaccgaggctaaagatattcttttgtctctcgaacagggataaatatgatttttttttcatccgagtaaagatcagttctgcagtagtatatggtctaaaagatggaaatcggtgatacatccctaatctcactaaaatcatgataaaagctcacgtgcatatgcgtaatatttataggcggtagcatttaaatcctggtgggtggagtcatgcaccgacatatgactccaccactgcactactggtgctttcccggagagagagcgatatacaatgatgtgatacaagagtaggtggcgtatgtgaagcggagagtgatcgatgaaacatttagcaagataaagatcacgatgagaaaataaaaaattcacttgattatataacatgatgtgtctaaagacctgacatgatttttatgtttgccggactggtgtttcattgctatggaataatttttttgtccattttaatttttaaattgcattggctcccattcctagctaagagttacttttctctccatttgaaacgtaagtcacacttccttaaggttatattcttttcttccactccaaactcaaactttacacacttttcaaacgttaaatgttgtgttttattttaaaaaagcttctatagaacttatttttaaaaaatcaaataaaatccatttttaagtttatgataatattaatgcttaataatcatgtactaataagttttctcgttttgtatgcgctgagaatatcactccaaaagcatggatcgaacgagttcgttggatcatattgaaatatatatataacatcaagttaatatcaccaaatccaccactgatcatctttcttaatcg

SEQ ID NO: 49807 - DNA, 921 bp, Oryza sativa
aggttggatctcctttgatgtggggcaaagaatcctaggatgtatgacccagcgatggagacgctcgaggtcatctatctcctctgtagccattcaggaagcccggagatcatccctacgtcgctctgccctattcatcttcatccttcctctatgaccttgaatcattgttggtggtgcattgtcgccaactcgttgtgtcaaagagaagttgaagaaaggtgtctctatgtgagagggaggaggaggaagatgaatggtaggacggttattttacactagatttatactataattatatttgatatatttttttacttaaaaatctattgtcatatttttagatagatcctttctaaataaaccaacaccgatgtcccagatattttttttataaacgaacactggtactttttttatggctttttaataaactgacactgatcaatagttacatgttataattttagccccacatggatgcttggaagagtgggaaatgtatattagatgagccgtacatgtgaggcgtaaccgctaaaaccaaaggagtaatgcttttactagagttaggcttagtttgaaaccgatgtttggatggaggttttcagcagatgcaaaatgagataagatattagggtatgattaattaaattttaattactataaaattgtaaatgaatttatttgattttttcgagcaatttttatatagaattttttcacacaaaatatactgttgaagtgttgagccgtttgaatatgctaacgaaaacaaacggaaatcttccccttcatcccaaatgaacggactctttgtttggtacggaggaaatggaaaagaaagtgcgttcactacgtacacatacatcgcactggcagcgaaaagtagaagtattgactagatcaaactacgagcaa

SEQ ID NO: 49808 - DNA, 15978 bp, Oryza sativa
  unsure (1)..(15978): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcttttttttgaacgaaccggcactaagcgtgccaatttcaagctttcatcagcttggagaacgagaactccatggttgacggttgcattgtgttttcttttgtatgtttttttgggtaggtttggatgagaaatgcgacgataggtcggagctcttggattcttcccctgccgtccgcaagagcttttcaggcacgtagtttgctgcgtgaacattgcatggttttctgatcattttggagaattcgtatgcaaacacattattacgctgaatacatgatgcagttaagttgatgaatttgtttttcttggtttcagatcggcattgcgccacaaaaattgagagcttgactctaagctgcttggattcaccccacaggcagttcgatacccgggaataccggtaattatttaaactgaatgttattttttttgaagagaaaaggaagttgtgatgaatttggaccctacctgacaattttgcagggtgttcgtaggcacatggaatgtggctgggaagcctcctaacagcagccttaacctggaggattttctacagatagaaggattacctgatatatatgtcttggggtacaaaaatacttcccattttttaatactctgcatcagttcatcatctgacgttgcattcttgagatagaaaaaaacatataaatttgctctatgtttgtgcatggacatgatgagttgaagataactttgcattcttagccgtaatgcagcatgctaacatgaatgccatctctgaagaaattgctgatcaattctgagacgttgcacaggtttcaggagatcgttcctctgaacgcaggcaacgtgctggtcatcgaggacaacgagccagcggccaagtggctgggcctcatataccaagctctgaacaagccccaggaccagtcctccggcgacgagctgtctccgccggagacctccgacagccggcagggcggcggcagcggcagccgcgactccatacccaagtcgtcgagcggcggcatgctcttcttccagaagccgtcgctgaagatgctgagcaagaactaccgcgtggacagcgcgctggtgaagacgtgcacctgcctgaccgacccgtccaccatgcagcgccgggcgcgggagatgcgggagttcctctaccgcatcgaggcgtcgccgccgccgtcgttggcgtcggcggcggcggcggccgacgaagacgggggcccggacgccggcggcgagctggcgaggagcagcgtgaactactgcctgatcgcgagcaagcagatggtgggcatcttcctgtccgtgtgggtgcggcgggagctcgtgcagtacatcggccacctcagggtggactccgtcggcagaggcatcatgggccgcctcggcaacaaggtgctcgacgcggtcttgctttgcctctgctcgctgtttggttcattggattcatggcgccgccatggctggctctcctgcttgcagggttgcatcgcgatgagcatgacgctgcaccagaccagcgtctgcttcgtctgcagccacctcgcctccggcgagaaggaaggcgacgaggtgaggaggaactccgacgtcgccgagatcatcaagagcacgcagttcccgcggatctgcaaggtgcctggccagcgtatccccgacaagatccttgaccatgagtaagccattgccgataaaagatcatgcatttgctcaaggctgcaatgcacaaacattttcacaaactctgcattgtcaaaatgtactactaactaatgatgaactcatctgcaaatccagccgggtcatatggctaggagacctgaattaccgagtcgcgctaagctacgacgagacgaagacgttgatgggggagaatgactgggatacattacttgagaaagaccaggtatgagctagtatatgaagtatgaatgaacaatgctgccgtgtaaacctgcattttttcagatatgctacagtgatatgacacagtaagcacctgcttagtttggtaaaatgttactgacaagatggcattcctgagcagttgatgatcgagagacaggcagggagagtgttcaaagggtggaaagagggcaagatctacttcgcaccgacgtacaaatacaagcagaactctgactcatacgcaggggagacggccaaatcgaagaagaaacgaagaacacctgcatggtaggagaacaagctgcatgctctgaagattcagacatgctagcactgacacttgttgagaagaaactgaaatttctgacggatccatccgtgtaaaatgcaggtgtgaccggatactgtggcacggccagggaatcgagcagctgcagtacatcagaggggagtccaggttctcggatcacaggcctgtttgcagcgtgtttgtgatcgaagccgatgtagataatggaagcatgatcagaaagggctactcaactctggattccaggatccatttcgagtctccgataccacaaagacacagcttctacgatgatttctgacttgtgattagtggttttgtctatactactatacttgtagcttaattacaaaaagcaggaatgtgtctacttttgtagtgggtgggctgcatttttcaagcctagcacttgtcttacactaactggagtaaatggtggcttctgaccaaaatacgtctgaacaacggacaactggctgagcggaagtgctttgtgtcttactaaatttttgatgcgatgtcttagtaaatcacatcatactttccttttatattgcgatgatgttcaaagaaagcagtaaacagttttctattgcaatgatgttcaaagaaagcagaaaacatttctccgattcgaaaaaaaaaaggattgcaagatatagcaggcagtaagtgaataaaccctcgagagaaatgacaggaggaaactgagtgcaacaaagtgtcgtgctgttatttatcatctggcagatattgttgcgaaagggttctcaaatgaggtcacgaaggttgggatggtggtgccgactacaaaacaagtcaggcaacacattcctgctgtgtgttaaagcgtttctagttaacatttggtgttcatctcttggtgagagctgagaattcactgtgttggagttcatatcaacagttggcttgcatttttcatggtggtattcatggatcagacgatgaacagacacttcaatctgccggggttatacctttaccttcgcctggcaagcttgtcagctcaactccgtttgatgaagtcactgcggctttcccattttcagattcagtctctttttcttctctcttgtcagatacagccactgtttcttccctcttcccagatacagagtctatttctgccctctcagattcactctctgtttcttccctgttttcagattcagtatctgtttcttccctcttttcagatgcagtctcttcactcttcaaacctgaactaccttcttgtgccatgtccttgttcaccatcacatatggctctgaagcaagagcagaattttcaggactccagaacaatggcatcttgatgtcatcttctctcatccttgcagcataatcatttatgttaaaagtagcctggtttttgccaccaaatgcagattctaattcttccatgttaaaaaggtcttccatgatcttgttagtctcaggcctatctgggtatacaaatttgaccttgttgaaagtctttggctcaagaatggggcttgcgatctgcatttagataaaacatgatgttaatttagttttatatgctacaatagttagttgcctacgggtgtgacagcaagaatgtatgtgctgtgctccatcattataagaaagttccaccttgaagtgtataccttacgttgtactccattacattatatttgacaatactaaccactgtgattttatctttgacaaatatttttttataattacaatgttttgattaatgcaagtagtgtagttatatttagcatgcaaagtactttgacaatacaacatatttttagatatttataatattttttttaaaaaaaagacgagtggtcaaaattaatactacaagaatagtgtctggtgtcaagtataaaaaacgaagggagggaataagtctacaatgcaaacaagagaacaatgcatgatcagacaattaaatggaacacattatccctaaatttctgattgaatataaatactagtacgatgatcaaagctgtgtaaaaccataccttccagaaagactcaaaaaacttaggagcattgtaaagaattgcaacacccaatctttcaggatagtgaccttgtaggacatctgctgtcaactttgtcacatgaagtgatatgttagataatgagaatccagcaaaatcaatgagccaaaccatctgactctggtcatgcggaagattcagaattgcattctccatacagtataccaaatatctgatctgccccttggccttcttggtattctggaaaacaagataacaaaattggatgactaatcacagtttttatgcacgcgtaaactataaattttttttacaagggaaaaggagcatcaataaacctgaactccaggtctcatgacaagaatactccgtccactcttgtcaaagtaatcagttcggtagatttttccagttgcagcttcgtttgctatctcatcctatattgaaattcaaatagtgcaaatgtttcacatagctctagaatggtacaaggagaatcactcgtatgtggatgtggataacatgacctgttattacttctctggagcaataaaaggtttcttaagtaaagaggtgaggacagcttacccaacggatctcatctggcttatactctgaacgccatttcaaggttttcttcaccttttcgtggccttcttcacttcccagttcctcgctaccaggtacctcgcaatcgaagcatctgagcaatatagcgcagcttttcctgatagttgtcctagggcagctcctaaaactttttccaacccccaatatttccttaatgagaagaattcaaaaatgagaaacaacaccaactgatctaacaacacaatagggttaaggaaaaaattgctccacggacaactcataagtaaagaaagggtcaaggggatgatgactaagaaagattgagttgcatttaaatcttatctgatgttttagaaccaaacaaacaaaaacctgaacctttgtgatactggctcaccttggatagccgctgctcaaacagtgccgcttcttttccatcaccattgttcacaccgcttgcggagctcatagtgtccttttgttactacctaccatagagcatagaacatacaagagctcataagaacatcaatctgaattacaccaaggacgataaccacatcaacattatgcattatgcatgaaaagcaaaaatatcataatgcacaagtgttgaccagtgttggctttgctgttatgcagtgaaatatgttctattagcagaaacaaaatcagtagttcctttttctaaaactgcttactgtcttcagctagtgtggcactatggcagcgttgcaatctaacaagccatttagaacagacagcacagaatggctaggaaatggtccatcataaatgcaacgatgttaacattaaccaccaactcgcatttcaacgatatccagttatcttccacgtgatcctggcacaacacaggagcgcacgagacccccaaatatccaatccggtgaacaaaacgaacaacgaggggacccgaacgcctaatttcagcgcagcaagtagcgtcagctcacaaagtacaagtccacaacccttacccagaatcatcgaagctcccgaaagaacccaaccaatctcgcccaaaatcgcactgatggaacagaaccaataaccacagaaccccaactcttgcttcgcgcgacgccaagcacatgccgcaagaaccaagaaacctagccacgttcttgagatggcacccaggaaatgccagaacacaccatgattctcccacaaactccagaacggcgtagcaagaaatgcaagattccacctttcgttggctcgaagccaataaatgcaaccacgcaaaaccaaaatacccccatacacatatccaccaatcggaagatctcccgcggatgcaacaaaacgctcggggacagcaacaaaacccccctcaaaagaacaaagcaaactttctccgttgaaagaaacggatgcttccagtcaatctcctccacccaacagaagccgcgacgacgcaacaaggtaaagctagttcttagcgctcacctcggcgagacgggacgcgcgcgcgcggtgagctcgactgcccgagcccccgattccggagtcgtcgggcttcttcgggttctcagcccaggcgtcttcctcagttcctcctccgtttgctttggaagccggggaagaaccgaagaagggaaaggtaagaagagactggtctgatcgaatctgacggctcagatttctttgactctatcgcgtggacgtatccgacggtggtagggctcgtggtacgggcccacactacgggaacaccgggtaatggagaggggaaaaatacatgtaagattttttgtccggtagatatgagctgtttgtgaagctggctttgggttcgttggcgctgtgatcgtgagtgctggatatgataggataggattggattgtttaaatgatgatttaatcgtatttaattgctgaaaaggttctttgaggtgtgtactccatctatcgcttggagaatctctatgctattatttccagcataactggatatttgggtgtttttttgccattgatcaatgatcagcagctccatcggatgttgcttttctaaaacttgtgcatcaggagacgttggtgtcactcagtatatcaacccttttttgcgacatccttgtaacattttctttggttggaggatgcaaggagttgattcagtacggggctctggtaggcagtagcgtcctgtttgaagttttaaggctacctttttttttttggtgattttgtccatagccgtccctcttgaacgttgaaaattttccaaagtacagtgctggttaggttggagaagtattattggggcaacacagtttgagttggccatgcatgacgctagctgtcacaaaactgttaatttgggggcgtgactcacgtttgtctgaagaacgtgattggattctccagagttgtattttctaaacatgggttttgaccctatctggagctctggaagtaccgggactccgggagcagcatttcattgtggcagcaccgcggtagtggtacgtgtacgtctctccgctgaaaatgggctggaagattcatttctgggccgaatcgacgaagatcttggttgatcaacccagtccgcacgtgtctccgcaacattttggcccaactcacgcagcgaaacaggctgaaaggccgaaaccccggagtcccgcgccccgtcgcttggtgggccgaggcgggaggaaagagttgctatccgatcctacacggattctacggaggcccagaaatcccaccgtttctccgtgctcggcccgcaaaaaacgctcatgccgcccccttcttgccgatcgtgcatcctcgcggcggtgccctcatctgctccgcgattctgcgtgctgccccactacgattcgccagccgcggcggcggtgccgggtgcgtcggtcggtcgctagctgacccagtgagcggtgatcgatcgtcgagatctgtacgcgcccgtcgcgatcgatccagggacggctgagttctgacttgtagtaacaatctgtctcgttcgttcttccacaggtccggtatccgaacaaaggtcaatactagtaaatctttgcaattgtgggatagaatagaagttctttttgcaagataaaacagaatattactaattgcaattatctcctttcgttgttactgatcagcttaagcatgaactttgcttctctgcccttttttgtgaacgttacttacttgtacacctccatacgtgcacaatatcacactcagtacaatcaggtagcatatatatgacgtcaacggtgcctcaatctttcttaaataatcattctcttgttcacataagttagattctttttttttctttttgagaaaagaagatagatggttacacttgctgagcaacttaaatcctcagccccctgaacgaagcagcagatttcccaagcaagcaaatgaaatgcaaccatgcgctggcttggaatagctcgatcagtacccaaccccaactcaatgaactggacccagctcgatcaaggcgtgaagctcatctcgaactcatcatcgccaaccatcatgaaatgcgacccatgatcaatcaccttcttgccgtcctccgtcgctctgctgaagtgcttgcatgggctcacctcgaactccacatggacagtctgcatcgacttgaggtgcaggctctggaagccgatcagctggctcgccggcctgccgccgtccgccgcgccgttcggccagcgcaggaagagcagcacggggtgcctgccgtccatggggccatggttctgcaccctgacgagcgccgggaacttgagcttgtcacacgtctcggggccaatctcttcgacgtcatagctcaccgtgcctgcagctgctgtcgccatcgccttcaggccatcgatgctgctcaaagacggcagcttcgtgccgtttgcgacgaagtggtgagagtacttcgagtagctgaggccgtagccgaacttgtagacggtgttgcctcggtagaacctgtacgttcgtccgggatatcccgtggatggatcggcacgcatccgcatatctgtcatgggcacgctcgtgaactcctttggataccaggtcactggcagccttccacctgatgaacataggtcacatgtaacacagttcagtatttgaacgtactcatctactgatgagaagatcaaaaagtgaatgaaattttaccagggttgtgctctccaaagaggacctgagcaatcgcaatccctccagcctcgccagggtaaccagcccacaggatggccccaatcttgggattatacttagcaaaggtcacatccactggaccaccacacagtagcaccaagatcaccggcttctttgccgcgttagcgaccgtgttgatgaggttctcctgcattcctgggagcgacagttccagcctatcaacctcttccctctcctgatcttggtctaatcccatgaacagcacaacgtagtccactgaacttgccaattgcgccgcttcaccaattgatgacacattgcaggcagccgagttgcacccagctaggaacctggtgtccttcacatagccttgcagcacttggagaggagtcaccgatatgcaaggagggccgaagtaattcccaagcaatctcgtggcgtcatttgcgttgtgcccaatgacagcaatggatgagacttgtgatttggacagggggagagcattggcgtcgttcttcagtaggacaacgccatgttgtgctgcttcaagggcaaggttttggtgctcctgcgtgcacacctggtctgggccaatgttaccgtagcggttgtactttggattgccgttgaagagccccagcctcatcctgacagcgaagaggttgtggagggctctgttgatgtcttgttctgtgatcttcccttgctggattgcagatagaccatgttcctgcacgtagctgccgcagttcacgtccattcctggaagtgtgttgttacagaaggtaagaaacacttcttaaaaaaataatatggagtatatcggatcgttgcattaatgttagaagcaatttgcatttgttgttttattgttttaacttttttgttgatttggacctactatctactgtcttttgctactcattgttgttgacttgaacccttgccatgtaacaccagaatgactacttacatgctgagttagttttctttttgaaccttttatatactgtcttttgctattcattgtcgttgttgacttgaacccttgctatgtaacactagcacaactacttacaagcagaggtgatcttccttttttattgacagatggattcctgatgatatcatgatgttcagtgtcatgccatgaattatttcttagtggactcactgaaatacctttgtttagagaacagatcattaatctcactcaagtacctaaatcagcaaaacgggaaagctgtatgcctgtatgggtagtgggatccaaatcaacttttggttgcagttcagtgacctaacctaacctccctatatctttgcattattcccggagggctccatgtgaggaaaacaaacacttgaaagttgcaaaatagtactacttccgtcccgacacttgtctagatttgtcgccaattttttttttgtttttacagaggaagtaacatatttgagatactacaatatattgtggaattaccccatctctgacaaagagtaataggacaattgggtgattctgaccagtaaatatatagtggacaagtattactaggtgtgatgtgcaaattcataccagccttgaggacatctgcaactgcatcttccgctgtcttggcatatccttggacatcatggatgatggacacagcatcacaatctgaggtgatatatctgtcaacagaggaaaacttgcaaggatcagttgctgggcattgtcacatacacactgaacaaaaacttcatgtctaggccaaagaaaaaactgatagctccagtcattctggcttacccgtaaaacctccaatctccccttgcagttttggagaggaggttgtaatcggcacaagttggcacgccattgacgcggttgtaggagcacatgatgccgctggccccgccgtcctcgacgcagcttctgaacggagggttgtacgtgtcggccaggtcctgcgccgtcacctgaccaaaaaaaatcgcatcactcagagcctcgtcaatggcagggtcacccaattagccagaccatttgctgacagaacaacgtgtcgtgacgggtcaccaccttggcgtcgaaggcgtagcgggtgacgcccttccagttctcgaggtcgtaggcggtgaagtgcttgcagcaggcggaggcctcgaggtcggtggagttgatggcgccggcgagggcgtagccctggacgccgcggacgaacacggcggcgtacttgccggtcaccgtggggtcctcgccgggggtctcctgcccgcggccccacctcgggtccctgaacacgttgatgtttggcgcccagaacgtgagcccttccgcctgcccgttgttgtacaccgccctcgcctccgtgccgatcacctgcgttgcgtgcccccaattgcacagcacccaaaccagaatcagtttacagaggaattcaggtacggttttctctgctcttgtttcgtgttactactctgcatgttgttgcggtttgctgcgttgtttagtagtatctgctttacgacttgttaccgtctcaaaaggttgcggtgaatctcattacgtgcttttgacaaaaacaaccccaaaagttgcatgcatgtaccgaacacgttcttacctactcctataggtccgtaggtgtacaaaagttcatagggccgacgggtgatggattaccaacaagctgcctaaaatgtgtggattattggactcagtatgtaccagtagcaccctgaatatattactgacattctgggcataaattaggcgcaaagactcctctgtttcttttaacccctcaaaggtaaaattgagaaagagactacaaatcgtaattcccagttacacttattacacttaagtcccttccagtactgaacagtaactaaccactggtgttagcgtgaatttgcaccaacacggtaaaaaagtaaaagtgaggaaacgatcgaggccgtgcatgcgctgagcacgtacgtgcgtacctggccgatacggtaccagaggtgcgggttgaatgacgcggcggtgaggatgacctgcgggaagctggtggcggcgcggagcgggccgtcgaggtggatgccgcggccggcgttggagacgccgtggagcgcctccgaccaccacttgtacgccgggacgccgagccggtcgacggccggcgactggtccccgagctgcgagatcttctcctccagcgtcagcctcgacacgaggtcgtccgcgcgctgctcgatgggcagcctcgggttgcagaacgccgcgctggacggcgcgccgcaggagaagggcgggcccgacgccacggcgaccgccgccgccgcggcggccagtgccagcagcagcaggagcggcgccggcgcgtggaggagagcgcgcgcgcggcgtcccatggcttcgtgtgcgggtgtcacgtactgcgctccggagcgaatgtgtgtgtaagtgcgtgccaggggtatatatgaagcaaagggcgcgaagcacatgggagtacgggctgctgacttgtggggctatgccgctattcacgtgcaattacaatcctgcccgtttcgtaattttgcattgacaaatatactcccaccgtccttaagtaacaaaccaggatggatctaatcaccataatatgtccatctcaaaaatatagttaccatgtacagttgtattggattagatataacttagtataacgaataattgccagaatatgtagaactagaatatgatcaatcatgtgctaggtttttatattttagaagagagagtagaatggatttaattctattctaggtcgttatgtccagatttatagttttaggatggatctagtcaaattctagattacagcatatcggaacgaatgctctccatggatcatagtgatgagaaagaaaagagcattgcctttgtatagggcaaattcactgtgttggaacttggaatcaagccttttgttaaacgacaatcttaaaaatccagccatttagccgaaagccagcgatggcaccgaacaagttcggagtgcaacaaacgaaaaacgatcgcatactcctcaagcgatcgatccagatctacgtaaagttgtcacaccacgacgcgtcgtgtggctgccactagctaacataactgctagcgagtagagcagtagcggaaatgctcatgcttacgcttatggaaaatgcttacggatgctgtaagatttagcagcaggaggcaagagcggtgtgaccaccgatgggcaaactcgtgacttcacaggtttgcctgcctgcctgtgctttgtgggtttggctggaccgacgcccaaggaaagcaagcgatagtgcgaactgggaagaggcgaggcgaggctggcgtccgcgcagtagaccgtggtagtggtggtggcgtcctccgccgtgcgattcccgcgatatcctcctcctttgccactccgtggcgcgcctgacgtaacgcaactgcttggacccgcagaaagtcagaaatcgttcgagtcgtgggaaaaatttctgaattatagctcggtgattttatggtatcggatttttgacgccgaggacagacgaagcgtcagccactggtcaaaggagaaagaacaacaagttcggacttcgaagtactctgatactattgcccttgcaacaatgctcgtggtctgatcgagaggaccagatcgctctgtgtgatcactgatcagtggagcctacggcctgaagagaatattgaccggaggttaagattacattttgtctttttggcactttgcagagaagtgactggtgcgtgcccatggtccggtttgtactcgtaccgcatattcataaattcctcgagtaaatttcacaaaactatatatactataactaaattatcacaaaactacagatttaactcggtatatcacaaaactacacatttaacatcaaactagctgggtggcccgctcacttgcgcggctagcacctaaacaaaatcatatattttttagtatggttttactttaaatttgttaaatagttatccctgtatttctaattatatagtttttaaaagtcacaccagctgctaccccttacttctgtcatatccttctttatttgcttgctcggtctaccactatttctattcattctccttgaaactttaaaaattggatctgttttttgagtttattatctcgttgggtttcgtttttataatttctggaagtctcgtcaaacgctgccattatactcctctacggcccgtccactgtcttttctctttattgtcattgggattttacaaatcgaacataattatcgttcgagttcattttttttttactttttataagtcccgccaaaccgtcagcggttttgccattgtactctttatgcctcacccgctgtctcctttttttattgtcattaagattttaaaatcgaacatgattatcattgtttttttttactttttagaagtttcgtatctttaaaaattggaccctgtagtttttaaaatttattgtcttgttgggttttatttttttataatttttagaagtcacgtcaaacgatgccactatactcctctacgacccatccgacacctactctttattgtcattgggattcgaaaaatcaaacataactatcgttggaattcttttttattttctagaaatcccgccaaccgtcggcggctctgcaactatactcctatacaccccggctgctgcttctcctttttattatcattgagattttaaaaatagaatataattatcaatggggtttattttttttactttctaaaagtcccggcaaccgccttacccgtttgcttcacggcctggcgatagttggtgggacttcttgaaagtaaaatatgaattccaatgatagttttgttcaattattaaaatgctaatgacaataaagattaagcggcggatgggtcaatgctaatgacaataaagattaagcggcggatgggtcacagaggagtatattggcagcatttgacgggatttctaaagattctatttggtgtattactaacagtttttatatgtcgaatcaaccgctaccactctactcttttataggcttgttatttaatttatctcaccgtgtgttttagatggtctcttttttaataatctttatttttatcaccaattttagttatttataaattgtattctattttaaatctttttccttttttctttttctaatttcagattttttttaaaaaaaaatatttaataccgtatagtgttcttttaatatttttatttttcgtttttgaatttcagttgtttcaaaattgtattcctacttgaactctcttttaatttttctaattttggatattattttatattttattctgaattttaattaatctcgtatggggttcttatatggattcttctttaaatattgctttttttttaattctgaattttagttgattttaaattgtattcctacttgaactcttattttatttttgctatttttggattttatttttatttttatttcaaatattaactaatctcgtattgggttattatatggactcttttatcaatattccttatttttaatttctaatttcagttatttttaaattatattcctacttggactctgttttatttcctaatttcgtattttattttatttttatttcgaatttcgattaatctcgtattgggtttttatatggacacttctttcaatattgctttatttt

SEQ ID NO: 49809 - DNA, 14989 bp, Oryza sativa
catataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaacaaaccttatcatcctcgtgtttctaattatatagttttcaaaagtcacaccagttgctaccccttatgttatctccttctttatttgcttgctcaatctatcaatatttctattcattcttcttggaacctttaaatttggattttatagtttttagagtttattgtcatgttgggtttcatttttataatttctagatgtcccgtcaaacgttgccattatactcctctacggcctgtccactgtctcttctctttgttgtcattgagattttaaaaatcgaacataattatcgtttgggttcatttttttactttctagaagtcccgccaaaccatcagcggctttgccatagtactcctctacagctcgcccgctgcctctgttattgaaattttaaaatcgaacatgattatcatttgcttttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatagttggaattcatttcttattttctagaagtcccgtcaaccgtcggcggctctgcaattatactcttatacaccccgcccgctgcttctactttttattgtcattgagattttaaaaattgaatatgattatcaatggggttttttttactttctagaagtcccggcaaccgctttccacgtttgcttcacggcctgcctgacgtccctccttataatcgtcattaggattctattttggtgatttattaacaatttttatatctcgtatcaaccactaccactctactcctctataggcatgttacttaatttatctcgtcatgtgttttagatggtcttttctttcaataatctttatttttatcacaaattttagttatttataaattgtattcctaattgaaatcttaattttctttttctaatttcagatttttttaaaaaaaatagttaatatcgtattgtgttattataatgtttttattttttattttcaatttcagttgtttcaaaattgtatttctgtttgaactctcttttaatttttctagttttagatattattttatttttattataaattttaattaatctcgtattgggttcttatatggattcttctttcaatattgcttatttttacttccgaatttcagctaattttaaattgtattcctacttgaactcttattttttattttcttttgccaattttggatttatttatttttattccgaattttaattaatctcgtattgggttcttatatggactcttcttttaatattccttatttttaatttcgaatttcagctatttttaaattgtattcctacttggactctcattttcttttctaattttggattttaatttatttttatttcattttttgattaatcttgtattgggttcttatatggaaatttatttcaatattccttatttttaattccgaatttcagctatttttaaattatatttctacttggactctcctttccttttctaattttggatttttattttattgttatttcgaattttgattaatctcgtattgggttcttatatggaaacttctttcaatattgcttatttttaattccgaatttcagctatttttaaatagtacttctacttggtcttctttttctttttcttttctttttctccgattaatgtgggaatttctaaccccccacagcgaacatggtgtctcctttcaaagctgttttaataatataatagatttatcacaaaactgcacatttaagatgaagtgtcacaaaactacatatttagtaactaaattatcataaaactacaggtttagaatcaattttatcacaaagtaacgatgtttatagctccaccataacaatgatgctagggatttaaactccaaaagttgtagtttttttataagttcaatattaaatatgcatttttatgatacttaatctaaaatctgtagttttgtgataaatttggtgctaaatctgtagttttataatacaactccttaaatctgtagttttgtgataatttgatcaaaatacctgtagttttgtgaaatttattcaaattactttgtcatcattgatatggctggtgagcctttctggcccgtcgacagacatagtagtgaagtggagtagtagcttgttgcatcactagaattctagaaatgccaaatggcgacagtgcttcgtggatataatttccagtgagcttggtggtgcatgcacttgtttcatcagagtgcctgacaggtcaacacaataatcttgatcgacatggtaccttatctagcaccggcaaacaggaagccgcgacatcattgtgttatatcgggcgtgatgtgtggaaatagacgggagagaggaggcaggtcagagcaagttgcacgggacgtcgctattacagcgagtaaaagacaggctcactctactcctagtttactactacaggactggcttgctaatctgtgttcaaactttcatcgttgaaactcaaaggacctgtttcggagacaggtcgagatcaagatctttacaattgaattggatgtgtgagcgttgaaggcgatcatggcagaaaagttgagacatataggtaggaaacggctttgtaagctgccgttcagaatgaaagaagtgatagagtcacacgagacaagtacatagacctttgctgctggttttactgcaaaattttttgatgggaaaattggaaccatgccattataattttgcaaaatttgagatatgtcatcctgacccacatgtcattgactcatgtaggtcctacttgtcattgagataccgatggcatatctcaaactttgcaaaattataatggcatggttccaggtaaacgtttcacctaatcacctacggagttttttttttcctttctgttctaaagaagtgtgctaggtagttacgattccatatcaacaaaagccggcattcccaggataatcgtggctaactgacgaagcagattgcaagtgcggtgtcggtgaggagctgagtacgtacctcaagctatcatgccacaggtatgatgaatttcacgttggaaagaaaatccagcaacgccatctgatcgtgttaggtggcaattaggtccagggctccaggttgacagagttcttgggatttccattcttctgaactttactgaactttttcattcacatactgacaggtaaggtaaactcaacatttgtccggtccgtagttcataccctactaccgctagtgcactgtgcaccaaacagatcgggcaattcagcgcttgttttcttgcaagcgtttggactaagcatgcatgttcctggatctagaaactgtacgcccacaactccacaaggccacaacatactccaaaaatgaggacagtgtacaactagctgcacatgcgatggtattgcagctaatcatatgagacgtggagaaaacactgcaagctccaggtcaccgtgaacgcacgcgcatgcactcgactctgtccataattgctggtgactgtagcggcgtagccatgtgtatcgtattcgagcttgagcacaaaagcggcattaatttttggccgacttttctcgctggagtgtagacctcgacatgtctggagttgtctccgggttcgtaggaactgtgctttgctcttagcctaatcagaacgggttggcgaggtcgaaagtccgaatatccttttgcagttttgcagtgttcgcatgatgctgattaattcatttaattggctagtaaccgagcaagaaatggaacgtgtaagaaattgaagttgctgaattcagctaggtagagtgtagattatgtggttttcagggccagagtcaaaagttggtacgaaagttgggacggtgcctctgagatcgtgattgtttaattagggttttgtaccattactaaatgctctcaacatagtgctcgcggaaactgcgaagtggcaggcagatctctccttttacaacccactatccaaaataaatataaataaataaaatcacgtttatttggcagatggcactcttgctcttcgacgtgatctgtggctgcggcaaggatacaatgattgagaggtaacacagtgcagttcatatcggtgctgttttatcttgaaacctgcagctccattgataattgctgtgaacaagcagccatttgggccaatctcgcacagaagtgtactggttaacttgacatgaacgccagagtacaagttgaggaggttgccatatgctttgggatggtcaagtttgttgcaaggtttcagtgcgccacgtcacagaaagcaaggatatgcttgcgcatacattaggccgttttgatcgcctatcttctcaataatatgagaaatgaataatgaattgcttagccttgacgcataaggaacgaaacggcatcaggaatagctttattttgcattttgcgtcatgctgtataagttacagactttgatgtgcataccattttaacagtctttggcttcatttaacatacggagcatgttcaaggtttatcgggtagaagtactacttcactgttggctgtcaaggatatcctgacgagacagaactggtaccggagtaatcagcgtcccaccagcaggtactgatcgctgaatccactgttcattgatatgatcaagatgtacagccgcaagatcgctatcgatcagaaatgtggcagctcacgttattggctgatagaatttgcaagattgtgttacaatcgcggcaccgacagtggtcttgcaaagttgcacaccttcccaccacccacgcaaaagattttaacaaccgtagagaatgttaaagatcagattgaaaatccttgacaatgcttgtggttacagcgatacaggcatcggccggctcacgcaagtcaaggatagtacacgtagtaacagcaaatctgcagagtacttactacatgttagccagtgtaagcaaacagacctgaacattgaggggcggcaagcaagaaaaaaaaagaagtcaaatcatcgttcttccaccattatgcttgggagcaggaaacaacatacagataccacatggcgcaagctaactgccagttacaactgaggagaatcatgtcgctaacttggagttccgaccttcccacacgatttttacaaacaaagatgctgaacactgcatataggtagtaccatcactataaccaaacttcctgactggcaataaccactaatcttcctagcaatcaaccaatctcaatgcacaacttgactcaaactggcccagctgatctgaagaatcccaggcaaaagcagtttaacagcacaaccatgaaagattcattttcccaacaacgaactgctagccgtctcgagatctgtcttgcagttctctctgaattcctttaacttcacaagagatgaatgctgaatgtaagaaattttttgaggttagcacataatcaaatattggcaatacagttcatcagtcaagtaagggaagttacattgacgtcaaacttagaaaaggtgtagaaaacatagtacatgattgatcataaaaccatacaacaatatgaatactggaactctgtcctatagcttgatgaacaatatagtacatgatggataccagaatcaatgaagttccgataacagaaaatcatgcaaggcactgaatgtaatattaatttatgatttgcaccaagtcaaatgctcatggtactccaagaccatagtcaccaaagtatttggagttacttttcatgaagacaccacagcaacaaaataaaatatttagtgctccatagaggaccaaagcccccctgccccaaacagacacaagcggaaaaaaaaaggtgctggtacacataaactagtttcacaacctttatttaattaaacaacgaattcacaaatgccttttacattatggataaaatcagaacagagcccttcgcacccaaagtatcacaacctccattgcacaggaacggagaaacctacagctagcccaaaaaggcccttgaattttttttgggttaattagatccatgctattataactttcacggttttgaaatatgccattacaatccaagtatttggaattataccattataacttcagggttatttgatatatatcactacttaccccttcaacccatattctaattttttggacgaaattacccctttcttcttcctccaatccttcctctcttgagcaagccgggatcagtggaggaggagctgagcaggtcctaagtgcatgtccacaagctccttgtccatggcgcattgcacaaccgagaagtttcctccagtatcagaaaagcagcacactgaatcctacaaatgttgctcctcttcatcgatggcagattggaaatttgatttccccaaactggctgtgtagctcggcacacagcctgcagccatggcgctccgtcgccactgccgcttgaagagagagagagagagcatgcacgtctcctccacatcatcgggttggcgaagacaggcccaaccccatcgccggctacaccacctccatgaccacgaccatggagatgtcagaggccaccacgaacgtgctctccgccacctactggatgctcagcgaccctgtgcagcaccagtgtcacaaaccgtcgctcgtcgagcacccagtgtcacagaccgtcactcggcagtgtggcagccccagccactgcggcgagcagggagagcaggagacaggttgaccgccgggggcctcgaactgctgtcgtcaatgctccgagctgtagctcgccagccaccagatccagaggatgaacagaagagagagagggagaggagatgaaggaagaaaataagggcaatttcatctataaaaaatacaatatgtgttgaaggggtaagtagtggtatttatcaaataaccctaaagttataatggtatagttccaaatagttaaattataatggcatatttcaaaaccatgaaaattataatggaacagatctaattaaccttttttttaatgacagaaggggccattgtcatattgaagatagcagcgcagtcaactaattccattttgcactccgggcatgttcacttcattgccaaaaaaaccttaccaccaaatattggtaaagtaaggtgggggtgcctccgtggctagtgtttgctttgataccttaccaaaatttgggagtagttttgagagtagaaagttctagaattaccaaaaattagtagggttatgttggcaatggtatgttcagttccttgccttactaaaccctccattttagtaaacagtaatgttttctgctgatcacatcatatatttttctaagggacctaataatgaattctaaaccattgagcatcacatggagtaatgagcaaatgatccttccaaatttactggcgcgtacaaacagctagtagatccatattaaatacactgtatcaaacacaacatttttgcaaataatctcaggtatgctttaaacattgatgccaagcaaatgcccgtacaacattgaatatgccaggaagttcgggggtgataaagaaacttacaagctgtgcgctctcacggataaggacattttctgtatgaaggaagagtgatctttgctgttgatatagctcaaactccatctctgcagcccgtttcaagttgtatctgcctgcattaacagaatattcatctccttggcttctcttgcccagcaatctagcgaactttatgctcttcttcaatgctaaaagggtaagttttcagagattgaatcaacattagtgagatgatcagtagtggcctacatcatctatatgtagaaaaggaaatgtgctgcatttgcaaagacataccagcaagccgtccccttgtgtcctgataatggagatcggtccacatgaatgcagctattttgtacaagaaaacagaggttaggtgtacattcacctagcatcatgatgacgtggaaaacatatcttgaaggaagaaataaatgcaaacatacccttaagacagaaagaacaagcacacgacttagtggtatcgtcattttccagttcactatttccagtgaatggtgatggacatcggaacatggcatgtcatcacaacctgttgtgaagtccagtgaagatagtggcttctgattccctgatgatccagccatctcctcttgagtaagacattcaccatcattagttgccgttttagtactatctctggtatatgccaagtattcactatccatgtcatcatcatcatcttcttcacagccaccttctgattccagcgaagactcctgctccttatcatgcaagccagatgagcctaatgacatggcacaactcctcatgtcatcggattccttggatagcaacacagctgcctcagcagccatgtgctgcatcttagtttcccgaaaaattgagggcctcattaaattctctttggcaatactatcaaaaaggggcaatgtgtttcgtgtcgctccaccacttgcttttgcagtttcatcaaactcttttcttggctcaacagccttttcaacccggacaatcttgattccacctgcacttttctccaaattcgatggggctgggcgcttgccaaggacatttgttaaatctccaaaggggcggcgaccactaccttgagcgttttcacccattgcaacttccaaattcactctggtcggctaagtggatagcaaaatcttcaccaccaaccttgtaaaacagaaatctgcggacataatcagaaacaaaagacactgtaagcgctgtattcagctgtcaacatagtttatatccaaaataaaggctaggttttctggatcattaaaacagttggatctggcctatagatgaggtgagcgaagttcatataattggacattacgagaaaattagagctcgtgcttgccatagtgtctattagatgtgaacttcaacgagatcgagacctctctgatacagaatcctcccaatctcgccaccgaccaagtcaaggatcaaaagcgaacaatgcaggtacgacataaatcaacctcaaactcctcatagactagagagaaaataggttaggtttcgccccttttacatcaccattccggatgtaaacagctgaagcctcaatccatggagaggatttagcgcaccatttcggatgtaaacagctgaagcctcaatccatggagaggatttcgctaaaagctgaatccaccagaaggctatcacaatgagccaacagggattccgtccgccgcgcaaactagaccgccagaaaccgatccggggggggaggaggaaatcccgcgggatcctacccacccctgcgccgccagaagcggcaagtgaagacggcggcgatgcgagaagggaggaggggggagggcggcgactggggagcacaaacctcgccgacgcgagacggccgcctttcccccggttcgccccgcgggagcggcggcgcgggcgagagaagcaggagaggagaggggagaaggaatggtggggttagtagtaggaggttttattccgagacgcggcccgcggtggagaggagcgaaaaaatggagcgggcgggcggcgggggcgaggggcgaggggcgagggatgggatcccccgcgcgcgcgctcgcgttcggaatttgggccgcgcgcgtcgcggtcggcgcgtgacggggcggggaggcgcgtggctccggcgcgcttttggagttcgtcgcacagtgacacgtggtgggtggacgattcggtgtgttggcgatgccgaggcgaacggcgttgaacaggcctggactagtcgattggcttctgggttgggccgttagtgggctaagaaatataggaggagtgagcattcggatagatgtcgtcctcctttcactggatagatagaagggtatatctaaacgaacttttgattagtttttctttcaaaagctttcaaatttttagtgtatttacgttgtaacttatatataacttagatataataattagtcaggaaaaacatgttagacatagtggccagcccatcaatcgcacttttgttgcacagattgagtttgaatctgaagcaccgcatgcataaataattttcctcacatgcatgtaagaatctcgagacaattcaatggacacaaatttaaaagttggtagaaaactaaaaccgtcggaagactttttgcaaatttgagataggatggcttagaggcagagcatatattataagaacctaagcgctagcctcaacatgttacatagggcttgtttggtttgctaccatgccaaaccataggcaaattttggtaataccaaatgttttggcaacttatgtgtcttattagtatattttggtagcaaaccaaacactagccaaactactattcaaaatgccaacaatttgatagagcacatttcagcatcaaaccaaaatggcccataagcttacgctatgatgggtagaagagagaaagtatgagagataaaagaagacacctcttatacaagagatagtcgacaaaagggaggaagatgaagattatattggacaaacaagtattgggctaatatattagagttaatataaaggtaatttatttgtaaatgattacctttatatccatgattagatgcacatgaacaagagagcaaacacccctattagtataaacccactactttaggctgtgtttagttccacgctaaaattggaagtttgaagaaattaaaacgatgtgatggaaaagttggaagtttgtgtgtgtaggaaattttgatgcgacaaaaaagttgaaagtttgaagaaaaaagttggaatctaaacagggccttactccaaatattacccatgtcagcaaaagtcattgtttaatcaatgcactgttatttaaattattatttttctccttgttccgtgcactctctcctgacacaagtggaattgctcaaacctgcattggagtgcaagtgcagccagcgcgtaaacaatcgtccgatgatatagggttgattttgtttgataccctaccataccctaccaaaccattggtagtgctaaatcttgagcacgttttagcactaccaattaccaatgttttggtagagttggactatatgggttgtattagctatggcaaatattggcatcgatccaaacatctagtataaagtactatttaatttgccaactttttggtatgacaagttttggcaccaaaccaaaacaacccatactctctcaccttctaactcaccactaaaactggtgtggcttattgtcctaggctgcgttcgttctagcttgtttccaactcctctcacttgttttcagcgtacacgctcttaaaaaagtttatatttgtaagttgcttaaaaaaatcatatgcgagaatatacgaaaagcctaggatcaatattcaaattgttgcaagttgcaagttgtttcaagttgcttaaaaaatatacgaaaagtaagttttctgggagatttggaaagaaaaaaacgcaagaattttcaggcaacttgcaaccaccccaacggccattctatccagaattaaggaggaagcaagactttggatcacggttggcgcaaagccgctagctgagttcctcctttggaagagtaggcttttctcggtctgggaggaccttaaacttacttttcgtatattttttaaccctctctatcaacatacgagttaatccttttgcctcttgttttttttttaaaaaaaaactgttgtggcaggtttatagttattgtatctactcttacagatttgcttttttacagtaatcttcttttatagtatcctgctgcaacgcatgatgcaaagttgcataccgcagacaacgattcatactctattcattcttaaaaaacttttgggaatgcaacaaatgcttggccgtgtttaattctttgcccaaaattttttttaagtatacggacacatatttaaagtattaaatatagactaatagcaaaacaaattacaaattccatctgtaaactgcgagacgaatttattaagcctaattaatccgtcattaacaaatatttactatagcatcacgttatcaaatcatagcacaattaggctcaaaagattcgtctcgcaatttacatgcaaacaacgcaattggttttttcgtccacatttaatatccatgcatgtgtccaaatatttgatgtgacgtttttggccaaaaatttttttggcatctaaacacaccactcttgttcaaatttatctgtacgagttgattattttctttttacagtttgattcatgaagtccgaaacagcaaacttgactagtcagctgttgatgcgaaaaaaaaacacacacacactggcctgggagatctgcttagctccagggcaggaccaaaggttgatgagatgcgggcgtgccagtcaatttgatcccgcaactgacaagatatacaaatagcataccaataagccagtcggctgtcaagccgatggagtaattacagtcgatgccgatatcagccgatagcggtagggttttgagctatcagctatgtgtttgatgtagaatctgatacttgatgtaaataatgatatatatacaatcggctgatgatgatgtaataaaataacaatataatcaagtagaaaccaatcggcttataatgatatgataggacaagcatggatctgaatgttaaagcgtacatcggctggaggttcgatgtcataaaattcacaagattagataaacaatgaaacctttgttgcaatcggctaaatccaacttatatgcaatccttgtaagccgatgcaacgtccagatacctcgtcggctaaaatgtcacgcccagaaatttagcccaaatttccagactattttgtgtattaaatccctgtccaggaccagtcagggtacacaaaacgacaagtaataaacagttccaaacgtaaataaagcgtaaaatacttacagaagaggcacttagtcctcacaccgaaacaaaagcagcagcagcggaaaaaggcaatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggatacaaggaggggtttgtggctatttgcataaaggcagttgtaaaacatttcattgagcaaaacagtaaaactgtgagtaattaaagtaacattaaatctccactgatcaacgctacaccacgttgaacaggcccaaccaacccacctggactacagtgcattgggtcgatttaaaaagatgggactaatcacggtgaatctggtcgaccgcccataaccgcgggcacggctattcgaatagttttactctggccagaggtgtacaactgtacccacaagacacagccccacgacacgtttccgtgcgccgacatgccaccacgacataccggaaagaggccgtgacaggacccttcacataaccccctctagccaagcacaccacacctcaggtttcacccccatccccagcgggcaacgggcagtcccctctcgtgcctaggtgaatccggaagtgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgtattttaatcggataattacgaccatgaagcatggccagatgtctcgagcacgcagctcactctgataccaaaaaggtctaatattgtaattatcccatcaactgagctagtggtaattaagcatggctaagcatatagttctagctaatcacataagtaacatgagctagtcgatttattacccaaggttgacaaaggatagatatcaagtaaacgtggcacaagcgagcagataggtaaaccctgatcccgtgtaattagcaaaacatgcatgtttatttgtaaacagtaaaacatttgtaaattaggatcaaaatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaatagtacataaaaactaaacaaacatgtagagatcaattttagatgaattttgcaagttgaatggctcaattcggagttcgaatgaattagatatgaattttagaagttttgagccatttaaatgaatttctataattattcacgaattattgcgcaattattatttattttacaaaggaaatggacctcgctgacgtcatcaaaggggaggggcggggccggcaagcgggccccaccggtcagcggcacaagggcgccggtccaccgtggac

SEQ ID NO: 49810 - DNA, 2670 bp, Oryza sativa
ggcggagttttgtggaaatggagcggtggccggtgtgcggcaaagagcggcggagccgacggtgcaagcggcgcggccggcggctacagcgacggcggcgcgcagccggagcttgccggaaagcggcagagcgtgggagcaacgaggggagagcggtagggagtgtagcgggttcgggaaaattggggaaaagggggaggatggcacggggatcatttttataggctcggggaggagaaatcgtggccggacgtggcggatttgaagcggcaacggccggcgacgtgggtgacatcgtgggcgaagtggggctcgattcggcgccaaaaattggggaaaagcgggggaggaggtggaggagaggggtggttcccggtcccatgcgagagagggctcgaggaggccgggaatggtggcgacgtgggcggttttcggcggccatggcggcaacggcagttgccggcctgaggttggggatgacaggtgggcccatgggtcccacctgtcggccaaagaggagagggaggccggctggggacgcaaagtagacttcggggaggagagggccgagcggcgagctgggccgagggagagagagagcccgagaggaggagggggattgggccggggcggcccaaaaacaaagacggggaaaaaaaattatttgttttctttttattttaattgatgcaatgatctttgtgctattaaaactatctcttgagctccgaaaattcactagaaatttcagagagtattttagggcacaaagaatattgcgaaatattcccggccaaagatttttttaaaggaaatttttaatttcctctataatttcacttgattaaattgatttaacttttaatataatttctagaaatgcattattaattgatttttattcccgaacgaaaatcggggcgttacataaaacccctatgaaacccttgttggcagtcaaaaggcaagctagggattatggttataaacacgacttagtagatcaaacttaactgatgctacactaagtatgaaaagaaacacaatatctaggcaatcaagccgttgactggtttttaaggtggtaaatgccttagctaatctaatctaatatagttaaacaatttagccaataccggcagaaaccctaaagcgagagacaaccgatagggctaaattgagatactaagactagattaactaagacatatgataaataggcaggcaaatatatcatccaaaccagagcaatccaagagattgaatgtgctgatgcagccttgaacgacgccgacgtagatgatacaattgtccggggcggtggaacattggacttaccccttcgccggagatcggaaagcgatgcagcgccgcgtcaggtgccaagtcccgccggacgatgaaatagagtagaaaagataaaaggtggtgatgcgctgaattgtattgatcgtggagataaaatacaatggccctggtgtacatatttatacccatggggagatactagtccttgtaatccttgtagaacaagaaagaagctttcctaaagataaaaggaaaacataaagtccttataggatactaaacacactaaactaataaactattcctaattaatagataacttaccataccgcatcctacttgaactcggtcacttctggataagcttcctttaatagattaatttccttaaccgaatatagcaggaatccgactattggtgatgtgataattctcttaggggaataccaaatttcactgttaacatcagcgcaaaagatactaagggcccatttgaatcgtaagaatgaaaaaaactggggaatagaataaacatatgattctaataggaatgtaagtgtaaagcagatgattgcaaaacacagaaaaaacataagaatagtcgtttgattggaccacaggaaaaatacaggaatcggatgagagagatagactcaaaggatttttactaagaggttgaacctcatgctaactttcctcaaaacctacatgcattaagccataaatcctttaatcctttgcggaatcgctaattcgcgctgacgcgccagatacttatctcgctcgcccgcggcaggccaactgcgcatgcatgcatgcacctttgcatccacccatgcattacacacacatgcatgcaccttggtcccacacatgcatgtgccatggcgtacacccagcgcatgcattacacacgcatgcatgcatatataggatctttctttcttttttttcatcttattaggatgtagtgaaagttatccaaatttctattataagatatttttattagaaaatactttttataattcaaatttaaaatctcgagttgaaagttttcaaatctgagttaaaagtattcaaatctgagttgaaagtttccaaatctcgagttgaaagttttcaaatctgagttaaaagtattctaatctgagttgaaagtttccaaatatcgagttgaaagttttcaaattttattgtaaaatttaaattcaagtagaaaataattttaaaatttgagttgaaaggttttaaaatttgattttaaagtttaaatcttaagtcgaaagttttcgaatctaacttgaaagttttcgatttattagaaaaaataaaaagttctcttaggtactaattataatt

SEQ ID NO: 49811 - DNA, 7006 bp, Oryza sativa
ccacacacgctactctctctttattgccacgcccgcgcacgctgtttctgccgttgcacctcggatgggacacatgcctcgaccccccgccgctacgagttccgaggaggagatcaagaaggaggtggcggccgtggacgtcgtcgtcgccgcaccggacgacgatgtggccgccgatcgggaggaggaggaggaacagaagaagaggaagcggaggaaggagaagaagaagaggaggaggagggcgccgagcgaggaggaggaggccgcgctgaggtccgtgctccgctgggcgcgccgcggcgaagcgggcgatgaggaggcggacgggcagcgccccgctgcgaccgggaggcggcggccgcgcgtcgcggttgagctgcacgcgcactcgacgtgcagcgacggctcgctctcacccgcggcgctcgtccagcgcgcgcaccgcaatggggtaagcagtaagcacagcaccgaaatgcccgcgaacacgaacgatctcggtcacgcttgcactcgtcgtcaccgcaaatcgtcgcgtttcctaacgctaatgcccttgtgatcagcgcaggtgaaagtactcgcgctaactgaccacgacaccatggccggcgtccccgaggccatcgaatctgcgaagcagtgctccatcaggatcatacccggtgtcgagataagcgccatgtactcaccaaggtaaccaaaacatcgtactctctagtctctaccgccttgcacatacacagtcctgcatgtctgatcattgccgtcttgccgatgtcgttgatcttaatcagtgatggaataggagccgaggaacccgtccatattctcgcgtactacggtagtctgggccctgcaaaaccacaagaactcgataggtttctcggtagcatcagggatggccgctatacccgtgcgaaggggatgctgctgaagcttcggagcctcgacatgcccatggagctcgaagacgtgtgcaccattgcaggggatggagtggctccaggccggttgcacgtggctcgcgccatggtagaagctggatacgttgagaacattaggcaagcttttagcaggtacttgtatgacggtggacctgcttatgccacgtgagtatcctcctaatttgtccatgatcaatgtatgtctttgcaactatacttatcaggtgagtagtttgatttactcgtggtgtggacgtgtgttttttcttctgttcatttgcagtggcaatgaaccagcaggggagtctgtggtgcaattagtttgtagaaatgggggtgtggcagttttagctcatccatgggcactgaaaaatcctgtggctgtgataaaggatttgaaggctgctggcttgcatggcattgaggtttacagaagcgatggcaagctatcaggtatgaacaaagatgctcgtaaaaataaactcttttaatcactcgagtggaactttgattcgatggaataaccggggactgtatcttcgacaggattaagtgatctggcagatacatatggtcttctgaagattggtggttcagactaccatggacgagacgacaaggatgaacctgacgtaggaagtgttgatcttccggtcttggctgtttctggatttcttgatgcagctcaaccaatctggcacaatgctaccaaggaaattctggcaaatattactgaaagggcacctaatggctcaaagggactccaaaggactaactctgcaaaagatttatgtaacttgcgtcttctttcttcagacctggaggtaacagattctacggaggttgaggtcctccaaacagaactttcagatgttgtcctcagtaactgaggaccataagacacatattgaacaatgagcagaaatcaccatccctctagaccctctccagtcacattggctggtctggagcagttcaatctaaactgcaattcaatctgctcatattcttggagagaatacaaattgttgcatgtgacgccgttttatattattggctggctggattggaaaagtttcaaacggtaagagttgatcatttgcatattacgtaaaatcattttaggatatctgtaacatttcgtgcacttttttttcatcacttctccaaagtccaaatgctaacaaataaagttggaagtgttatatggacatgggtgcaagcgtatattatatcatctactccctccgtcccaaaaaaagacaaaccctgagtttccgtgtccaacgtttgaccgtccatcttatttgaaaaaaatatgaaaaaaattaaaaagataagtcacacataaagtattaatcatgttttatcatctaacaacaatgaaagtactaattataaaaaaatttcatataagatggacagtcaaacgttggacatggaaactcaggtttgtctttttttttgggacggagggagtacgcacttattttgcatatttgtagagctaagatcatttttcaattaatggttgtgtgtctaacggtataggctggagatataacccatttacttattatctcaaactaaaaaaagatcgttttctactaattgtctgcggatagtttgttttatcaatttccagcgttttatggaatatagagatctgagctttgagagcttccgagttcaaatttcagaaagaatattctgccgcttaagcgtgccatcttccgtttgtgccaattttgcagcccattctgatagattccatggaccggcctatgtaagcataacagcacgtgcatcaaataaggcttggccactgggccctgtgaaacgctcatgatgcgcacgatatatagatgaatgaattttatacattatagaaatgatagaaatgatagatgtatatgtttgaataatgtgaaaataatatgtaaataataattttacattaattgcatattgaattttaaaaatacaataaagttgtaaataatatgtcatgtttacatgatacttaaaataccctagataataaattgctagtgtatgatgatgtgatacacttgcacgtgatttaaaaaactctagataataattgctatttagtgatgatgtgacacacttgcatgtgaagctttagaaattagtgggcatcaactttatactaaaatactgtatgattttgtgtcgcgttagattgggttgtacttgtactagtcaaattcattacaacccaattcagttaacaaaagaatatgagcagcaactatatccagttaactgaattcgtttgctaactgaattggaaatgaatgtgtgtttattatataattttagtccaattatactgtcagtagaaaaaaatatacaatcaataattaagatgatagtataaatagatatgattgattaaactataaatgatttagattgatttactgatagtagagactagagagaacttgaaagcgtcgaaagcgcaagcacgaatttttactctagtatctaaatcacattaacctttttactcatttctaaacgtggcataaaatgtcagtagttcacattgcggcgtaaagcccctttcacccttttccccgtgaaaaataaaaaggaactgcatggcgatcttctggggcccaaccatggggaccgccggcgacgcgactgtcggtcataaaaggaggaatatatcccaaggagtaataatgctagagatcatcagttcatcacaatcacataaggataaactactactgtcatggcaggctaacacattatacctggtaatttcaggacataattctagagaagatgggtcgtgattgctgaaatattccagagagattgaaggatcccatcgcaattcacaattcacgggtacggttgaaacacttgaaacgtttctttcttgagctgtagatggacttcaagaacaggttcccggagtgatttgatcgatgctggcaaattaacaaatgtgtgattctttaagagtaagagagatttcaaatagccatttgtaaactttgtttcttctccgagaagaattctttgttagtttttgaaaacttcgcgagaataaatcttgcaagcaaggaagtagacttcttgcaaaaccagcatcattcatcttagcgtaatgaactttacaagatccgaagcttgtaaagtggagatgatgttctcccttttctgtgccatattcacatataatttgacgctgtagagatttgtgctccttttatttcttggaacagatgctcctttcagacatgcaaatctcaaaacaagtacacgtgattcatccgctaaggttttcaattccaggacattgcttttaatggatgttaatgcatttttcttttgtgggggacgtgtttgcagttcattttttaaaactacaaaaataaaaagacgctatctgcagactgatggaaaccatgtgcgccatctgtggtttgcagctgaaaagatgatacggtaccaatctcaccagcctctttggaaacacattggcaaacgcaccctaatgatggatctaactgccatcatgttgctaactgctcatggactgcagctttaacaaatcgcagagtcaaggaactgaaagcacaactgtagttgccatcgttacgaatagctcctttattttacgaaatgtggataatttgttatatatttgtctaaaacatactccctccttaaaaaacttcttgtgacgatgttaacataagcctataactagatacataactagaagttaatttttacgcaccgagaaagtattattattgttgaaaatatagtcatatatcgtcatattttaatccaaaatattaagacaataatcatgacatgaacaatgtggggtgatctagtgataaaataaaacataaataggagcatgcttaagatagaataagcatcatcatcatacatagaacgcaatagcattgtgactaacagaaatatcaaaaaccgaaataacaatagcattgtgactaacagaaatatcaaaaaccgaaataacagtagagggttataccctgtgaaagtctctccaatggattgtgaggcagaactacctccattggtgttatcgatcggtgcaccagctcccgggcagacatgggtgatgcagacgaacaatcgaaaacgaacagaggacgaggagcagtcgtgcagaagcactccccaaaaacccgcctacccggtacagatctcaggcgaaggtgtagttccggaggccctgctcgttccgatctcttgtgcgcgcaagcgatcagaaccggtgaagcagtagcagcacaggcagcggcgcgaggaggaggaagaaccagtgtttggaaagtaaccaacctcggcccggccggccagctcggctcggcgcgcgcgcgtggctttctgatccccacctcaaccggtaaacagggagcctccaataactccctatttaagttgagatactcctcttttaattcccagggtggtattattatccttaacatttattatggccccttgagatttaatagaaaaatcgggcctagcccatttattctaacaattattcactaaattatagctatggacaatctatttggatattgagataaattaaacattttgagaaacaaacttaatagatagtttgaatgatgtggccagaaaagagatgtatagacagtcccaaagacggaattgcttgagaaaccgttcttttgatagcatggagcaaataatcggtgaataggccgaaaataacatgtagtcagagcggtggctttgctgcacattgtataaagagggtctgctcgaaattaagttcacacacgcaaagtaagtctgatgaagattaaattcacacatacaaaagtgagaaaactattagcgcgtggttaataaaattttaattattataaaattgaacatggatttatttgatatttcagagtcaattatatatatgaagttataaaacatactccctccgggctaataatacttatcgttttagataagggtgaagtcaaactttagaatctttaatcatgaatcatttttaaaatatttatcttttaaatatggtgactacatgtataaattaatcttaaaaaatactttaataaaatcatatatttgttaacacttttatacatattatagtagaaaataatggtgaaaattattttttggagaccgtgctcatgtttaaaagataagtattatcaatccggagggagtatcgtttagtaatttgaaaaacgtgcaaacagaaataagatagaatctgtatcttaattgttctgttaatcggaaaagaacgggaactatccatgattgttttgctatgatccagtccagtctacctacaagtcacaaattaaacaccatgagactcgggctcgcaggacacaagagactatcaggaggtaagcgggcaggagcatgtgcctgcacgctgcacagtttctctgaagatctgaagcaggagtgcgtgcagttacttctactgttactagcctacccattatcagtattctgtcctcgggtagctgaagtattgaagagggcagacaggagctcatgctttcacgggcacaactacgactacaccactactgtccctttgggctcttcctgtatgggaggaagatggtggagcactagcgagtagcgtgccatggcgcagaagccgcgtttcaggactcgcatcttggaggtgccaagtcaaaaactagatgaactcgcatgatagtatggcactatcacccgaccaccaaccctgtaaaaacaataagaaatgccaatggagatagagatctactcctattatgtaaaacataattgttacgtgaagcatttcctattttggtagttacttcacaattaggaaaatgctatatgtactaatcttattttaataactcttactaacattgacatgtcatgttgttagcacacctgattttcttttaatgtccgtgtagttaaggcttgtttagtttcctaaaaacttttctcaaaaatatcacatcgaatat

SEQ ID NO: 49812 - DNA, 13852 bp, Oryza sativa
attgcaagacgaatcttttgagcctaattagtccatggttagccataagtgctataataatccacatgtactaatgacggattaattaggctcaaaaattcgtctcgtggtttccaggcgagttatgaaattagttttttcatttgtgtccgaaaaccccttccgacatccagtcaaacgtccaatataacatccaaaaattttcatttcaccaactaaacagggcctaaattaaatggccgtgattattgtttgtgacagtttttaagaatctttaagaatgcaatactgagagagagggaaaatactctctcgccacacacatctcacaaatttttgttgttttccatgccattttacggggaaacgattccaaactcttgattgaatattttccattttttgcatgtcgtttatatatttataaatatataaaaaatttaacaaaatagattaatacgtgaaagatcgttccacaaatatgtagggtaaaatttaacttctaagtaaaaaaataaatttaattgtacatatacattaactatagttttacttgttcttctcattgcaacttgtaaaagttgaatttattaatttgcatgtttgtgaagtgatatatcacatactattaatctatcatctcatttattttatttttataactatttcaataacttactaccgcatttgtttaatagatgatgccataaactttaggtttgaccattcgtcttattcataaaaaatacataattataatttattttatcgtgagtttttttatcactcaaattactcaggcatgatttacatatattatacgtttgaaaaaactttttgaacaatacgaatggtcacatatgtgtttaaaagttaatagcattatatattaaaaaacagaataaatataaacaattaggatatctcttcgatagtttaaaatccactcactttaagagaaaacgattctaaactccggagaaccattgattgcgtcggcgatcaccgccgatccacacacgtccacatcgtccatattgagtgcgtgatcaggccgccccgtatcgcgtcgcgtggagtagaagggagctttccattaggccccgcgtctttttgactcgggcgatgctaatcacgcacggttagccaacaattgcttggagcattgcccatttcttctcttgtgctgctctccctcatcacctcataccttattatagatggaacatgactgctcttttctcgtattcgaattatactatacttttcgtttggcatatgaacatcggaaggagttttgctcagataagataaccaaccattcgctgaacctgaaccctctagtcaaagagggatcgtagcacgtattttcagctacgtgaagcagaagcacgccaatagccgacagaaattcgcgtacgtgtaaagctggtagataacctgattggtgaggacgagagctcgccaactgcggcgcgctggtgtgcgtgcgtgaacaagatgggtgcggtgaaaaaaggcgtcgaggaaaacaccaaaaattgacgtgaatcgaatgattgggggcgcggcacgcgcatcagaattggattggattccaggggaggggaggagctcacctacacaaaaatgctcgccgtctcgtaccaccacccgtccaccacttgccgccatccaccacccaaaaaaaaaaattcctcctcttcacatccatccatccaatgatccaacgcaaccccaatatctgcctctaatcgacgcaattactgtactagtataggagttcttagttaggttaattttggaaggactagtgagtgtttttgtcgttgagctagctcatttcggagctccattgtccacaactttgtaaattggagagctcacacaggactaattaaacaagtatatcttaattaactagtgtctgatggagattagttttgcgtcgaaatgatgcagcagtttttttagtgcccgatgcctatcttctcgatcagcagcgctcctagattaattcgagggatatctttgattagtgagttcggtagtgggagacgctagcattcgttgtatatatctctatataggctgatgcaagtacagtacttgcagctacttctattttgcaattccatgatccagatgcttctggcagttcattagcccctcgtcttgaccttgcgtttccacacataaatacaacgctacagccagaaaaatgtcacatctcatcttggctacgcatggatcgattaatttacattgatgcacacataatcattactcagagcgaggttacttgatagccctgaattggtgaccaataattgttgttaagtactatatcaccttgctttcgatctcatccactaatccgtggcatggacgagaccactcgatcccgtggtgatcggtggtcgtagatcggtctgactattcgtgcgtaaacatcaagcgcaactttctttcgtgccaccgtaagccacccggaacgaacaatttttcgtcctcctcctcctgtcctgtcctgcagccgcgaggcgatcgacgatagatgacccgtgccgcgcgaacgagccgagcacaccgggcgtgcgcggaaatgctacggttttcttgccaaaaacgcggagatccccgtgcgatcgtcgcggcccaccacctcgcgcgcgcgcgtcgttgcgttttttttttgcttcgcggcctcgcgagacgctgacctcgcgcgggcgcggccgggaggatccatcgaaaacgaaggcgtcgcgttgcacgacgacgtacgcagcgcttgcccacgtggatcggcatcgatcgtttcgagatctccggctccaaatcggcggggcatctccccgtctcgtatgctctcgtattctcatcaccgatatgcgtgtcaacgtccagctccgtgcccacggttgtgttgctcgcgcgggcgctcaacttgcaccagatttttttgttcgccgggatcgatattagaaggcgctgcaacctgtcgtgcaggttgtgcttgtgtgcttatagtacccttcctatcggggcagattacttggccattctaattttcgacgatttgaagctggtctcgatcagctggtggataatcacaaatgcaggagatggattctaatagctcaaatggacatctacccatttattacatgtcaattagatagttatgaatttttttaaaaaaaattgataagatatatcaatatgtaatatatcactccacagatacacaagtttaaatttaacttctacaagttataacaaatttaattgtaaatatacatatagtaatttgagttttgtttgttatttttgttacaacttgtagaagttgaattttaacttgcatgtttgtggattgatatattacatatttatctattttgttcatatttttttatttttttcataactattttggatgacatgtaaataaacgagtagacatacacttaaactgttaaaatagtttccgcccacatgtggttttatatgtactgtgagaatgtatcgtacgtgtttgactcgtgtaggtttgatttgctagagaaatcgcacggtttggcaaaatcaaggcgtacacatatcgtactccacaatctctccggatgatataagtgtccccgaaattaaagctccgaataggtgtggcgttataatcttcggcaacatcttcccgtttgtgctttaatgtgcccaacacgcatttgcaccctagcttgctgctttttcagtgcataagcaacggattaattaattccctgcttctaacggccttctcttcagcttgcatcatcatgtaatttcagattgaacaggtgaaacattacaatcagcacacttgtatcacgaggattaaactcgaaagtccaaagacaaccacgtacagtacatacagacgcatgaatcagctcattgaaaggttgattgtaaccagcaaagtttgaaaaaactattcacctcgccattttttcctccttatgttgctatccaagaattgatgtttgtaaaattttcaccataagtttttgaccaaaatgcattattgaggggctccctactatacgatcacgtggctgtgttgaccgatggaaaacaatttgccaataataaaatcacggctgtacagcgcttgtaattagacctgcaaataatggcgatataattgaggaggcactagaaatcaataatgtcctttttcatgtctaaatcaatggtgcccgcttctccaataccaagaacagttcaagctcaaattgtttctaccaattcacaccactgtttttcttgtaacgcaacaatagcagttctggatttttttcccccaacccagcgaaagaaacaaggtgattttaaaataagaagaatatattcaagatatggtagtagaggcaaaccatcaaactacgcaaagtaaagctgaaagagaatgaatgaaagaataagaatccaacatatcttaatttacagagtaaatgccagtcattgaatacttttcaaaactgtaatggcctcagatggagaaggcttttagcccttggcgcaatccaaaaggcgaattcccctggacaaagggcagcaaaatttgaagtcaatccagcccaccatcagtccatcaaccaactacaggacgccacgtaagcaaaacacagtgtggcgacgtgcacacccctgtcctgagcacacgtggggcatcctcactggctgcaacttgttacccccgcgtgctacctgccgtggcctgacggcatgggcgaaagctacagcttatttgtactagtaattcacatttcaaaaaaaaaacccttttattttctttttgtatattttgtagagaaagattggcaatgaacagagaggaagagagatgcttgccttcggttgcgttgcgttgcttgcacggccaaagtggcgctatataaaggccatggtgtgaggcctcttcttcctcagagagacgcctcaaccccaccccaagaacaccaaagccacatcccatcccatcccagtccacggtgaggttgagcgatctgaaaaaaatcatcagcgacgagcagcaacaggtttgttctctgaacttctctgatctttttagaagcaggtaacacacaagaaaggtcctgtcccaagaaggtacttctttcgggtttattagatcgaaagaggagttcttgtgcgtacaggttctttctcatcccatcaacttctcctaggaggaacagagatccagagaaccttttttctcttctggattcttgccgatttttaggcttcctttgcttttctaaggccagaaagggttgttttgcaatacccttctagttcatcctctcaaatttttcttctttctattcaaaagctctttctttctttgcaccctttgtttctctacttttattgaggaacagggctgatttttcacttcttgcatccaaaaagcaccccttttttctttcctgtttttaagatttccatacccttgccatcttcatcttctacctccatccagtcctcatggccgcagcaatagacatgtacaagtataacactagcacacaccagatcgcatcctcggatcaggagctcatgaaagcgctcgaaccttttattaggagcgcttcttcttcctccgcttcctccccctgccaccactactactcttcttctccttccatgagccaagattcttacatgcccaccccatcttatcccacttcctctatcacaaccgccgccgccaccaccacctcgtctttctcgcagctacctccgctgtactcttcgcagtatcatgctgcttcacctgcggcgtcggcgacgaacgggccgatggggctgacccacctgggcccagcccagatccagcagatccaggcccagttcttggcccagcagcagcagcagagggccctggccggcgccttccttcggccgcgtggccagccgatgaagcagtccgggtcgccgccgcgcgcggggccgttcgcggcggtcgccggggcggcgcagtcgaagctctaccgcggagtgcggcagcgccactgggggaagtgggtggcggagatccgcctcccgaagaaccggacgcggctgtggctcggcaccttcgacaccggcgaggacgccgcgctcgcctacgacaaggccgccttccgcctccgcggcgacctcgcgcggctcaacttccccaccctccgccgcggcggcgcccacctcgccggcccgctccacgcctccgtcgacgccaagctcaccgccatctgccagtccctcgccacgagctcgtccaagaacacccccgccgagtcagcggcctccgcggcggagccggagtcccccaagtgctcggcgtcgacggaaggggaggactcggtgtccgccggctcccctcctccgcccacgccgctgtcgcccccggtgccggagatggagaagctggacttcacggaggcgccatgggacgagtcggagacattccacctgcgcaagtacccgtcctgggagatcgactgggactcaatcctctcataaacaagcagaagcagctactactagtctattactagtactagtagtagtcttcgtcaagctagagtcactcaactcaactagctgtgtaatcttctctgaattccgtggcttccatggctcggtggcattttagacgtcggccatggctgctgcgagtagcagtaactagtcagtactcagtagtagtaaggtcgttggtattacgtcgtcgtgcaagtgtcgttggtgtactcagtgatctgatctcctggttgagctgccggttgtttttttcacggcgcggccggtcgagaattaagctgtaatcccttgttacatgttggaaattcagtagcttatgtaactatatgtacctttctcacgtgcttgtctgatctatatgtgtgtagttgtgtactctcgagttgcctaatcagttgtcatgccttctgattgtgattattatgtctccgatgctactatgctagcctgcaattgcttaccatcagatactgagctgtgttaatccacatagaaaggttaagttttcattcatctttgaaaaagaattaaactttgatgagcttgtaaagtattcatggctgcgaaaaatagatgccctactaattcatacctctcccggctcttctctcaggctatcagctgttcagatattcagagcagttcagttttttttcactcctgcaacaaaatgatccggccgccatccaccgtgcatcaggcgtaaactgcacacaattgattggaggagccggagcctcagagatgagttcatcgttcgttggcatccaaattcccagctcacctcctgagctgtttcagttaggatgcacacgaaagcgctaacatcaccggggcgtcacaaaaatggcgttttgtttactacaacatggcaatttgcaacggatgcatccggaatctcgccgaaccccatgatgcaagcgcccgactagccgagcttatcctccgaaaacgacatgcgggtcaccccgggccggccagccctcatctcatcccatcggcgtctctactacggccttagccttacccttattcgcccccactacacgcatttctttattaataatccggccatccaagtcgatcgccggtgaaagctaagctaaggaagagcataaagaggccggccggagggaggtgatgagatgaggcatcatatcatgatcgtccattcccaaccaaccttaccctctcctctcctctctatgaacctattttcatccctttgttctcagtaatgcctaattgcacatcactttgcgagggataccagtaatggattaattaaacgggaatgctacgtggcagaaatttggggataaaattttagagatgttggatcattggaaccgcgccaagatttgtgcttgggcttcttctcccctgactccagcgagttctccctatttttcgacaccaatgacaccccccaattctgactggtgacctacagattagggtttggaattggagttgtcacatagatagacctttaatttaagctttatttggttagttccacacctacatctttccaatcacttaatcactttcttgtaggggattaacaaaaacaagccctagcaaaaaaaaaaaaaacctaaaaacctatacatactccaaacaaatctttttaaccgtttgaaactttgatgtaactatataagtagttaaaaaattctagatttactcagagcatatcacgttagcgtttctaaaagttttataagaaaaactctgcaagtgttaacttttccttcataaaagacagtagctttaaaagaaaagtcaaatcgctttaaattacctacacttatattataatcacactttacatttagaaatttacactgtaattagtttatattgttattttctaaatgcacataggattaaacataattattatctattcctacttgaaagagaagataagaaagatagaagcatactcatttttaagagagagaacaatgggaaaaagttattaaaatcaaataaaaatatggtgctatattttaagaaaaaaaataaaatccttttagcatcaacggctttgctttcataggggagcaactgcagcggccagcggccagaggccactcgtacatagctccagccaaatcctccctgtttataacaactaagcacacctgttaattactcagcacctttattctcccttgagcatcagaagaatgcggcaaggaacacgcaaaaaacgcacgatacgattctatctgattaggatcgacaataaatctcaattactagcgagactagttctaatgtaatattcttcttttggcgttgccgtttggtgtgtagagcaggaggaggagatgggacaagagttaagatatgggctggatttgatgagagggaaaaaagtggacgggcatatgatgcgttcatatcagcggaatctgtagctcgcagtagcagtagtagattactgctacctctgtttcaaaatatttagcaccgttgactttttagcacatgtttaaccgtttgtcttattcaaaaacttttataaaatatgtaaaattatatatctacataaaaatatatttaacaacgaatcaaatgatagaaaaaaattaataattacttaaatttttttaataagacgaacggttaaacatgtgctaaaaagtcaacggtatcaaacattttgaaacggagggagtagaagttaagggtcggtttagaaaccttatgttggctgtaatttctcataaaatctccttatgtaagaagctctccaaataatttagacttttattaagattttaaaaaattatagttatagaattaagaggttttcgagcttcttcaaatttttaacagctactccagttctcagaatctattcgcgaacaggacgtagggctcgtcaaagtcgcggaaagcgccatcaccacgcaccattgcggatctgccgtgctgctgcctgcccaactctcattatttggctggctcactctcgctctcgccctctccgtccactctggattcgtagagcgatggaatccgccagcctgcgaatggagacagagcatgctagctactcgtttcctcctttttcagtcaaactggttctagaagtgcattagagcaggtcattagtttctcggcaagttgggggcgtgaatgcgacatggtaattacttgctccgatagtccgatcctactcctacctgctgatgtcgtagtagtatctgtgtggtggtaatttaacttaaacgtactgagtgactgatgaactgacctacagggcagggtgaaagtttggaactttagctgttgtcctacatttttaagcccagtggcatctgatgattgacgcctccgttctggaacttagctagtagtaaagtctgattaggtttaactaccatgcacgcgtgccacacatactactcctgatagcctgatcgtccctttcctgcctggctctggcgtgacatttggcctatacccattgtacacggccggtaaaactctcctagagtggcagccgttttcctggtcggaaagacccgcgtgtacaaaaaagcgagtctttacgatggaaattacgcgccttctccgtgcccgtgaggccaggccacacacacgagatacacaagcagcaggagcacgactgcacgagtgtttgctactgatgcctgaactgaagtagcccataaatcaagcctggatacataggccaggccagactattccgaacactttaggctcgcggacccggctgtttctcccactcgagtccaccagcagcttgccccgatgccctgtgctgcgtggccggccgcgcgcgggccgcgggggccggtgggctgagctgcatagtggggtacgtttgcacgtcgccggattctctcgagcaggccgcgagacgagcggcctgacggtgggagaagccagcgattcgcgtacaatcgcttgggccgaacagccgggagtatggggcgttctcgacctgcggtggcctcgccagcccaagatgaagaatccgggtaggcctcagtgtagctggacccgattgacaggctgcgtggaatcgcatcgtaagccatcttggttcttgcatgatcaagcgtattccgtccggcctgccaagcataaattccataggtctctctttctccactcctgaatccacgatacggtgggctgcaacttaaagccatgatgtcatacgatcagtacacaaaacagggatgatacgatagaagaaaaaactaactacgaagtactctagagcatataaataatactgtagtcaacacgggacttgcacgaagtgattccggaagaactaacgaagatacagctcgccaataactccgtacagtgatcagaccctccacgcatagcaagttgcgcctgcgacattcgcggtgaggttgtagcctgtgtttagttcacaccaaaattaaaagtttggttgaaattaaaatgatatgatggaaaagttgaaagttcatatttataggaaagttttgatgtgatagaaaagttaaaagtttaagaattattttgaaactaaatacggccgtagtcaagaattatagcccgcgtctggtcttctttccaatggaaagctgcacctgcaagaacctgacaggagaagccgacccccaatataggagtactagtaaatggcaggggcaatcgatcaggttcggacaagccactggctgcctagccggccgacccggcccgcttttgacgagcccgcgcatgtgagtttcccggcacgagtgacggcacgaggcctgcaggctcgctgccaactgtagtgtactgtacatgtgcaatacgggggcacttagaaatgtttgacaccgttgattttttaacccatgtttaaccgttcgtcttattaaaaatttttgtgaaatatataaaattatatgcttacataaaaatatatttaacaataaatcaaatgataggaaaagaattaataattacttaaattttttaaataaaacgaatggtcaaacatatgctaaaaagttaacggtgttaaacattccaaaacggatggagtatattctacatgctcctatactatatgcccatgaaatgacgaaatggaatctcgcacatcctgcgtgctgtttctagattccagcggctcgagctctgatcctctcgtccaagcagaatccggtcaaagtctagattctctcatccccgactacgtgcgtgccccacgcaaagcagcatatatctattgcttagcttagctaacccctgcatgcaaagaccaagccagtaggaaatccacccagccgtatgtgccatgcatgtgaggccgcatgctggggttgtgagagagagattattggttggcgattcactcgagcaagcaaggtaagctaagctagctagcgaccaatctcctgccgttctttgctataaaatgactcgaggaaaagaagggaaccttttgggccacgtgaaatcgaaagctgttgcacatcccatcgttgccgtgcgcgatgcctgttgctttatggtgtcccccggtccatttgttcttttataactcgacagggttactgggataggagtagctagcatgcaagtatgcaaactcttacaagtacgcaattatagagaccactagatcatgcactattatgggtttactgattggtgcctggctgccaatggctctccccttcctctcgatctccacggccgaaagctgattgcagcatctttcttcgaagataagtatatactgtactgcattagcagcatacggattacgttacttttccacaatactatgcctctttccagtactacagctattcaacctgcaggcagctgagggattctctctgcattgttaatataaactttctattctctattgcaccgatttacatgctatattactgttaagtttgtctagaaatggcaaagtggctattatatatgtatgttgatagttaaaatatatatacatgtggcgcggcagtcctagtcaagtttctctctaaaagcaaatgcgtgtgtggatatatattgccactactgttggaatactcgtattattggttatggatgcgtacttcctcctccaatttccatcacgccgcacgtagaaattctccatgatcggaactgcacagtgcatagcatgtaagggctagtgactgtttcagattaaaagaacggaatagtacggtagtatgcacatcaccatcatttgagcgaggcaccaattaatgtttcagtcaaaataatagtagaagaggtaggataacatggtcaaaaggcatgtaactatcaattttgactgtcatgagttgctccaaaattcatgcaagcaagaaactttatcacaagtcccccattcttcgtgcacgcatatattacttgcttcgtttcaaaataaaccaatctagaatatcacacgggttacatacgaatatattgtactagataatatcacatccaattctaaattaatttattctgggatgaaggaagaacatatttagtccatacctatgaccgctactatcaacccccaaccccaaccccctcccccacacgcacacgcactccttggtccctcatttgatcttccaacactccaccacgacatcaccttcgtaattaaacatgttgtactgtggtacatatatgcccccgccatcaattgaatgcaccctttatacttatccataaagttgtttttagcactgccagtctggcactataggatggataataacctgataataatactagaaaatcagtgcgcctattggcatgcttgctagttagcccataatgtgtgtgtaaaaattgaacttcagtaaagcgtcattggtttttgtcattcgtttttgctgcatttgcaatagatatattatcattctaaaacttttttaacatggtagaaccgtatttctatcactcaataatacataataaaatagacattgatttttttagtattgttatttttgtggctcttgatttcataaataaatcttatattaaaacagttcatgtattgcataatgcactctcagtaactacgtgtagcgcccgttccgtcgtggcgtctagcgggaaaattatctcttaaaaaccctaattgcgaaatttgcttccttgcttgttgtctagcgtccgtgccatctcaagatctcaaatccccgatctatcgtcgagttcaattccgaatccaaatccctccaaatcaaattcctccgcaaaagtctattttacctccccc
